United States Patent 7,745,391 (HUMAN THROMBOSPONDIN POLYPEPTIDE) - sequence listing, part 239

SEQ ID NO: 653610 - DNA, 403 bp, Homo sapiens
tatctgagtgcacacttctcttcagcagacagcactggcagtttgagtctgtccatcctgcagcacagctctgataggaactgggcagtcaccaggccctgatcatttcgctaagagagcagatagagttcctgacctccaggccagtcctgatccctgacctaatgttatcgcggaatgatggtaagtaaagtgtctcttgcatctgcatagagagggtcctgggagcttaggaagtgatggggaacagtgatgtatgcagctcatgactaggtggacaggcctctggggacagctggtacaggagggaaagggacctcacgggaggcccagaaacctggtaagaggtgaggtattaaggtctgggatggagaagctctgagggtatatttttctgcctcta

SEQ ID NO: 653611 - DNA, 572 bp, Homo sapiens
tggaggcactaggagtggatgtgtttattttagcatcttatgtggcacctgatatatatgccagcgggtgtcctaagcactttacagatattagctcaggtaatccactcagcttttacagatgaggaaactgaggcagagagagactaaagcatttgcctcacgtcacacagtgagtgatagcagagccaggatgcagagtctgccttcgagtccctgctgttaagtgctgtctttctgctgggactgccaggttcttgccattttgacaagtattataaccaactgggtctctgtttcctcctcataaaatggagagaataatattaactgtcgagtggtcactttgagaagtgtgaagggctccgcagacagaaggaccacttcttatctgatcatgttcccagctggggttggtttgtctccgtttcctcatccgcccacagttagcaggctctggcagctcttattgccttgtaggaccagtgagttcccaaggagatttctggacccctttccccatggcaaccttctcatgttcaacccctgacacaacccctgccaaacctcta

SEQ ID NO: 653612 - DNA, 442 bp, Homo sapiens
  misc_feature (6)..(6): n is a, c, g, or t
  misc_feature (139)..(139): n is a, c, g, or t
  misc_feature (151)..(152): n is a, c, g, or t
  misc_feature (167)..(167): n is a, c, g, or t
  misc_feature (195)..(195): n is a, c, g, or t
  misc_feature (205)..(206): n is a, c, g, or t
  misc_feature (262)..(262): n is a, c, g, or t
  misc_feature (281)..(281): n is a, c, g, or t
  misc_feature (291)..(291): n is a, c, g, or t
  misc_feature (338)..(338): n is a, c, g, or t
  misc_feature (419)..(419): n is a, c, g, or t
ttctcnggttattttctgtttggacccctgggccacaggagtggggtggggttggggcttgggagagtgcaatgtggctttttggtatgatttgttttattgcttgcccgctcagcacgctcctgttactcctaacaangtttgagatttnngcccttaaacctgtnggtttcaccatcagtttttctttttttncttttttttnntttttttgcataggcattactaggggcataaatgggcgactggcatagaaagtggngaggagccgaagccaaggnattgctttanacacaagatgaaaatactctggtcggtccaaagcatcacctattggnggggggcatctcacttagctgtggagaagtcctctggaattagatctcagagagacggctgttaggaccggggaacctttnggcagggggcgaattgccgtttc

SEQ ID NO: 653613 - DNA, 686 bp, Homo sapiens
gccgcatatctgcgcgagggttcccttgggcgatttttctcgagctcactttatcatacctaatacctcgagggctactgtatcaccggacctagcatggtctcgcgccatggttctcagcgatgctgacgtgcggaagctgatgcgcatgtgatggctttcattgaacaagaagccattgagaaagccgaagaaaataggatgcgaaggcagatagagagagttcaatcatagagaaaaggtcgggttgtggaagagccagatcgactagaagatgagtggaatgtaatgatgaggactgagaagagaaaggtgagtggagctgcgaaacgaaaattcagagtgtccgagtgtgactgagtgcaagcggagggtcaaaggtcctcaagagcaagagatgagcttatcgacagacctactaaactgaggcaaagcagagactcagccaaggtggtacaagatgagcaagcaggtaccaaggtgctgctggatggagcgggttctccaggggtagtggcagtgtggtggagcgtccgaagtgattgtgcgttgcaggaaacaagattggcctctggtaatgggatggagtgacagaagggaatgcctatgtagcaataattggcaccgaaaagagatgttgatgtgcaaattgatcaggagtctagctgctgaagacatagctgggg

SEQ ID NO: 653614 - DNA, 1269 bp, Homo sapiens
  misc_feature (396)..(396): n is a, c, g, or t
  misc_feature (535)..(536): n is a, c, g, or t
gcgccgattccgtcctccttggtcagccgacgtccttggctggcgtcagaaagatggctactaacttcctatcacatgagaacgatctacgttcgacaagttcaaatatgagcagacgcagaaaggagattctacgtagctatgatgaagcggtgcctgtgtccaggtgcctcccgaccgagtgatgaacggcagtccagcgtgatcctccgtgcatcattgccgcagatgctcatagagaacatccagaaatccctggtttggaagctcaggccccgggggctccagcggcaaccagcggagaccacggtgagctcgtcgtccggatggccagtctggaagtggagaaccagagtctgctgtggcgtggtacaggagctgcagcaggccatctcnaagctggaggcccggctgaacgtgctggagaagagctcgcctggccaccgggcacggcccacagacccagcacgtatctccatgcgccaagtggagccccagccaagaagcagcacaccagcagaggatgacgaggatnntgacattgacctgtttggcagtgacaatgaggaggacggacaatgaggcggcacagcttgcgggaggagcggctacggcaggtaccgcggacgacagaggccatgaagactagcgctggtgagcaagtcctccatcctgctggatgtcaagccttgggatgatgcagacggacattggtcagtggaggcctgttgtgcgctctatccaaggcttggaccggggcttggcctgggggggctaccaaagcttggttgcccggtggggcctaccggaatccgagaaggctacccgcattcacagtgtgctggtggacggacgacacacggtgggcgaccacacatttgccttggacgtgaagtatgaatccccaaggttagagagacacacgtgagaagtgtccaaccttgcgcacgatttgacaacgcagcgattcggaagagccctgcagacgtgttcggtacgtttacccacggtggactaagcggccctggccatgcaataaccgaaaatggacaacgggcacaacgagagaaacaacacgaagaacacaacacagagctgccggagaaatgacataatgcgtgagggaccagagagacaagcagagatcgatgagtgcagtgatcaccaacgcgtgactgagcaccgcagatgatgtgaccacagagggaaacaatcagcgcgacaccaactagatcacatgtatacatgagccgagcagcaccaacgggt

SEQ ID NO: 653615 - DNA, 185 bp, Homo sapiens
ttacatcctaaccagttcagccgaagagtatcgtagcacaagcataacttggtttgattgaaagcctgggatcaaacgctcagctgagcctccaagcttctcgggatgtttgccttccccaagcttggcacagtccttgtctagcagtacttcagctgtgagtttggagaaacgtatcgatcatc

SEQ ID NO: 653616 - DNA, 156 bp, Homo sapiens
tgttcttttcttctaatatcgtctacagaggtttagtacgacctatttccttttgacaccaaagcgacgtcaaatacaagccgttgtcgtgtcttaaattggctgtacttgtgagtataggtagttcacgtgtttcttttctcactactcctcctc

SEQ ID NO: 653617 - DNA, 260 bp, Homo sapiens
acggcagaagctgtctgcataaagctcaggagttctactattcaaaggaagaacagggaatggagactggtggaaagctagcagtggtctttaaaacactaaatatggggacactgaggcaggagaatcgcttgaacctgggaggcagaggtggcagtgagcccaaatctcaccattgcactccagcccgggcaacaagagtgaaactccatctcaaaaaaacaaacaaacaaacaaacacactaaatacggccaggtgc

SEQ ID NO: 653618 - DNA, 196 bp, Homo sapiens
caagtacttcctcacgcaagcaagcggcgtccattagtcctgctagattagctatcctcttcaacaagtatactctccggacaatgaagcataaccaatactaccaatcaatactcatcattgataatcataatggctatagcaataaaagctcaggaatagccccctgtcacttctgagtcccacttcttaccac

SEQ ID NO: 653619 - DNA, 133 bp, Homo sapiens
gactatagaggatcccagcgcagataaggccaaatacctcacaagaaaaccaggcagccagctgtggaggctgttaagatgctggatgatgatcctcctgcagactgagctgcctcatgtgccctgtgtgact

SEQ ID NO: 653620 - DNA, 167 bp, Homo sapiens
accacgagacatactgcctacggaaaacatagtaggaagaggggagcacctagaacctcagcagcgggatggacgtgggagggatgccgaccggctaatgacttgagcagtgttatggccagtgggtccagggtgggccacaagaagctgatacctttagggtggta

SEQ ID NO: 653621 - DNA, 109 bp, Homo sapiens
ccagaaatggaggctcaagtcctaggttcaatagaacttagagtgtgatttttttaaaaaataggttgttgatattaattgatgctgacaagtggtcatcgaactcata

SEQ ID NO: 653622 - DNA, 316 bp, Homo sapiens
ccgggattaccctccaccacacccggctaatttttgtatttttagtagaggtggggtttcgccatattgaccaaggtggtcttgaactcctgacctcaggagtcccgcctcggcctctcgaagtgctgagattacaggcgtgagctaccctgcccaggctgaccatgtatattcctaatttttgtactttttttttttttggagacggagatccacttttgggccccaagctgaagggcaatgccttgatctgggttaattgcaacctttgcctcttgggttaaagcaattctcctgcctgggcctcccgagtagc

SEQ ID NO: 653623 - DNA, 186 bp, Homo sapiens
agagggggtttctccatgttggtcaggctgatctcgaactcccgacctcaggtaatctgcccgccttggcctgccaaagtgcttttgttactgaaaaaaatcataatttgacacagtgagagcctgcagcgctagtttattagatattctgatttgggctaagagcaatatacaacccagtaacat

SEQ ID NO: 653624 - DNA, 739 bp, Homo sapiens
gaagaggaaggaatcgaaccccgctggagcttggttacagagcgcaaccccatggctccatgagtttttcaaaaaaaaaaaaaagaaaaaaaaaaaaaaacaaacaaaaagaaagaaaaaaagacaagcaaaagaaaaaaataataattaaagatataaataataagagggagtgatgtgtgtacataagaaagacctggtgttacaggaggtaataacaattgagtatacttatacgaagtactttatattttagatagaagggagtgatgagttaatattagaagtgtagtattataatataattacagagtgagtagaagattaataaagtaaataaaggaggagggaaatagatgaaatggaaggtgttagtattattgtatgaaggtgagagaggatatgtaggaggaggaagtagaaaagggatgaaggagagagaataattagataagaagtggaggtaatagggagattgtgagaagagatgataaattagtgaatgataggttagagagagttagtatgtttagatgatatgaagtagatagatgaatggatgtagtttgtgtatgtgatgatggtatcagtaattatgaatgtggttgtgagagagtggtgatgggtagatatggtaagtagagagataaatgatagaatgcgggggggtgataaatgaataatataaatagtagggtgatgttataaattatagatgaggactaggtattaaaggggc

SEQ ID NO: 653625 - DNA, 235 bp, Homo sapiens
aaaaaaaaaaaaaaaaaaaaattgcttttgttcctctgtgtacacagctgtcttcctgcactcctgtgtgtccatccttgggcagaatcagtacagccaagcactaaaggcgaacctctatatagctatcggtgggtgccccagactatcttcgcccctcttgtgcccctatctcagtctgtcctagacagtccatgggtcaatccctgccaccggccccttctgtcgtcttctc

SEQ ID NO: 653626 - DNA, 635 bp, Homo sapiens
  misc_feature (48)..(48): n is a, c, g, or t
  misc_feature (109)..(109): n is a, c, g, or t
  misc_feature (115)..(115): n is a, c, g, or t
  misc_feature (585)..(585): n is a, c, g, or t
aaactccggtttgcttgtttgcacaatgacgacacaaaaacactgtgnggttggacggagctcgcgtctcgaagtgtttctaagatgctattttcagcaggtcactatnaacgcnttctactctgaagcacacaggggctggggctggccttcggagttacgaggaaacgaggaccaggaccagggattctgcatcagcacagccgccaggagccggccggggccccatccctgacactgctgtcgcccggctgtacctgggtgctgtgtccgcggggcgtctggagacgtcgatgtggtcatagcagggcctggaacggggaggtctggcctgaactagagaaatgaggggcgtatccgcttctccaccctggcctcagatgaagaggctctgggggcaggagggagtcagacacgtgcagggcaggcggcctgtgcagggcccaaccctccggcaccagaacctgacctcctcagaggcccccaccatggagggatgtctgggggatgctgtgcgctgccgctacgatgtttggttagagattaaagccatttcagaagtgacacctgcccatgtgatgcaangggctggacccggtctgtggcgatactccgccgggtatacagctcggatt

SEQ ID NO: 653627 - DNA, 563 bp, Homo sapiens
  misc_feature (48)..(48): n is a, c, g, or t
  misc_feature (109)..(109): n is a, c, g, or t
  misc_feature (115)..(115): n is a, c, g, or t
aaactccggtttgcttgtttgcacaatgacgacacaaaaacactgtgnggttggacggagctcgcgtctcgaagtgtttctaagatgctattttcagcaggtcactatnaacgcnttctactctgaagcacacaggggctggggctggccttcggagttacgaggaaacgaggaccaggaccagggattctgcatcagcacagccgccaggagccggccggggccccatccctgacactgctgtcgcccggctgtacctgggtgctgtgtccgcggggcgtctggagacgtcgatgtggtcatagcagggcctggaacggggaggtctggcctgaactagagaaatgaggggcgtatccgcttctccaccctggcctcagatgaagaggctctgggggcaggagggagtcagacacgtgcagggcaggcggcctgtgcagggcccaaccctccggcaccagaacctgacctcctcagaggcccccaccatggagggatgtctgggggatgctgtgcgctgccgctacgatgtttggttagagattaaagccatttcagaagtg

SEQ ID NO: 653628 - DNA, 302 bp, Homo sapiens
ccggtaccggttgacgtggcttgtgggttgaccgcggcttactgcttgtatctcagcactttggaaggcgaggcgggaggatcacgaggtcaggagatcaagaccatcctggctaacacggtgaaaccccgtctctactaaaaatacaaaaaattagccaagcatggtggcaggcgcctgtagtcccagctactcaggaggctgaggcgggagaatggcatgaacctgggaggcagagcttgcagtgagccgagatcgtgccactgcactccagcctgggtgacagagcgagactccgtctc

SEQ ID NO: 653629 - DNA, 1023 bp, Homo sapiens
  misc_feature (334)..(334): n is a, c, g, or t
gaactatcactgtatgatggcgctgccataaatcaccgagcatcatccggcttcaacagagccggcagatgatatgcctaatggaaagcctcgactcgtgcacagatactgggcgaggcttcttcatggacagagctcggtgaatattccatgttgatacagagtgccatataggcttcaagtctgcctcactcttgttgggaaatgaactaagggacattacagaggcctgttgagccttctgccgtctccgacggtatgcagcgggaatgtctcagagcgctgtgagagagatagttatatcgaatgcacagaggtgaaactctgtcccttnaagtaagacatgccagtctggtgtggatattctctagaatacaattgacgctgtacaggggtcgcgggtccactggttgactccctctgcagggcatctggcataatgcgcttggcggagactccaaccttgtggtccatccaggtctcatctagcgagaaacgtcgtcgtaatcgtcctctcggatacctcctttgtattaccacacaaattccaccaggccactggaccgcaagctctcctctccatacacccagccgaatgtaccttggggtgctgaggcagggggtttagcccagcatgcacccaattgcatacccccaggagtgcgcattgtgtggggacgaagctccttgcctgtcaaaccctaagacattctgtacacgcactcaggaattcgggagggacaacgctgtcagggttccacatggcttaccctttcggggagcttgatcctagtgaccttccttgggggttgcactaatactcacggttacactcagcctccaatccggggtttttcccaaggggttcccactcttactccagtctcccccttgttggcctagcaagttcaactaggaagagttttcccaaagattcggttgtcggattcggattctggccccaaccaagcactggagaacgctggaaacttccacaagcacccattcccgccgaacgcgccc

SEQ ID NO: 653630 - DNA, 90 bp, Homo sapiens
ggatttgctggtgcagtacaactaggcttaatagggagctcgaattcgactcgaattcgagcctcgaattcgaggctcgaattcgagaaa

SEQ ID NO: 653631 - DNA, 315 bp, Homo sapiens
acctagtagaagaaaagtgtaggttatatgcactacgaaaaggaccaacgttgtaggcccctacggctactccaacccatcgcgatgcctaaaatattcaccaaagaaccctacgacacgcacatcctcaatctccatgttcattattgcagcaatcctagccttatccctagcactaacaatatgagttccactaacaaatacctaccctctaatcaacataaatctaggagtactattcatgctagccatgtcaagcctagcagtctactctatcctatgatcaggatgagcatccaactcaaaatacgcact

SEQ ID NO: 653632 - DNA, 1165 bp, Homo sapiens
agcgggcactctgggtagcacagagagctcagggtagcctgcctagatggcggcgcgcacctgggccgcggcgtcgtggaggctgctggtgccaccctgctgagggctctctgtggggcagccctgctgcgggacgactgtgctggggttgatgctgcgcctgctgacaagtgggtggactcttgtggaaccctcgtggtgcatgcgcatccccggcagttgcaatggcagcaagcatgtcacaagcccaatgctcggtatcccctgctgactgagttgcaacaggggcaagccccagtggaatgcacaggaactgccttcttggggaggggccttcttggcgcaggctgggaactaactccatccgttgttgggaacgacccacgcccttaaactaacaactcggttctttgggagaccttgggagaacgtttccaagccaccttggcgcaaaggaattccgaggctttgtgtttccctttgtggtgaagtggcccaacgtaaaacaacttgatcagtccgttgggtcaaaagcgttggcgttatggtggacccccaagtcaatttgttctccggcgaaacggtatccccccccggaaaagaaaagcgggttttggcctttggtgactacgtgtggaggaaggcgtcagaatgttgaagcacctgttgggaaagcgtgggaactgtgttgtagggcgtaattcaaccccttaaccgaggaggtgaaagaccgtaacctgtggacgaaccccaacgtcttgacacatgtcagccttgttgcccaacaacgtaaccaggccattgcaaaaggaagtgtgtgccattgggtgatgtctttaccctaacaccaggatgtgtggagagacccccctggattgggttatggcacgaaattcatttaactaatttatgccgcacatggtaggatccccccgccaatttttggtgggcgcttttaggtacggcggaacaggcgaaagtatggactgtgggacccttagattcgccgaagctggaaaatcccagagaagaaagctattatgatgcgcacacaaacaagtagtacgaagttcatgttatgcttagcgttgggacggttatctcaacgtattggcgagagaagttccccattctagcgcgtatttatggacaagtggatatacag

SEQ ID NO: 653633 - DNA, 158 bp, Homo sapiens
tatactaaaaactataaaatagacaggtgtggtagcacaatgcctgtaatcccagctactcgggaaagctgagagacaggagaaccgcttgaacctgggaggtagaggctgcagagttagaaggtacagaattcctagaagcacctatagggggtaag

SEQ ID NO: 653634 - DNA, 137 bp, Homo sapiens
ggaggttgaggcttcagtgagccgtgattgtgcaactgcactccagcctgggtgacagagcgagactctatctccaaaaaaaaagagagtgttcagcagtggactgaccacttagaaaatagatcctcactcaccag

SEQ ID NO: 653635 - DNA, 380 bp, Homo sapiens
ggtcttgcatatcatacattctctctatgatacttgaggtaccagcttgtatttaattctgattcattatccctaaagtagcgtcattaaggatacttagcattaaggacctaagcccaccatagttcgaatccaagactaaagcgtactcgaatgattaaagggtctggtagagaataggaagcagtgctgttgggcacggctagctgttgtcacgcattgtatgcaatgaatttgtctccttctgatctatatgttcatgccagcccatgtactaggcatttcgaatactccaagtaagattttacaccttgccatgtggctgggtattctgatgagcagtgccaatgaattgactatgtccagtcactttccagtat

SEQ ID NO: 653636 - DNA, 636 bp, Homo sapiens
gccgagcctggagatgagggggagccggggcgttcggtgactggagcttgaacgcacgaagtagcctcccggctgtcgggatctcgtcctcccagtacaccctgacacagcctgtcccatgagccatgtgagtcgtgcaggaggtcatcagcgacctgcatggttacagaggtgtggaccgacgatgctgcatgcatgcagggtgctgcgaacgacctcgttcttcgcaagctccatgtggcatgaaatgcgctgttcttccaccttggaggagctgcagaacgatcttcgcccagatctggacggagcatcatcgaggtgtcgattcccatgttcctcgaatcgcctgtatgaagcggaggcaggagagttggctacctcagtcgaggagatcgagagcacgtgctgcttggcccgtgtttggatggttgcttgaggtgctcctgggttccatgaacatctcctccctgtttctgcagcgcgccatgtcatttgccttagagcagctcaaagcacaagctaacgcaaggatccctcgtgttctgtgccttcgctgcaggaagctgagagccgcccgctggttgccgcctgctgcagtctgaaggacatgatccccactggagatgcagcggctga

SEQ ID NO: 653637 - DNA, 102 bp, Homo sapiens
  misc_feature (16)..(16): n is a, c, g, or t
tcaagaagaccgtgtntcaatgcaatcctgcacattttggctgtgaaggccaaatgcaggttatttgacttttgggaaactcagtctcctcctctgagaatg

SEQ ID NO: 653638 - DNA, 820 bp, Homo sapiens
aaacacacacaaaagaaaaagactttttttttttgccaaggccagtgttgctgcctaaaaaaaaaaaaaaaaaaaaaaaaaaaaatatgctataaaagggggaaaagctcccttttaaatgggccccaagttttgaagtctcccttttttttgggctccgtgttagtggtttggttttctacttgttttggtttgttgcaacaatgtgtataacgggggtttgctcgcggggcgagtgggggtgatttttgtgtttgcacatcttgtggtcaggggcgacaaatgtgttttgggcttgtgtctttcttatcttgacccctggacatgtgtgttgtgcgattctcaccccgtgtgtttgtgttttgtgtgtttgtgcgcgcttatattgtgatgtgcccgcggaagtgctcttttgtgaaccgagttagaacgcccgaaatgtgtcttagacaccctgttgtggggaaattctgtgcctcgtgtgtgtgtccccccttatatatccattttccgtggtgagttttacaccagaagaccgccggtgcttaatagtgtgtcgcgctctgtgagggagcccttttaagtgaaccactgtgtgtgtcacaataaaatctctccaatgtgtgcaatcttttttctcaaaacaaacacaaaaacaacaacacaataaacaacaaaaaaaacaacaatacaaaaaaagagggcgcggcgcgcgccctctataaatatatttctccccacagggggggccacccccacctcattatctgctctctctcccccgctcttcttcttgtctaaccaaagggtagctccacaa

SEQ ID NO: 653639 - DNA, 898 bp, Homo sapiens
caaggggtggctcacgcctataatcccagcacttgtgtgaggccgaggcgggtggattccctaaggtcaggagttcaagaccagcctgcagcatagtgaaacccatctctactaaaaatacaaaaattagccaggcgcagtggcacaaccctgtaatcccagctcactcgggaggctgagggaggagaatggcttgagccgggagcacagagtgttggcagtgagtcaagatcatgccactgactcccagccttggccaaacagagcgagattgtcccccccccaaaaaaaacaaacagggagagagactgggctttcaaaggagggcccaagaattacggggttgaacttaaaacatggtttggctggggtggcaatttgggtgggcatcaaaaacttgtaattccacagactttgtggaagggcaagaagagggagttgtggatcacccttgaaggctcaaaaaaggttcggaaaatcaggcttggaccgcggacaatatgtgggaaacccttgttttttaaactaaaaaattaacaaaaaatttaagtgggcaaatggggtggggggcaccctttgttatttgcaaggttccttccaaagaagattgggagggcacgggacggaacttggctgggaaaccccacaggtggggttgggagggttgcgcagggacgccaacaggtggggcgccacatgtggcactccaagcacttgggcacacgggagggtgacaactccgtgtcgtcaaaaacaaaataactacatatcacaccacacacaccagtgttgcgcccgcctgcccctaggaaaaacttttcgtacaacccactgtgtggggggcgcgaccagaggtgagagacacgggggccaacgcgtcacgaaaacaccgtgcaag

SEQ ID NO: 653640 - DNA, 960 bp, Homo sapiens
tcactcatacacgctttgctccttacattgtcgaaacgcgtcactagaatagtcaacaagtttctgccaatatatgtgtcccgcccctttaaacacaaacttttttctcctcccctccccctctcccctctcccttggaacccccgggcacaaattgttacagaaccacttagccgcctaaaatgtccacacacaaccgcgttccccgcggcttactactaataccctctccccccaccagtatattaaaccccctgtatacagagaaccctctggggaaccacccctgtccccgctttaattttcgaactcggccccacagaggtcacattcttcgggtacccctgccccataaggtttggagcgctcacacctggcggagaagagaacacccttgggccccaaaggcgcgcaaacctttccaatgcctcacacgtgctggggtaataatatgctccgcaccacccgcatgtgtgctgatatcttgcccggcctcggcccgactttcggagaacccgaggcgaggcacgtctcacccccagagaagcgagatggtgatatttgttgggataacccccccggtaagcacaaaaggacgcccactagtagggttctttatgccacgagggtgcccccctcctgcactttgctctcggaagttttctgtgctgcccggcctcccctcggctctcccccacaaggtgatgtcgcttggttgcgagatttttaaggatcacatatatgcgtaatagctaccacggagcgcccattatgtgggtggcaggagtccactttccacccgggttctagcagaggcactgagccaccccgcaacaatggagagtgggtgcccaccacggcgaacccccgccccccgcggggggccccgccccacccccgaaagggggcctttccaggaaaaccccccagggacaaaacaaaaaaaacagaacaaaaaaa

SEQ ID NO: 653641 - DNA, 331 bp, Homo sapiens
tcttcatgaggttcctcccaagaattggtcattcattgcagcagcactcgaagcgtcacgctaggcaataccgccgtcgacgcgcaccagagatcccgtggtgaagctcgacttgctcgacgcaagatagagcgccgccgtcacgatctcctccggctggccgctgcgcttcaacgcggccgtcggattgagcttgtgctcctcgctccaggccttggagacgtcggtcaggaagcggcccggcgaaatcgtgttcacccgcaccttgggaccgtactcgaaagcaaacgcctcggtcagcgcgttgagtgccgccttggcgccggcataa

SEQ ID NO: 653642 - DNA, 687 bp, Homo sapiens
ggcgccgcatcccatcgacagttcggatcatatcgccatatcggcgagactcgactcgcaaacggagatcagttctcacataatgacatcagggtatagtacaacatgtctgtagccgtgaggcacattaggagatagctgctcttgaccactgacaatacgagtgacatgtcagattccatagatcagtgatagactagatagctagatagatatgagaagatcgtgagggaccgcaatggagctgtacttctatttgcggacttattggaagaccttgctatggactaacacacgactggcccacgttaccaccacttcacctcagctgacagcctgccagccctcggagctgtgacacctacttgactgcatctgcttgataaataagaagaaccagctggtacctgtaacataaaagaacagcaagaatacagaaacaaagcaaatcatgattcagaatgtcacaatcatcttggatctttgcacttgcatcacaatgttggggatctttttatcttcatgtaaagaagccctggctagcctaatgtaggaaccacctgcagcagaaacaagccatcccaacggaggagccctaatgccaaacaagaaagtggcaaccatcctaaactcttcagccccaagcaaatcaccagccccagtcacatcaccagctgatggtagaaa

SEQ ID NO: 653643 - DNA, 902 bp, Homo sapiens
  misc_feature (24)..(24): n is a, c, g, or t
  misc_feature (125)..(125): n is a, c, g, or t
  misc_feature (178)..(179): n is a, c, g, or t
  misc_feature (186)..(186): n is a, c, g, or t
  misc_feature (188)..(188): n is a, c, g, or t
  misc_feature (221)..(221): n is a, c, g, or t
  misc_feature (257)..(259): n is a, c, g, or t
  misc_feature (264)..(264): n is a, c, g, or t
  misc_feature (273)..(273): n is a, c, g, or t
  misc_feature (280)..(280): n is a, c, g, or t
  misc_feature (289)..(290): n is a, c, g, or t
  misc_feature (294)..(294): n is a, c, g, or t
  misc_feature (298)..(298): n is a, c, g, or t
  misc_feature (311)..(311): n is a, c, g, or t
  misc_feature (327)..(327): n is a, c, g, or t
  misc_feature (342)..(342): n is a, c, g, or t
  misc_feature (352)..(352): n is a, c, g, or t
  misc_feature (360)..(360): n is a, c, g, or t
  misc_feature (366)..(366): n is a, c, g, or t
  misc_feature (416)..(416): n is a, c, g, or t
  misc_feature (477)..(477): n is a, c, g, or t
  misc_feature (538)..(538): n is a, c, g, or t
  misc_feature (540)..(540): n is a, c, g, or t
  misc_feature (543)..(543): n is a, c, g, or t
  misc_feature (567)..(567): n is a, c, g, or t
  misc_feature (570)..(570): n is a, c, g, or t
  misc_feature (575)..(575): n is a, c, g, or t
  misc_feature (738)..(738): n is a, c, g, or t
  misc_feature (855)..(855): n is a, c, g, or t
gaaaaaaagaaataaaatttatgngctaaaaaagccaaaacaaaaataaaaaaagggaaaaggttataaaaataaatatggatcccagtattaaaagttgaacagagaatgtgatttttaaattnttaggggatgataaagttgtgtagaaagtgaacacttacaaattatttaaaanntggaatnantgagcagaaattaaacagttggatgatgggggngggggggagggggggtatgggggggggggggggggnnntgggnggggggcangggtttntgagggggnngggngggnttgattagataangggggggggtaatagnggggggggggggagngatagtaacntgggtacnagaggngggttccactgggttgggaattttgatgtgggccccggaaatctgggggntttcattaatgttggggggttggcgcgggattatggagggaattaagttatttggaatggngagttgatgggtggtttgagtagatggatccaaacttgcccaatagcctttcacctctggngnggnggggtgaattggggggaatggggnggngcggnggataatgggaaagtgagaatgttgtcttgccacctggttcagcttggccagatcgagcggagaaatggtgtgttgtccttgaatcgagtaggcatctagaggtggtccctccaggtcatgggtggcatgggggtagcccgcagcgtcgctgacccgatcttngccgcccgcgcagatgactggggagctggccggcatgggctggtacggaatggtcatgactctcccttgcggagactgggagagcgtctccagcatgaccaggcaaatctgcttganacactcggtgacagactgcggacccagcgatggtgatggccgctcgt

SEQ ID NO: 653644 - DNA, 154 bp, Homo sapiens
gggcctctgctggggtggcagccgggcgacaggcggaggatgtatgccgccaacgtccgaccagccgtcgtgcctgagcaccaacgccgctgctcgcctcctcaggcgccgccggtccctgcgcctcaaccgcagcagtcgccggcgccacggc

SEQ ID NO: 653645 - DNA, 269 bp, Homo sapiens
ctacagatgcttatcgtgcacgaatgtcgcgcaatgcagtagttgactggtgctctgcacgccacggggctcttgtggaatctcggcgcagcgtaaggagcatccagcatgacctctttgtctgggaacacccggtcgacagcccagtgcccagggcctcgtcagccaccatcttgcgggcggtgaaggccagctcgttgaccaggctctgtttcccgatgaccttgggcaggcgctgcaggtgttcctacatctgcaaggaacccacg

SEQ ID NO: 653646 - DNA, 277 bp, Homo sapiens
atgtagccccagagaaccctctcaacatccccttgtaaaatcaaatagccgagtccaccagaggccacagctcattggacaacaaggaaacaaccttgtagagagagtacaaaaatacaacggggcatagtaggcctaaacagcagacaccaattaagacagcgttcaagctcaacacccactaactaaaaaatcccaaacatataactgaactcctcacacccaattggaccaatctatcaccctatagaagaactaatgttagtattgtatacag

SEQ ID NO: 653647 - DNA, 1066 bp, Homo sapiens
ctaatttacaagaacaccgcggcctgaggcctggagagtcccttcaacccggtgaggcgtgcggctgcatgggagccgagacggctgcctattgccctccagcctggtgcaaaaagagctgaaactccgtctcagaataaaaaaataaaacttggctctgaaaccgggaatgctgcgcggatggcggccaaggtgccctcttctttcttcccgtgccgtgtgtcccggaagggttacccctaccagagggcgccccgggactcccggcaaggcgggaggagaagagggcgggagactgatgccgaggggccgggaggctcaaagggcccttggtgggccggctcgtggctctcccggcacatcggcaagggcgcggggcggcgtggaccctgaggggcctccccaggaccaaaggtgtccccagagtggctgcgctggacgggcagcgacggcgcttgtgagaaaacccggcagaaaagaacgcgctggcgctgcagcaggggagcccggtcacaccgcccgggcgaggacagagacttctccaccagagggcacgacgtttacgcacagggcccaaagaggcccagaggttcccatggagggtgatgtgcaggccccccgagtatacaggtcccgtgagcgggggagaaaggcaccacggggggtgtgtcaacaaaggaaaccgctccttacgacattcccagtaccggtggtcgcaccgaaaagggtggacatgagagtgtccatggatggcttagcacggcacacgacagcagggatccactctggaatcacggttcggcaccggacccataagttctggcttgtgggtgaacactcctccactttgggttcaaaacccccccaaaccgggacacggtatttctccccttccccgtggaggcctttccgcttgatacccttatgaggcacccaaggaatacttataacgctcaatagtggtagagatacattggtaaaccagggggtggaaaatgacgagtaggtgaacagaggggaaacccattacgcgtggggtagactgtgatgaaagggagacactgag

SEQ ID NO: 653648 - DNA, 212 bp, Homo sapiens
cggactccaagcaaaggcttatgaaagtctacataaaatagaaatatgtaagagataacatgtgaaatgtacactcaggtctaactatcataccttttatttctctggttaagaagtagactggacacaggaatcaggaagtcccagacggaagagagaaagagacaggagaaaacaagagggcgaattacaccaagttaccagacattcag

SEQ ID NO: 653649 - DNA, 800 bp, Homo sapiens
ggttctaccgcagttcctgtctctctgccaacgaccgccggatggcttcccaaaaccgtgatccagacgccactagcgtcgccggcgcccgtaaaggagctgagccgagcggtggcgacctgccggggtcgcggtgggacaataaggctacagcagagagctgatgacgcctctagtgatgtcgtgggcgatataatggtgattgtctggcacgttcgcccatgaaaatcacgatcaatcctatttacacggtgtggtaggtgacctatctcgatgagagacagccatgggtaacagtatatgaaggacctgaggtatagacgctttcgctagatgtttccctcgagtggctacgctcttacaatgcagcaccaacaagtgaagtatccatcgacgcacgcatggtatcgacccgcgaacgtaggacgaccgcgaggtgtagacatatgccgtggaccatacctgaagggaaacagtgtgtctcgtccgtggtcatggatggttcaggaccgattactgctcttcgcgatgccagagcacttactagggcagaatcgcgagcgatgtagatgaagtacccattgaagcgactacattgctggcgaggctcgtggacataagaccccgaccagtgtttcagaagaaagtagcgcgtgtacagaataccttgactcaatacgcaggtacacgcgagccgaggaggccactgtatccatggctaggcgcagacctgtgccttgttggtcgtgcctttttacattgtgtcgcttacggatggtcatgtccggttgttgtgacta

SEQ ID NO: 653650 - DNA, 297 bp, Homo sapiens
gcgctcaatggaattcctttttttttaagtataatgagctctgtgagattgcaattcagccctctctttagtttatgaaaatttttttccatatcactttaattattatctcttctgtcttttctctcttttacttctggaactcttcttatgactgtatgttgaggtttccttgatccattcaaggcttttctctttcaacattacgactttcatcgctttgtatttttacttcgcgctttgaaatttcattaattggctctttcatactgccagttagcatcgatcttctacttt

SEQ ID NO: 653651 - DNA, 329 bp, Homo sapiens
  misc_feature (46)..(47): n is a, c, g, or t
  misc_feature (56)..(56): n is a, c, g, or t
  misc_feature (62)..(62): n is a, c, g, or t
  misc_feature (65)..(65): n is a, c, g, or t
  misc_feature (74)..(74): n is a, c, g, or t
  misc_feature (94)..(94): n is a, c, g, or t
gcttctcacgctgtgctcacggttcgtgccatcaagccactctatnnggagcgagnctgggngcngttcactgntgcagttgtgtcctggctanatcagaactcgaatggccttgttatcttgctctggggctctatgtctcagaagaaggacagtgccattgataggaagcggcactatgtacgacagacggctcatccctcccctgttgtcagtgtatagagggttactttggatgtagacacggttcatagaccaatgagctgctacagaagtcaggcaagaagcccattgactggaaggagccatgatcctcagctgaggggtgg

SEQ ID NO: 653652 - DNA, 877 bp, Homo sapiens
ctctcataagccctcaacatccactccctcttagccaatattgtgcctattggcatattagtgtttgccgcctgagactgatcgtgggtactacccgtattagtctcaatctccaacgactatgatggcctaagaaatacggtacttgtaaccatataaccgtatgtcccgatatgcgaaggaacttaaatcggtcccccatctacatttatgatcagatctacaaccgacgtggacactggattttctcacattaaacagacccccgtcacatttggaatcaaacacaaaccaccccaaagcctaattattcagatatcatcccttctactatttttttataaccaaattcaaacaagcaacctatttacgctgtcaccccaaacacttattcctccgaaccccctaaaaaaaccccctcttaatactacagttacccttgactccttaccccttcaccattcatggcacgccaaggccaacttatccagtgaaaccatcttatcacgaaaaaattttctacctctctatactaattctccctacaaatctccttaatttataaaccatttcacagccactagaactaatcaatatttacatatctttctgtcacaaacccaacacttttatcccccaaccttggctaatcactcaaccccgatgagtgcccacccagccaagaacacgccttgaacgcaggcaccataccttccctattcttacaccccctagttaggctccctttccccctaattccatccgcactgatttctaacactcacaaaacaccttagtctcaataaaacattcttactactcaatctactgccccaagacatatcaacttccgcaccacaacttatttgctcattca

SEQ ID NO: 653653 - DNA, 1067 bp, Homo sapiens
cacacacacactacacacacacagcacgacatagttatgtgccttggcatgaggcggggcatgtgtgtaatatgtgacccctggacttgtctacctatcagggtttccatactcgtccctccccttcctggctcatgctgtctggagtctggcaagcgggcggtgtgttcagacaggtcctaggcctgtgtcgcatgtccaggcactggcctgaccatccgggctccctggcacaagtccccaggcacggagcagctgttgtccatcccttcccagacaagctctatttggtatcacaatgacctttagagaggtctcccaggccagctcaaggtgtcccactatcccctctggacgggaagaggccggaaaattctccccgggtccctgtcatgctactttctccatcccagtacagagtgtccaggacatcttatctgcaggcataagagaattataagcgcagagatttcccttaggcccaggaacttgggctccagctcatcgtgttccttctgggcccattcaatggcagggttctgggctccaagctgaactgggggagacgaacgagataccagaagctaccatggtgactttacctgataggccctacaagatcaggggagtcgcttatttgcggacacgagagagacgaagacgtcacgtttggctacgggggaagctagctgaaaaagtcgatggcgccaggcatgcccttaggaggcacaattctagcagtggagtaacagggcttctgggtcatgattgaaccctttgagcggcctctttgcccagtcctttggaaaaaaggggcccatataccctactgggaatcatctaaggggaaaagaaccgagagagacgagggagatgggaaaggcagggaggcgcccaagagcagacaaatctcgaaaaaacaaaagcggccgccccgcaaggacacaccaagggggccaaccgtgacgcgacacaccgctagtacaaaacagagaaacggagcaccaggtcccggtgcactatccactcggggtaccacccaccgcgtacgaacacaactcgcccac

SEQ ID NO: 653654 - DNA, 314 bp, Homo sapiens
tgggtatcttaggactgtataatggtccacgaggttcagctgtttactacataatgagctgcccgtgaagaggcgtagtatgacacagtgaagacgagaaggaccctatgcagcttcaattataaagtgcaaagtgtatctaacaaagccacaggtcctaaactaccaaacctgcattaaaaatttcggttggggcgacctcggaggtgagaagccaatctccgagcagtacatgctaagacttcaccagtcaaagcggaacgtactatactctagttgatccaataacttgaccaacggaacaagttacccta

SEQ ID NO: 653655 - DNA, 861 bp, Homo sapiens
gatataggagcctctctccctactgctgctacacaggaccctgagactgacctgcgggacgaatccatgagatgagcctgatccttcttgctcagcctggtcggcctgtagtcggatagtaactctggtgtcatgaatcacatgaaagcgtggaatcgtatgaacttaatccctgcattaacaggagagatgcaaataccttcgtatccctctcggcagaatatggagagctgagtgtccctgagaggatccgagaacgctctaagcctgtccacgagctcagtagggacgcctgtgatgactacagacttttgcgaacgctacgccgtggtttatggatacaatgctgcctataatcgctacttcaggaagcgccgaggggccaaatgagactgagggaagaaacaaaaatcgcgtttttttactggcggctgtcacctgatttggtatccccctgtagcagcgttactgaaatacataggcttatatacaatgcttcttccctgtatatgctcttgtctaggctgcaccccttttcccgccccagatcgataagtatgaaaggtgcactgcagtgaggtccaaaggagagtcaccgtttgttgatgttccatagctaaacttctggtgtgctacttgcatctgtaatctgcttcttggggagatattgggccactaatcatggccaccttaccagatcagagatctggcgctcaaactaagtaacttggaagaaactacttaagacggaggaaaagccccaccggctaagtctaacccttcgtgaccgaaggcaggagttgggccccggcaaggaaaagcccctgggcccagcaaaaacttcgccccacaaaagaacac

SEQ ID NO: 653656 - DNA, 274 bp, Homo sapiens
ggcacgatcagagaggagcctgcctctaaaggaaactctctgcaagtcacattccccagtgaaactctgaaattatctgaaaaatgtatatagtagctaaagggggaatcttataaaatcctgtgcaatagacatacatagctgtactcagaagggctgtcttcatctggactcccactagagaacaggcgagctcctgagggctctccaaggctgcagactgaggtccttgagtgcccaggcttgaagcacattggctgtcattctgatgtga

SEQ ID NO: 653657 - DNA, 344 bp, Homo sapiens
atcacagttagtaagtaggggacagggatttgagccctagcagtctaagactagagtctctgtcttttttatttgtattttaacctcaactttattcatctcccatgtgcctgttgagtctcaaaccccctttcttcccatcagctcgggcagcctcatcaagatgacgtgattccttacttcagctccttgcctagcaccggagagggccaagggggctgaagcacggccatgaccccagcactgggccagcacggggcatacgtggcgtggtcacagcgggcccatctgccacttggtgagctcatcatcagccccaaggggaactagactcacagacctag

SEQ ID NO: 653658 - DNA, 112 bp, Homo sapiens
taggcgttgtcagtgtgcgttgtcagtgggtgcatggaagaggcagccaggagagggagggctacccacatgcaggcaatagaagcagggagatactgtttcttgcacctaa

SEQ ID NO: 653659 - DNA, 138 bp, Homo sapiens
ccacactactactacccggtgccgatgaatagcgacacctcgctattcatcggcacctcgctttcatcggcacctcgctattcatccggcacctgtgctagtcttgtctccatagtcttgtgggggtgccgattaata

SEQ ID NO: 653660 - DNA, 438 bp, Homo sapiens
ggaagtgatctcaagctggattcattcatttttttatggtgaacagttgagccttttaaaaaagccaagcatctggctgggtgcagtggctcgcgtctgtgatcccagcactttgggaggccgaggcgggtggatcacaaggtcaagagatccaggctggtctcgaattcctgacctcaggtgatctgccttcttcggcttctcaaagttctaagattacagtcgtgagccaccgtgcctggctggtggcggtggtggtttttttaatttttttaatttttgttttttcaacttttattttgattcgggggcacatgtgcggtttgttacctgagtaacaaaaaaaaagcctctgcctttatgagataaacttttttatattctgtatgagtaagatcatacaaaatttgtctttctgtgtctggcttgtttcagtta

SEQ ID NO: 653661 - DNA, 381 bp, Homo sapiens
gggcgcagtggctcacgcctgtaatctcagcactttgggaagcagaggcgggaggatcgtttgagaccaacctggccaacatagtgagaccctgtctctacaaaaaattagaaaattagccgggcatggtggcgcgcgcctgtagtcccagctactcgggaggctgaggtgggagaattgcttgagcccaggagtttgaggctacagtgagctataatcataccactgcactccagcctgggcaacagagcgagaccctgtctcttaaaaaaaaaaagaagaagaagaaaaaaagaaaagtgctcttctgcccataggaggtaagtagggaatctgggggacatctcataaagagtaagagaagaccaagggttcttatag

SEQ ID NO: 653662 - DNA, 752 bp, Homo sapiens
agcgggcagccgcacttcaccaatgcggccggatcctgaggggacatggctgtgcaacctctgcagcgtctgtgctgctggcgggtgcaagaaactggtggcgacactgcctgatccctggatgcatgtttgccaaggtgacgacggcgataaacgccagcggttgtgagtcagagtgccgtggggagcgcggagtgctggtgtgagtgacaggagagacacgaaagctcgacgtcggcacaagacagggagccgcgcaccgtcttgttcacgggagattccggcttctcagtctcgcccttccatggagggcgttccttcttgctagccaggtcactcatgttcgttcacccctggccgctgcaacgacgaagttcgtcacgtatctactcaccagtgcgtgagagtttgcaaggtggctacttaatcatgaggtgtcacttgcaatcctccgccttctcgggattcataggcgattctcggttgcctcagcctcccgagtagtagctgggagtacaggcatgtgccagcatgcccagctgagttttctgtattttctggtacagacctggtttcgccgttgttggccatgcgctggtctcgagcttctgacctcaagtgatccgcctgcctcggccttccaaacgtgctgggattacatggcgtgaaccactgagactggtcagttattggctctttttaaacgattgtgttgctttctgcctcaatattaatatgttggaagttaccag

SEQ ID NO: 653663 - DNA, 221 bp, Homo sapiens
  misc_feature (3)..(3): n is a, c, g, or t
  misc_feature (161)..(161): n is a, c, g, or t
  misc_feature (190)..(190): n is a, c, g, or t
tanggtggagcgagtgtgtgtgtctattaattacaaatggatcactcggcagaagtacgtgaagcaaacaaaggaattactacaagaaccaaaaattatacaaggaatatttttacaagttcgttctgtgaatattcaagatttttacagaatcatgatcnatgcttaagtggcaactggatgacggccnaccttcaagagtacagtagtgcaaaaagaaa

SEQ ID NO: 653664 - DNA, 215 bp, Homo sapiens
tggtgtaggaaagggctggctgcataggaaggactgaagttggaacggacatcgggaaagcagaggggcagtgaggtttactacaaccgaaaaggactcttgaaacgagaatcagtgttgatgtcagggtgaactttgtgggtacattacttggtgttaagattgttggcagtggtagccccttttcagaaggcaacttgctgtaagtcagggtg

SEQ ID NO: 653665 - DNA, 351 bp, Homo sapiens
ctcattattatacttctcaacgcttactacttattaacgctttatacttctcaacgctttatacttcctctcaacgctttatactttctcaacgctttatacttcctctcaacgctttatactttctcaacgctttatacttcctctcaacgctttatacttcctcaacgctttatacttcctctcaacgctttatactttctcaacgctttatacttcctctcaacgctttataaatcgttgaggaagtataaagggttgaggagtataaagcgttgaggagtataaagcgttgaggaggtatcaagcgttgaggaagtataaagcgttgagaggaagtataacgcgtcg

SEQ ID NO: 653666 - DNA, 242 bp, Homo sapiens
ctttagcttccattttaagaaaacatatggccgccatagaattgtttcttatttatatttaatttatggataaactcagggaatcttctattttaacagtacttttggcgttcatacatttttcatatagcccttctgtctgtaggagggaggttaatgccaaataccattattgcctgtgaggaagaccatcatcttgtgattggaccatactaatgaaatatgaatgctctagttgagcc

SEQ ID NO: 653667 - DNA, 175 bp, Homo sapiens
atccgagtgaaaggagcagcacttcaggaggtacatctttacaccttctctactgtacaacccatcccagatgaagacagtccctggatcaccgccagcacagacagaatccctgctaccaatatggactccagtcatacgtccacccgcttccgccttactgcaaactccaaca

SEQ ID NO: 653668 - DNA, 420 bp, Homo sapiens
tttttttttttcaggttttagttttccaccgagttttatccacacggaaaactctcaaaaactataaaccaaaatgttcactcaggaatatgttttaattttgcttttctttttttttgtattttctaaaatgtctataataatgttatttttgtccaaaaagaaaaatgtttatggccgggcgtggtggctcaaacctgtaatctcagcactttgggaggccaaggtgggcggatgatgaagtcaggagatcgagaccatcctggctaacacggtgcagccccgtctctactaaaaatatgaaaacaaaattagccgggcgtggtgacatgcacctgtggtcccggctgctcgggaggctgaggcaggagaatgtgaacccgggaggtggaagtttgcggtgggctgagattggaccac

SEQ ID NO: 653669 - DNA, 157 bp, Homo sapiens
agtgctccaggacacagtctttctgcacccgcatccggcgtctgcggacagtggccagagcagcttcaccacagagctttccacccagaccgtcaactacgggacagtgggggagacaggtcaccctatcacatctagcccagtacagggtatgggg

SEQ ID NO: 653670 - DNA, 220 bp, Homo sapiens
tggtgttaccgtctagtcggatgcttttctgctgtgccacgatgggaattccacaatgggctgtcctgattaccacaaagtatttgacaaaatttcccaagatcatttcatggatcagctagtaaatgtgagtagtagattagtgctttgggggtagatcataactaatgaaccaccacccaggttcccagttacataataatgacaacaccacagtacg

SEQ ID NO: 653671 - DNA, 396 bp, Homo sapiens
  misc_feature (170)..(170): n is a, c, g, or t
  misc_feature (234)..(234): n is a, c, g, or t
  misc_feature (249)..(249): n is a, c, g, or t
gactttattcagccccacacgctgctggggaatgtggcatgttctagctctgagatgttaactgagagaagagaagtccaacaaagccgatacgtgcagacctgtctacagaatccttcattatccagtttaatcaggagtcacttggtctttcattaacttggtcccanagaaggaattcagtcctagataagtaaatcctcaatttgctgttccctgaagtatggaaatgangttgggccagtattnaatctctgctgccatgagaggccctttctagctaatagataaaaacctctttggctcacacttagtaatgaccttgtggtctttgggactctggctgacctgccattcccggagcaggggtagcggcttcaatttcgtaatcatggt

SEQ ID NO: 653672 - DNA, 126 bp, Homo sapiens
cttgagtctcctaaagcactgggattatgggtgtgagccactttgcctgacctgagctcaaaactttagcacagattttttaaggaaagggaataccatttgtgagggtcatggtcaccgcagatc

SEQ ID NO: 653673 - DNA, 104 bp, Homo sapiens
cctcgtacgagccttatgagctgtgaggtactgcggatgaggtgtcatgtgcgcggaggaggcaggcacacaggagacggctgagaggagaggggccgacgtgt

SEQ ID NO: 653674 - DNA, 248 bp, Homo sapiens
tggtctcaacaaaggttagttctctctacagcaattagaagggtttagaactgggaaaggtcaggtagggagtggcctgatactggcagtattcacgtgggagctccattaccattcgatggagtcttttttttttttttttcacgggggatgtaaggggggccagtctaaaagtcagggcagttggaggcactctgggtgtgtcaccatattacagggcaaaagcttctttgggctctcccttaagt

SEQ ID NO: 653675 - DNA, 244 bp, Homo sapiens
ctcaggcacactacctacacacaccaaaacacatcacacaagcacacatcacacacgctaacacacatcacacactaacacacacatcacacactaacacacatcagcacgtgctaaaacacatcacacgcccacatcacacacactaacacatcacacaagcacacatcgcacacgctaacacacatcacacactaacacacacatcacacactaacacacataccacggtgctataacgggt

SEQ ID NO: 653676 - DNA, 245 bp, Homo sapiens
tggactaaaaaagctcgtgtgtagtagaaagggtggaatgtatggaaaatttattagaagcaggaagtattggttagtctagcttattccctttcagtctttttccaatatttttataaactattgagtacttactggaatttagtcctggggctcttccttattaagggtggtatcataaatacttggatgtttcaaacattctaaataaataatttccaggggcttcataataaaaaaaaaaa

SEQ ID NO: 653677 - DNA, 491 bp, Homo sapiens
tttccctacgaatgcctaatccaaggttcccaaatcggcccgcacatccacaagcacataaaaggaaaaggtcccgtttttatagtagtttaaacgcgctgcttagactagaactgacgatcgcgtagttttaactatctctagcctaggacttttaggatggaattgtatctcttccctaggactttatttgtgataatggtttaatagatttagactttagacttatcttgaggggtggagctatccgcctaaaagaaaagacttgtgaaaggcccatattggctcgaggtactaggagggatacttttgaccggcggggatggagttgctgtctgaggaataaggggggatcgttacttctattcctcccgacgatcgattagctctgaatttcctttaatttgtgtccccgattcttggtgcttgggcttgtttagcttcctgtcgaagggacgcgccggggggacatcgtttggggcccctaaggt

SEQ ID NO: 653678 - DNA, 354 bp, Homo sapiens
  misc_feature (162)..(162): n is a, c, g, or t
agtggctgggattgcaggcacacgccaccacgcccggctggtttttgtgtttttggtagagacggggtttcaccgtgtcagccaggcttttcttgaacttctgatctcaggtgatcctcccgcctcggcctcccagattgctgggattacaggcgtgacacncacgcccacctgtaaccattatttttaaggattgctaccattgggatagttctgtcatgggtccaacttttgggatatttaaaattgatccctgtgtgggctaacagaattaatgttttccaaaaatgtttgaaaattatataggttctccttaattccccacctctaactataatttttggggttatttct

SEQ ID NO: 653679 - DNA, 425 bp, Homo sapiens
  misc_feature (384)..(384): n is a, c, g, or t
  misc_feature (425)..(425): n is a, c, g, or t
ctcacaagtacctatgaagtagctcttcctctccccattttacagaagatagcagaggctgaaagaactgactcagaaccccacagcttgtgagtggtatgaggagactatgtcctctgccttctagcctggtgttcttccttgcatcatgccccatactctgcgtaataaaaatacagcgaggcctttgaactgtaaagaaacagacctgggcaggcagggtggctcacgcctgcaatcccagcattttgagaggctgaggcgggcagatgatcgagaccagcctggccaacatggcaaaaccccgtctctactaaaaatacaaaaattagctgggcttggtggcggcctcctgagtagctggggattagcaggacctggcancaggcccggctagtttgtgtattttagtagagaggggggtn

SEQ ID NO: 653680 - DNA, 202 bp, Homo sapiens
aaccctgtttctcaggctggagggcaagtggtgccatctccactcactgcagcctcgacctcccaggctccactgatcttcccacctcagctactcgggaggctgaggcaggagaatcgcttgaacctgggaggtgaaggttgcagtgagtcgaggtcgcgccactgcactccagcctggtgacagaacgagatccgtctca

SEQ ID NO: 653681 - DNA, 596 bp, Homo sapiens
ggcgggcgcctgtagtcccagctactcgggaggctgaggcaggagaatggcgtgaacccgggaggcgcagcttgcagtgagccgagatggtgccactgcactccagccttggcaacagagtgagactccatctccaaaaaaaaaaaaaaaaaaaaaaaaaaaaaaaaaaaaaaaaaaaaaaaaaaaaaaaatatcatgggggggatcccaagacaaaagacccccatggggggacctgtgtcacaattgtccccttggtgttacacatctcaatcagtgggaaccccttgtccaccctcgtttttgggaactcactgcagttccctattcaagccgttagaaaaagaacaaaggttcccagactgggggattttcaaaagggccgcaccccgttggcggttaaaacaattgtgcgacctgatatgctagggaaaaacgtgacggatttttcttaagttaaaatttatgttataactatggagataaacggattatttgctaataggcctaaagtttcgaacgatctgtgtatagcgaggaatcgaccggaaaaggtagccctgttttacaatttggaacacaaaacccttgtgtga

SEQ ID NO: 653682 - DNA, 310 bp, Homo sapiens
acaacggctaggaactcaatcatatggggaaggtaagtgtactcgagaaaaaggagagagatcacctctatccaaaagagtgcttgatactagcagccccagctactcgggaggctgaggcagaagaatcgcttgaatcctggagagcagcagttagcagtgagattactttagtcgaaaacttcactatttgcagcggaccaaggaacaacacgatcatgctctatctgtcattctaggtagtcctacgctgtactccgtcctggtggcaccctcaatttcaagtaagcaggaactgggagtgatcctc

SEQ ID NO: 653683 - DNA, 1224 bp, Homo sapiens
gcagtaagatcgagcgaggagcccaagagcgagcgcgctagtacggaagctcgagccgcctcacgctcggcgcgacccctactctcgtgcctgcctgccgcactgcgccggcgagatccgccccggtctccccggagagcgagccccggccgcctgcgaccacctagccgcgctaataccgccgaccaaccggcaccgaggcgcctgaagcgagagcagaggaggaggaggccatgagtgaggcgggcgaaggccacctgccaacaagcaaacaatccatcccttcccgggagggctccgcgacgggaaggcggccctgccgagggacttccgcaagggacccgcggaggtgcgcaaatgaatccctgggttggggaacccgggtggacgccccgcttgggggcggcggggaacccagggttgcccaggtcggactcacttgtgatgccaaggggaacaatgaccccagggtgggaagacagctgcgaggccaatgggatacaaggcggagagaccaggcggtcccacccagacctccatgaggaggcaaagcggccgcaccggagttaggaaaagaaaacggggagggacaaccagagagtgtcccgaaacaaaacacgaacggggagcaggggaacgcgtggcacaccaaagaggggtccccaaccgggccagaacgcacgtacagaaggacgaacatgcacaatacaagaagtgaaacaggcaagacaaaagtatgttgacagcgtcccaaccgaccaagttgaacagtcacagaggaagaaatgccccaccacggcaagggaacatgtagtgagctagtggcgacgatcaaaaggagacgaacaagggaacaaagaagcagagaaactagaaacaaaacaggaaaagaacgggaacacaacacagaggaaaaagaggagaccagggacacaggaaaggagagaacccagaagagaagcgccacaagaaaaaccacaacgaagaagcagagcagccacaaccaataacgggggccaacaacgcaggaagagggagcccaagatacaacactcagataaaataacgcacgacagaaggaaccaaacgggagcacgcaagccgagaaaaaaatcaggaacaacgcaagacacacacacgaagcaaaaagaaagaggggagatcgtaggggcgcccgacgagaatagagacgggaacgaaccacaacaatactagcaccacccc

SEQ ID NO: 653684 - DNA, 674 bp, Homo sapiens
ggatctaatttacagtcccaccaacagtgtaaaagtgtccctatttctccacatcctctccagcgagtctgttgtatccatgactttgtaatgattgccattctaactggcatgagatggtatctcgtggttttgatttgcatttctctaatgatcagtgatgatgagacatttttttttcatagtttgctggctgcgataaatgtcttcttttgagaagcgtctgttcatatccttcccccactttttgatggggttgtttgtgtataagtttaatttgtttaagttctttaagttctttgtagattctggatattagccatttatcagatggatagattgcaaagcttttctcccattctgtaggttgcctgtgcactctgatgatagtttcttttgctgtgcacaagttctttagtttaattagatcccatttgtcaagtttgaacttagcccattttatctattgcaaggatacagagtcttaaggacgatcgttatactgtacaattttccttattgtaagtctagaacagacttaaagcattttccgtattagagacaattgtgctctttcctgagcaattagctgcttttgctttatgggtactgtggattggtgtaacctgattaggcattacctactggtatagagtcatgggaagaatagaata

SEQ ID NO: 653685 - DNA, 288 bp, Homo sapiens
gcccttgccctcctttttgccatttttttggggggcccggggggcccgggtgggccccctccggcaaaaggttattggggtttttccgccccggggcaaatttcaagggacctccccaaagggggtgttttccctggatggggggaaaggttgggtcccaagcctcccgggtcaagggaaaacatgggttgttttttcaaaaaccccgggggccttggcggggaaggtgtctttgggacccggcttttccccggggaaattttggggctttttttggtggggttgcca

SEQ ID NO: 653686 - DNA, 937 bp, Homo sapiens
gttacgaggatccggtgttctaacccaggggaaaatatgcggacttttgatctgatagcagcgagacccgtgtcatgtttgatgagatgatagcgaaatacattggctgagaatcttcaactgctggtggaccggaccgatggtcaactactgtattccgtctgcactacgaccgtgtgtactatgtgagtgagaagattatgaagctggccgacaatatttccggggactagctggtgtcggctgggtgacctgcttgggaaaattcactaagaattgccacaagttcggttgcacgtcacaggtctggattatgcttgtaacttatggcaagtataaagtttggataaacgcctggttgcagagcatggtccttcctgtattgggaaccatgtagtttagaatcctggtctggtgtcgaatcaactgaaaatatttctcacgtaccaggcgcaggtggtggaactccatgtagacatcccttaagtgattttgggggtgtacatgccaaatctactacaaagactggtgaaaacgtaagcccatggctgaactgtggattcatctatggtggacataggggaaaacatgtgaggcgtcaaggagaccgtcgaatacaaggaaggcttgccatgacgaaggctgtttggaatcgccgcgtttgtacctggttatgagggatccacatcttgtccgatttggcaacaccctaacacttaggagttctctaagtgcgtctcattcgctagaaaagaaggggacaacaaatgataagtgctaaacatgggttaacatgacaaagaaaatggcaattgacaacggcttgtagaaaagtacactcagacgggaaaaatgttggaacagaaacagaatgtaaacaaaacacgcagacagaagacgacaaaaacaaacaccacagaagacagaatatataacg

SEQ ID NO: 653687 - DNA, 242 bp, Homo sapiens
  misc_feature (217)..(217): n is a, c, g, or t
agaaaactaaaaatccgaatgttctcacttatcagtgggcagctgaagtgatgagagccattaccatgcgttaaggacacactgcggcctgtcggaaggttgtgtgtcgcaggaggcagagcatcaggaagaatagctcatgcatgcttgggctttataccttactcattggattctctgtgtagcataccaccatggcccattgtatatctacatnatagagctgcacattctccatgctg

SEQ ID NO: 653688 - DNA, 283 bp, Homo sapiens
  misc_feature (40)..(40): n is a, c, g, or t
  misc_feature (48)..(48): n is a, c, g, or t
  misc_feature (50)..(50): n is a, c, g, or t
  misc_feature (52)..(52): n is a, c, g, or t
  misc_feature (105)..(105): n is a, c, g, or t
  misc_feature (119)..(119): n is a, c, g, or t
  misc_feature (139)..(139): n is a, c, g, or t
  misc_feature (216)..(217): n is a, c, g, or t
  misc_feature (228)..(229): n is a, c, g, or t
  misc_feature (236)..(236): n is a, c, g, or t
  misc_feature (248)..(248): n is a, c, g, or t
  misc_feature (265)..(265): n is a, c, g, or t
  misc_feature (279)..(279): n is a, c, g, or t
acttgatggccctaaaggaactggatatatcaagactganttgatttntntntctgaagttcacccttctagacttcagaccacagacaacctgctccccatgtntcctgaggagtttnacgaggtgtctcggatagtnggctctgtagaattcgacagtatgatgaacacagtatagagcatgatttttttttatcttctctggcgacatttttnnttctcatctgnnattcccncctgctactctnttccttcacatcctgtntttctagggaaatnaaag

SEQ ID NO: 653689 - DNA, 465 bp, Homo sapiens
  misc_feature (220)..(220): n is a, c, g, or t
  misc_feature (275)..(275): n is a, c, g, or t
gattgttgggaccatgctgcccccactcccgcttttgttggggctctaagttctggaaggtgtgtgcacagagggtgctcatgggactcgcatgcagctctcagcactgggtgggagggcgttggcttgtccagaatggggacgtggggcagccacccctgcccagcgatgagcgcagacacccgtgtgatggggacagcagcccttggtgcaaagccangagacttgatccttggctcttgaccggctggacagacgggaatgaccccaagggnctggggcgttggccgtggggcctccgtggaaatccccaacttagacattctttgggcttggtgtcgcatactgggtgtcacggcacacatttactctgcattgtccccgtctttcccatcgcctagcgtttggggaggaacagggagagagcttcggggcgtctgtctccgtgctctcctgcctccaccg

SEQ ID NO: 653690 - DNA, 509 bp, Homo sapiens
gcgacaggtagaagagtactcctccccacagatacccgtccagtcagaacctataagcatagtagcactataactagagaaatagtctataacacgatctacggtagtaacaggtagcggacatataaggataataggtagggccctacaatccaatagactaagtgtccttaataagagggagatacagacacacagagggaaaaagtccacgtagatagacaaaggctgagatagcagtgacagagtagataaaaccaaggactagacggcaaccaccagaagatagcgagggcggcacgagacagatatctacccaataacagcctccaatagaaaaccaatactaaacaccctcatacaatacagactactagccaccagaactgtgagagcattacatttctgaagtaaaaagccaccaataaagtaggaataaattatggcagcccaaggaaacgaatacacgggctaactatacaaactggatcttccacaaaaaacacaac

SEQ ID NO: 653691 - DNA, 580 bp, Homo sapiens
tctgggggggcccccctttttttctcacaaaaaaaaaaaaaaccgggtgtaaaaaaattcttttaaaaaattccctcgggggaaaaaaaaaagtgagtccccccacctcctcccccccacacccccaacaattgtgtggtcgcctctcggcggaagagatatacccgaagcgtgcggcggtagcacccctcggtgaagaacaatgcgtagagcgggtgggcgtctcccccgcggggagggagaagagacagcagagggcgaaggggagaagaagcgccagggggtcacccctcacatactcttctataacctcaccccacgcagcgagagggagtgtgcgcccctcctcccgccgcgcgagtgcgggggggtgtccctctaaacaccagcgaggggttgtatgaagacggaccacgggcgatgtgggaaaagagagagagaggatcgtgaaagttagcgagaggatttataccgcggaagagagtggctcctcccctactaatcggcggtaaacggaccgaaggagagagtggcgccctcgcacgccccgcgaggaggaggagagtagttatcgaaagaa

SEQ ID NO: 653692 - DNA, 1199 bp, Homo sapiens
  misc_feature (28)..(28): n is a, c, g, or t
  misc_feature (43)..(43): n is a, c, g, or t
  misc_feature (58)..(58): n is a, c, g, or t
  misc_feature (62)..(62): n is a, c, g, or t
  misc_feature (80)..(80): n is a, c, g, or t
  misc_feature (733)..(733): n is a, c, g, or t
  misc_feature (856)..(856): n is a, c, g, or t
  misc_feature (884)..(884): n is a, c, g, or t
  misc_feature (899)..(900): n is a, c, g, or t
  misc_feature (903)..(903): n is a, c, g, or t
  misc_feature (917)..(917): n is a, c, g, or t
  misc_feature (1022)..(1022): n is a, c, g, or t
  misc_feature (1135)..(1135): n is a, c, g, or t
  misc_feature (1139)..(1139): n is a, c, g, or t
  misc_feature (1142)..(1144): n is a, c, g, or t
  misc_feature (1148)..(1148): n is a, c, g, or t
  misc_feature (1150)..(1151): n is a, c, g, or t
  misc_feature (1155)..(1155): n is a, c, g, or t
aaaacactcaggtgctttcagatttcanagcctcgggcagtgnacatagggaatctcnggcngctctgagctagacacancagcttcaggaagagtaccagatcctgatgggaaatttcttttccccattccttttccctcctgagtggagggagtcctcttcttcgcctccctgagaattgctgtgctctgtattgagagcacctgcctgctgacttagctcaaaggcaagccagaacccttccctgaagactggcaagaggtggtgtttagagcaacgtccaggctaagagatgactcctattaactgctgattatctgttactgctgccctgagctggggcccaagggctgggaaatctgttggtgctaccctgccctaccattcacccagctcacagactgccaacaggaagtgctgtttggctagtttcctcccacttgtctacccctcctttgtccttagaccaacatgtttacctctctgctttgccaacttagccagcaggccatccccggccctaacgtctcctggccattatctcttagttatggctttcacgctctcaataggattctgtatttggtcccaatttcctcaagttcttattgaggttactcccatcaattccacggagggaacagtagttattatagaagcatttgcgctctatctaaagattaaaaatagaatctgcttttatttcccaaagtctgtctctgacggttgagncattgaactcaggcagagggacgaggctgggcagggctgtcctgagtttaggggcctatccctgcatttcactgagacctcggaatctcctctgtgaattccacctgcctagttctccccttncatcctctctctcttcccacatcatcanagaggaaaagctctnngtncaaaaggaagaganaacgtaagcatcttatttgcttttaaaagaattttaaaccatgaaaaagatatttttaaagaaattcaccgagaacattaaagttcattatattaagtatttatnatgtgtgagaataataaatatataactgcagctagtaggtccctttccctaatcttttaggtcatatgagtagggtttgcttggtgccagtcctgtgcccttttctctccagncatnttnnntgtngnncagnaaagtattgcactgcactgtcagagtctcctttcactatacttt

SEQ ID NO: 653693 - DNA, 381 bp, Homo sapiens
ccagtgagcagccgggcaaatttcaccatcaccaccaagcaaaaatcagcaaaaacactcctgtgtgtcagaaatgggagggttaagggatgccagtaaagtccatgccctcaggaaaaacaatactgggtccttagctcttgtcaaggtaactgccaagacaaaacacccaattctgtgtatggttttctccagattaaaaaactaactcggctgggcgcggtggctcacacctgtaatcccagcactctgggaggccgaggcgggcagatcacctgagatcaggagttcaagaccagcctggccatggtgaaaccccgtctctactaaaaatacaaaaaataagctgggcgtggtggtgtgcgcctgtaatcccagata

SEQ ID NO: 653694 - DNA, 1386 bp, Homo sapiens
  misc_feature (608)..(608): n is a, c, g, or t
gctcctcgacagctcaatgtccgaagagcttgcctttacccccaaaggacagtcggggagaagccgaacgttcttggcgcactgactgaagaggaacgcgtggtgtcgggagaggctgatctatgggggctagctgactcgagagcgatgcgtaaggagatagcgtgagaggaagtagagctgtgacgtgctggtgtgtcgttggtggtcgtgcagtgatcgtgtgtcctgtcatggactatgcgatgcctgcatcacatagggaggctgcgcaacgcgatgaccaaaatacgcggtggtatggggcgatggaggagaggagagaatctaggaaagagatccacgtcttgggacgagtcctgcctacatggcccgcacgaacagaccatccggatgtggaaagcttatgtacttgttattcggacacatacggacgtcccttcgggaagcaatctagggtttcgcgcgcaaagcatctagggggacccacgcacatagtatggtagaacagagcacatggttcctgtagatgcaagacatctacacacaaaacgcctttgcaattggttcaagaacgtgtggctccttttgtggcacaggaaggcccnttttagttccctccgcatggagaacagcgggcgggggaaacttgggacacccccgcggcaaagggaaccaccgttccccttgagaggggaccccttttgttgaacaggccaatgggcgaatgttgtgcattgggccccaaaaaaccaaggacaccccaggaaaccaccttagaggcgcttaatttcttgcgacgcttttcttcccgtatggccccttgtaaattggcggagcaggcgttgtctctccagtggcgttccccaccattacacaccgtgggcgagtccccttcccattttgcaagagagaggaccacacatgtgggtaacagccgcttttgggcaaacgttaaagaaggcgcaggttaaggggtttaccttaatggggtgtggggttccggatttgaagcggcgcggtaagggcgccaagggggcgcctaaagagggggggcaatatattggccccccaatttaaccgaaagaccgtattactcttcccacacggccctggttaggggtgtcctttatcccccctgcggactggactaggcgcaaaccgaagcggtttgcgccagccaatatggccggcaccctaggtttctaaggaagggtttctttttggaccagaccttccgccgcgccgattttggttggacttgggaaaaggttgggtccccattgttctttttcccccatttctgtttccctataggtcggtgtgtccgcgtctcagaggtgtgcccgcgcgcggtgggtgccggcttaggtattgcgcctgggg

SEQ ID NO: 653695 - DNA, 255 bp, Homo sapiens
attaatcgagccttaccagtgaatcgactcgggtactggagtaatcctctatgagtcacaggctccagcgttaactgatatttggaggtcagcacggtgctcacgtgtcgacggaacttgtacagggaggcatgcaccgagagttggtgaatacactgtcgaccatggctccagttttaacgagtatttgggaggtcagcacgtgtgctcactgtgtcgacgcgaacttgtccaggggaggcatgcaccggcagt

SEQ ID NO: 653696 - DNA, 1042 bp, Homo sapiens
agcggattgaagaagaacacaaactgagctgagcagatgtcacacacgactccacgagtgcatttgtgctagtatggccgacgataccacaacacgttctctgtatacgagattgacgcggtcgcattggtgggcagggcagtgggtattacatcgacgggcactctgtgacattcgaacgttgtgcaagcacgcctacaaatgcatcgtacgagcgtaacgtgatgcataacacggattcctgtgaaaaatagatcatagacctaataacaatcagagttatctccacaggcgtcgtaaggcaccaccatggatcgaagagatcgcgatgacacgctgcttcatgtgacgtgcgtactctcgagagagctagccgtgacgctaagagcgcgactgaagaaggctccggtattgagcccattggcaccttgtagaattttcttggacaggtatggagggtcaacggtggacaggcacgaatttcccgggaaagaccttctaagttcacaatgtcgccatactgtcgaattcaccaaagcaaaatgggcccataaagaaaccgttcgggtgtaacaatttgcgtagcaaatttggtccaaatccccacgggtgacatgagtggacagagtcctctatgttccgaggacagggggccttagcgaaaatagattcgcttttggaattcgaagaggacaatggagtgtactctcgcgaaaggctggttcttccaccgtcggggcaaaatatggcgcttaatcccaattggcgagggattttcttatagcatccggtgcctgagaaagatgggcatgtctaagtgcaatcgtgaccttgcctctgggggtggcccaataccgttaggtgcacgtgcagtgtgtccaagtgaggaggagcaagtctcctaagaaaggaacccccccttaaaaaaacatccgtggaagtcaagtggaaaagattcaccaagtgaactggaacgaaactggactgggaaaggaaaactcaacatcgaacgcgtggggtaagcgtcgtatgttgtggcatg

SEQ ID NO: 653697 - DNA, 818 bp, Homo sapiens
cattgaccatctcacttctaggaatactagtatatcgcgtcacacctcatatcctccctactatgcctagaaggaataatactatcgctgttcattatagctgacgtctcataagcacctcaacgcccactccctcttatccaatattgtgcctatttgccatactagatctttagccgcctgcttaaacaactgatcggcctaaccctactagtctcaatctcctaaccacatatggcctatacatactgtacataacctaaacctactccaatgctaaaactaatcgtcccaacaattatattactaccactgacatgactttccaaaaaacacataatttgaatcaacacaaccacccacagcctaattattagcatcatccccctactatttttcaatccaaatcaacaacaacctatttagctgttccccaaccttttcctccgatccccctaactaacccccctcctatatagctaactatactgactcctacccctcacaatcatggcaagccaacgccacttatccagtgaaccactatcacgaaaaaaactctacctctctatactaatctccctacaaatctccttaattataacatacacagcacaggaactaatcatatcttatatcttcttcgaaaccacacttattcccagcttggctatcatcacccgatgaggcaaccaggcaaaagctgaacgcggcacatattactattctacaccttaataggtcccttcctatcatgcctaattacatcacaaacctagtcctaaatttactatcatcttctgccaaattaactcttc

SEQ ID NO: 653698 - DNA, 343 bp, Homo sapiens
gcacgagagagatagagcaccactctattctctctgtttagaaacaagcggtacagtgtggacatttttgtcaccgttctcacagccttgctgttttcaaaacaaaatcctgtaagtgtctaattctcattacctgggccgagataaccaagctttcctagggttaggagacccaccggtataaactcccaccgggtgactctcgttggacccataacaccgtgttgtacccggaccaacatatttcccagaaattgcgtaaaacccacgacccttaaccaatgtctgtctatcgcaaggcacctgatgaagggctactggacccccgcgcctctgttttctt

SEQ ID NO: 653699 - DNA, 353 bp, Homo sapiens
  misc_feature (76)..(76): n is a, c, g, or t
  misc_feature (84)..(84): n is a, c, g, or t
acaccatccgctcgcgcagacgtaacaccctgtgaacatctgctcgccctgtgggtgccgtggatccttgagggtntgcacgtngttgagagcagccggatcatgctatccgccttgtccaagtcccgttccacctcccccgcccgctgtggcactttgcctgcagccagcagccggacatccgactgcagcagggcgtcggcctggttcagctgctcctcacacagccccgccttcatctgcagcttggtcacgatgcgctgaagacactccagcctctcaaactcgctgcggagctgcttctcccgcgccaggatggggcctccagagaagctttttagaagggccagact

SEQ ID NO: 653700 - DNA, 280 bp, Homo sapiens
ttgagcgatctgctgtgcaatcttcctcgggtcgcccgtgggcgaggtcgggtacgtaccggtgtcgcggttccagcgctccccaaatgcaaaccagtcgatgggtggcgccggggtgccggtgcgtaattgctcctcgagggagtcgaagtacgcctgccagcgggctttgtagtagtcgccggtaagaccggaccagtccttgttgccatagtcatgcaggctcgcctcctcactcgcatggcgatccccccaggtggtgagcagcgagcgggcatcg

SEQ ID NO: 653701 - DNA, 135 bp, Homo sapiens
tgttgagtagttcgggttacagtaacacgtaccatgcgcagctaatttttgtatttttggtagagacggggtacaccaggttggcaggctggtctcgaactcctgacctcaagtggtccacccgagctgaagagg

SEQ ID NO: 653702 - DNA, 863 bp, Homo sapiens
taaaagagggtctctgtcaacgcaaattgggatgtgcaggggcacgatcttagttcattacaattttctggcctcccaggttcaaggcaattctccggcctcagcctccgggagtagctggggatataacagggcttgcacaaccagcgcccagttaatttgggtgatcttacagtagagaccgggttctcaccatggtgggccatggttgggtcccgaattcttggacctcaggtggatccaccacagctggggctccccaaaggggcgggcgatatatagggtggcgagccatggcggccgaagccctaaagttattatcaattcaaccagctggtaacggtcacttagaaggtaagaacacatggcgggaattcagcttcatgttttcttacatattacaaaaagggttccccccgagtaatttctggaaattgttagggccaacagcccaaatatttccaaaaaatggggagagactacctctttaaaggaaacgggtttacggtctcggtgtatatcgccagcagtcttattaaacgcgagcgttggaaacgttctgcgcctttacacagctgcccgcctggattaaacttgcgacggggcacgggtaaaatgggcttagataagaaggtgggagcactcccggacactgtgcccaaactgggttacacgcactcagactagcatatccaagaagtggtgttgataaaggtctgttgaacaccaagggcatcctattcacagctgcaattccacaacggggcggaggccacactgttgtgtgcgcacccatattggataggtagcggaggtattcgcgaaatgaagccactttaaagcacgcgcttcaggtgttagtc

SEQ ID NO: 653703 - DNA, 336 bp, Homo sapiens
caaacactactgttatccaataacatattatatatcacagatgtttccacatcaacactgattgtccatttacatttccgctggtcacttaattttgtactgatcctaattgctaatgcttcattcttacctttttcttttttaaaattaaagcactaatgacctatcataagaaagagttgcaccccagtaccctggtatttttcactgggttctaaagagcaaagaaaaaataaaaaagagaggggtaaaaaaaagggaggagggcaggataggagagagcccagtaagtggtttttgtcctgtggttcggattcttgaggtaatccgtgaggg

SEQ ID NO: 653704 - DNA, 130 bp, Homo sapiens
ataaatacgaccatgacactctaaatatactgtgactatctaggacactcctggacggggactactggacacagacacacacacgaccattacgactagacctacacggaaactctacaatacacacgta

SEQ ID NO: 653705 - DNA, 115 bp, Homo sapiens
agcgccctgcatcctccttcctcaggcctgtgaatccaccacactgaatgagccatccttctcctgggggtttgaccaggatcctgccctcaaaggctggggccctcttccccag

SEQ ID NO: 653706 - DNA, 393 bp, Homo sapiens
  misc_feature (271)..(272): n is a, c, g, or t
attcttcacttttggcaatatagttatttgtacaaattcgataggaatctgttttcttttgtaacagaacacagttggatacactgattattttgccaaggctttcattggaatggcataattttttaatgaccagactgctttgaggatttgaagttgactttatagagcctataaaaagccttggaaaaattagcctgataccttgtctacacagtttccttacaaggttcctggccttgcggtagtaaagaatgtcactctctggcannggcccaggagcctttcaggatatttctgggaaccgttgacagagagcaggcagtgtatccgaatttatacagcgaattacaagctgcagtctgattgtgaatccttgtcttggcttctctg

SEQ ID NO: 653707 - DNA, 129 bp, Homo sapiens
gcggccgcctactactactactgctcgaattcaagcttctaacgatgtacggggacatgtctggtctggggcttggatgttgcactgcccactgcctgtcccttctggtaaaataaagaactcttaatg

SEQ ID NO: 653708 - DNA, 300 bp, Homo sapiens
ctcccccattgtagcctggaggttctagagactatgctattcaaagcttctaaaagtgagggccttagccagtgactgactgatggggcacaaacttgggtaggagctctatacacagcacccgacatgctgctatgaggacctcctgggactgctgcagcccatcaacacccgcatcactgatccccagtacttcctttacacgccccagtcagtggctacgacccctagccctctctctccttctgtcccttttgattcctgtgctattaaaacttctaaaacctagggggtaccgag

SEQ ID NO: 653709 - DNA, 191 bp, Homo sapiens
ccggactggggcggtttggcctccgggactctcgggctaccttactttactctcttaccggctccgtttcttttttttttttccccggtcgacgaccggggtctggcttcggttcccagtcggtttactctctacatttgtggggctcacgggtgctctctcccattctcacgctctcccaacgggtgcgg

SEQ ID NO: 653710 - DNA, 332 bp, Homo sapiens
cgtgtgactgtctcgccactggtcatgtggatctgtgcaaactaggacagctcctgatcttgggtcgagaggcagcaactttgtcattgatttgagaattcaagataggactccttagaactaagatgtaaatactatagaatcttaacaaacttgcgaatacatatcctagaattcataactacttctagttgtccttgtttagtagccatctgggacgctgaatttccaggtcagtctccaatgcacgtttcgtctagtggtgggaaaagctgagttatttcttgatattatacagattgatatttacctgatatttaaggatattaaat

SEQ ID NO: 653711 - DNA, 323 bp, Homo sapiens
gctctagtggatccccctgctactatgagaggaccgggacgatgacctgagatcgggagcgggatcgagaccgtggatctagacagagtccgagtgctggacaggcatcggcatcgggatcgagatcgaaaccgggaacgggacctggatcgggagcgggactccagaccgagatcgagaggggtcctttccgcaggtcggctgcattccctgaacggtgagcccctaggaaagggaatactctctatgtctttttgagagagtgacaccctgccttctccgttgggccttctctccttttggaaacgtcatttacctctcca

SEQ ID NO: 653712 - DNA, 141 bp, Homo sapiens
ggtgactctagacgatcgctatcacgtgcattgtggacgcctagtgaagtaagactccattaacaactatgctgacagcacacacgtgtgacagctctgagggtagcacctttcaacaccttctggtgtcaccagcacaac

SEQ ID NO: 653713 - DNA, 578 bp, Homo sapiens
  misc_feature (8)..(8): n is a, c, g, or t
  misc_feature (125)..(125): n is a, c, g, or t
  misc_feature (131)..(131): n is a, c, g, or t
  misc_feature (192)..(192): n is a, c, g, or t
  misc_feature (218)..(218): n is a, c, g, or t
  misc_feature (294)..(294): n is a, c, g, or t
  misc_feature (314)..(314): n is a, c, g, or t
  misc_feature (546)..(546): n is a, c, g, or t
taacattnagctcaccagcgccaccgtccccggcgaagttctgcgctggtcggcggagtagcaagtggccatggggagcctcagcggtctgcgcctggcagcaggaagctgttttaggttatgtnaaaganatgtttcctcatctctaaggcttaccagaagctctgatttgaagagaataaatggattttncacaaaaccacaggagagtccacggngctcgcatcgccgcactcacaacagagtgccgttgacacaaactacggattggcagaaaaagatcctgcatatggncaggtcgcttcagaaaaggnagatgcaatatcccagatactgtctcgttgaagatgcttgattgcgtgcataagaactagatgcgagtgaagttcagctatctaatgattggcctgacaggtggtaggatgcatcttcatggttattgagggcaagaaggctgcccatcatgacagcgagcacgttatgatcaagcttgaacttagaaaagaaagctcgtctgaaagaggaagcagctatgaaggcccaacncagagtagcagaggtatccgtgttggctggat

SEQ ID NO: 653714 - DNA, 221 bp, Homo sapiens
ctagaccgtcactcacaacacgctacttacgtcgggacgtacgacgtttgacacctcctatgacgacgacggacttactgactcgcgaccttgtgacgatgcgtatcgctacgttatgactgtttgctacggccagaactacgtacacttgacggactgtaacgtcccgctgggacgacttactgacgacactacacctgtcgcccgtgtgacacgctggt

SEQ ID NO: 653715 - DNA, 870 bp, Homo sapiens
gagaggaagaagcagaacacacctagggtgaactgtcagccagtggagtgtcaagccgtgcctgactccagcccgtgcgtgtcctctccgggggtgtaacggtgtgggttcacaccgcgtctaatgggtctccgcccgcggtgtaccctattcaagagaacaggggtgtgcccgccgaaccaaatcaggggcccccgcttcgtaaagacagggacccgaaacacacgggaaacaaatgagccgcaggattaaaaagttttctagctctgctttcggggaaaaaaaacactacgtcggagagtcataggcaagctcctttagcgccatattccccacagaagccccgggcattctcctggaaaccgattttgggaaagacgccgacgagaatggggatgtcgagaaaaacccaaaaaggggcgtcagttcccgccaagcaggtcacaacaacgaaagctcaggggccaagctttcccgacgaagagcatgaggacatgcagacgtggctcccctgcccaaggaatcaaaactatgggggcgaaaaaccggctcacacgtggcatggttaaaatgcaaggagaatacattgaaacatttttaaagagcagtttaaatccctcttccccgcttttacaaaaggggtcatatacaagtcaataccttgatgtgcgtcgttttttaaaaaaacaaaatttgccaccaagattagtttgtgagcccgcacggccactcacgaaaaacatctgttgcttcttcttctttatacgaagacaggttgctggtggtcacgaccgcgcagagaaagccccggtagggccaaaagaaaaacaggcatttttttctaaaaaaaaaaaatagtcggacataaaa

SEQ ID NO: 653716 - DNA, 152 bp, Homo sapiens
gagctacttcgtgatgaaaaggaagaaccagattcacagtatggggaacttattgaaaagtgcattaaagaaggaaagaaggtaccagttgagataaccatcattgtattaaagagggaaatggatcagacaatggctgcaatgctcagaag

SEQ ID NO: 653717 - DNA, 376 bp, Homo sapiens
aagcaaggttatgcaaaggaagtgacagtcaagcccgtgagtctcgccgagcagaagcagctcaagggttacatccctgtcgcggattcgctgggtcaaaactccaagagcgtgggtcaaaggttcaagaagtatcttggctgggagccccaggtgaatgactcggtggaggacgacattgccaatgttgtccgttcaaaggcaaagagccttgggctgtaaactagtttacgctgtttcgttgtttcgaagaggggcaaggcgtgctgtgctgtgtaagaccgcaaggaggtctgttccatgtgatacgctggtgtaacaacacctgtgctttgagtatctacctactataatataccttccagtcgatatagaa

SEQ ID NO: 653718 - DNA, 327 bp, Homo sapiens
cacagctctccttcacaggcatcggcaccctctccagccatttctgcagttccagcttctcctcctctctcactgtgatgttcttgatctcagaggacaatgagaatacccttaaaagctcaatctcattcacggtgggctatcatcagctggttgtaactctgcactgtatcattggtgatgtattattgactggctataccgcccagttctgtcacctggaagttgcccgtcttcttgtcgtacttgaccagattgttcttgtccagcatcaggacagctgtatgaaccagatctagtcggcgctggtccagcaggggatctccc

SEQ ID NO: 653719 - DNA, 155 bp, Homo sapiens
cgtataatcggtagtagcgacagcatgcagtgtgccaaggccaccggaaagctagtggttggtaaaaatccgtgagctcggcaatatgttgtttttctggaacttacttatgttaaccttttatttattttctaatataatgggggagtatcgta

SEQ ID NO: 653720 - DNA, 630 bp, Homo sapiens
  misc_feature (28)..(28): n is a, c, g, or t
  misc_feature (125)..(125): n is a, c, g, or t
  misc_feature (206)..(206): n is a, c, g, or t
  misc_feature (248)..(248): n is a, c, g, or t
  misc_feature (335)..(335): n is a, c, g, or t
  misc_feature (367)..(368): n is a, c, g, or t
  misc_feature (372)..(372): n is a, c, g, or t
  misc_feature (374)..(374): n is a, c, g, or t
  misc_feature (393)..(393): n is a, c, g, or t
  misc_feature (399)..(399): n is a, c, g, or t
  misc_feature (433)..(433): n is a, c, g, or t
  misc_feature (441)..(441): n is a, c, g, or t
  misc_feature (443)..(443): n is a, c, g, or t
  misc_feature (447)..(447): n is a, c, g, or t
  misc_feature (452)..(453): n is a, c, g, or t
  misc_feature (455)..(456): n is a, c, g, or t
  misc_feature (461)..(461): n is a, c, g, or t
  misc_feature (463)..(463): n is a, c, g, or t
  misc_feature (467)..(467): n is a, c, g, or t
  misc_feature (587)..(587): n is a, c, g, or t
  misc_feature (602)..(602): n is a, c, g, or t
ttttttgtctaaaactatgcatggaganattaatctcttgtttataaattaggttaagtctaacatcactatttgaaaccagtgttatttacaaaaatgaacctcttctttgctttattgttggnttacaggaataattttaaaccaacctcaatctatctttaaaaatcttcctgccttcaaatgcccagcaacccttataaggnagggggcagccctttgacagcaacattcatcattcaccaggnatgtagaaccacaagtgaacaacaacaacaacaacaacaagattaaatcattcccaacaattcctatttgcttttccaaagcatgcnatgtctaattctgcctttctatgcagacaggnngaananggggcccatagggtatatnaatgtnaattaaattaacttcctttaaaagccaacaggcnggcttggngnggcnggggnngnnctgcngngggnggcactggcgggggatggggggaactttaaacccagggtagtaacatgtgctccagtgactgaccagctcagatagagacttctcatttactctgggtcccatgtgcaatattttacctnccgattgaatatggngccagaatctttcagaatgggggggggg

SEQ ID NO: 653721 - DNA, 564 bp, Homo sapiens
aacagaaacacagctattaccaggaaagacgctataccaggagccgctatcaccgggcaggttctataccgcgcacgtccatttaacccaccaaagtctacaacagcgctctatagctgcaacagcacgccgttctatcacatcgcgtcacctaccagaagcttctagcgtgcaaccgccggcttctcatctggagtcaggctctcgtactgccgcagctgcagcagctgccttatccacccggagcttgtgattcctggcctggcgaagaatggtgttccggcgcatggtctttgcatatgggtttagcttcaacatgattctcaagtttttcagtgggttcttctttaggactctgcgatggatcttcttgcgtggtgctcgaagggctctttggatctctgggcttttcaagattctgctaaggtctgtattaatcatcttgtgcatgggaagattgtagttactcttgagggaagcggctttacgccaagtgccgtacaattcatctaacttccggaaagcactttcactccaaatgcagaaacgtcccacatgcccacc

SEQ ID NO: 653722 - DNA, 100 bp, Homo sapiens
atacatttgcaagtataaaagcagatgggtcagcacatccagttaggtctataatccttaataaataactcccaaatctatgtaccagtgtaccatccca

SEQ ID NO: 653723 - DNA, 136 bp, Homo sapiens
ttctaagaccaaccactccacttgtgttctttttctgtagttatatcctttctcttctgcatcatcaagttctttctgtctgctgaatctatccactggtataaaatacgctgtaaggacacaagtggagtggttg

SEQ ID NO: 653724 - DNA, 117 bp, Homo sapiens
ctttgggaactgatttagttgggccagtcatttaacaggatattttttggatttatgtaacaactttttgagagcacatgccttataaccccattataataaacttttgaggtttga

SEQ ID NO: 653725 - DNA, 347 bp, Homo sapiens
cgggcggatcatgaggtaaggagatcaagatcatcttggccaacatggagaaaccctatctactaaaatacagaaaattagccaggcacggtggcatgcgcctgtagtcccagctgctcgggaggctgaggcaggggaatcgcttgaacccgggaggcggagattgcagagagccgagatcgtgccactgcactccagcctggcaacagaataagactctgtatcaaaaaaaaaaaaaaaaaaaaagaggctaatttcaaaagtgaaacttaggggaattaaccattcctttgcaaaaaagggttaaggctacaatttaatttagcccagcttagtgtccttttcaa

SEQ ID NO: 653726 - DNA, 116 bp, Homo sapiens
cgagcttgtacccggagacacttacgcgatagaggatgaggaaaactctctaccgagatttaacccaatatgttctgcccagcagaacctaccaagtaacgtgccctagggtctca

SEQ ID NO: 653727 - DNA, 200 bp, Homo sapiens
ccgtagctgtaagtagagagttgacagactcggtctcacacaatgccacagggttggtcagcgagttcactgtcaggcagatgtcgcagtcactgattttcaggtcggtgagcatgttctcaggtaggatgacaggcagcacgggcaagcagttaaagatgaccccgttgagcacagagtaccagaagtctttggaaggc

SEQ ID NO: 653728 - DNA, 460 bp, Homo sapiens
tccggcgtgtgccctcaaaggtgtagggatcacaggcatgagtcatcacatccagccaaaatctatcttttatctcaccgcaagcttttaattcatttccaactataaggaattagttggtttcataagcctgagatatgtgcaggattttggaaagatgatttcggtcagtgtggaagcatgtggcctccagcagtcgttaaaactttcaccagctggtctaagagttggattcaaggtctcatcgtcctcggacatgctactctggctagtaaacaagcaaaaggaaacggctagggctcagggttggggtgctacggagggttacaaatactcgagcggtagacaagcaattgttcccggacacagaaggaagaggggtgaggatattcctcttaatcctcagttcggctgaaagagagagagagagagagagagagagagagagagagtgagtgtg

SEQ ID NO: 653729 - DNA, 656 bp, Homo sapiens
ggagacgggggtctcaggagcaccagtgagtgagtccgggagagggggggctggtgagaatctggggagcgagtgtgagtgtggggtggagggggcatggtgtaacagaaggcagaagggcaggcagcggggaggctgcgggaacctgaagaccagagggttgacccttggttccaggaaaggctggatcaaattcccctgaagtctcccgcaaagcacagaggtggggactggtcttccctcttcggtctaaggggaaaagggagtcagagagcaagagagggcggtaacctccagctttcaagtaagcccaagattggtgcgtaccttttccagaaacacaaattctacctgatggtaaaaaaaatgaacatagaattggttttttcaagtggctttaagaaatccaggtccagggcggggcgcgggggctcacgcctatgtaatcccagcacttggggaggccgaggcagggggatcaccggaggtcaggagttccagatcagccgggccaagagggtaaaacccggtctctactaaaattacaaaaaaactagccaggcttggtagtgcacatctgtagtcgcagctacttgggaggctgaggcaggagaatcctttcacgcggggaggtggaagtcgcagtgagccgagat

SEQ ID NO: 653730 - DNA, 945 bp, Homo sapiens
accaagtggaagctgctgtaagagcagaatgtggtcaagagcagccgtctcccagacatctttgaggcccagattgctggctatcgtgggtcagcttgaggcaatgcacggtggatggcggccgcgtggaggcggatctgcggaccctgccaggatgtgagtgtaggacttcaagaataagtacaggaacgactgaaattgaagcccgccggcacgagtgtgctgtacgcaatcgacgttctctgtggctgctgataccaacggatgtggatgctgtcctacattggaacgaagcgatgagaatccttggtaggccagggctcgcgtactgccctggagatgtatgatgatcacacttcctcaggaacctcactgagacggagttcgtaccaagagctcgcaaggtcccagatctccgacgacatctgtggtgcttgctccatgggacgacaagttctgctccctggaccttgagacaggcgatcagttcggctagagtgtcaacggcaccagatatcgacgtgagattgggcccaattgcctgccggcggcttcacggcgtgacatgctcgtggtacgcaggacgcacatgcttttgaggactcatctcaagccccaggctgggatgcttgtggacgaactccggaatacccggaatgagaattgcagagatgaagcgggcatccaacagggctgcacggctgtggatcgacaacatccaagaaccaggcgttcccaaggtgcagagccgcccattgcgcatggctcgagagcgtgggaagctggcagcaccacgggatggtcgtgccaagcaggaggagccggaaaccgcccggtagggggccaagcaggatatgggacaggcagagggtaggttccccgaactcatgaacgccaaactggcctcggcattgggatgcccctcacccaggggtgaagggagaa

SEQ ID NO: 653731 - DNA, 124 bp, Homo sapiens
aacaccctaaccactacaatcttcctagggaacacacactataacggcacatctcacccttaacacatctacacaaacactacttttaatcaccaccgacccatacgttcttaaccgtaccagt

SEQ ID NO: 653732 - DNA, 609 bp, Homo sapiens
  misc_feature (87)..(87): n is a, c, g, or t
  misc_feature (112)..(112): n is a, c, g, or t
  misc_feature (130)..(130): n is a, c, g, or t
  misc_feature (135)..(135): n is a, c, g, or t
  misc_feature (168)..(168): n is a, c, g, or t
  misc_feature (180)..(180): n is a, c, g, or t
  misc_feature (182)..(182): n is a, c, g, or t
  misc_feature (188)..(188): n is a, c, g, or t
  misc_feature (208)..(208): n is a, c, g, or t
  misc_feature (218)..(218): n is a, c, g, or t
  misc_feature (224)..(224): n is a, c, g, or t
  misc_feature (226)..(226): n is a, c, g, or t
  misc_feature (229)..(229): n is a, c, g, or t
  misc_feature (242)..(242): n is a, c, g, or t
  misc_feature (249)..(249): n is a, c, g, or t
  misc_feature (254)..(254): n is a, c, g, or t
  misc_feature (259)..(259): n is a, c, g, or t
  misc_feature (262)..(262): n is a, c, g, or t
  misc_feature (265)..(265): n is a, c, g, or t
  misc_feature (294)..(294): n is a, c, g, or t
  misc_feature (304)..(304): n is a, c, g, or t
  misc_feature (306)..(306): n is a, c, g, or t
  misc_feature (310)..(310): n is a, c, g, or t
  misc_feature (313)..(313): n is a, c, g, or t
  misc_feature (315)..(315): n is a, c, g, or t
  misc_feature (334)..(334): n is a, c, g, or t
  misc_feature (336)..(338): n is a, c, g, or t
  misc_feature (442)..(442): n is a, c, g, or t
  misc_feature (449)..(449): n is a, c, g, or t
  misc_feature (453)..(453): n is a, c, g, or t
  misc_feature (457)..(457): n is a, c, g, or t
  misc_feature (461)..(461): n is a, c, g, or t
  misc_feature (472)..(472): n is a, c, g, or t
  misc_feature (475)..(475): n is a, c, g, or t
  misc_feature (477)..(477): n is a, c, g, or t
  misc_feature (564)..(564): n is a, c, g, or t
tctaaaagaaacttttatgttataagagttactttttggataagatttattaatctcagttacctactattctgacattttaggaangaggtaattgtttttaatgatgganaaacttgtgctggtgttncggancttatgatgctgagcatgttctgcactggtgcnaatgtctaatananttttanatttacacacatacgtgctncccagagatnaatttngnccntatgaactattgncccattnttcantgagnccnccncatacgcacccccaaatcagtgtgtttanaccccccaantntctnacncnttcccaaacatgtaccaantnnnataaacctcttgatttccagcaacatactatagaaaacacctgctattcaaaacacaacttctcagtgtcatccattgctgtcgtgagagacaacatagcaatntctggtntgtngcangctntcaagatagcntgnanttaaaaagttggtgcattagttgtatctgatggatataaatttgcctcctagttcactttgtgtcaagagctaaaactgtgaacctnactttctcttactggtgggtaataactgaaaataaagatttattt

SEQ ID NO: 653733 - DNA, 195 bp, Homo sapiens
tatgtttggacgaacacaaactaccacctacctccctcaccaaagcccataaaaataaaaaattataacaagaccctgagtaaccaaatgaacgaaaatctgttcgcttcacttctattgccccctacaatacctagcgcctaccctgccgcatgtactgtatcattcatatttccccactctattgatccccac

SEQ ID NO: 653734 - DNA, 1240 bp, Homo sapiens
gccaaccatgatttgtgagccttctgggaaattttgttatataaaggaatatatagtagtcagacagcaagttataatcagtcttgcgcaggaaccataagaaaaggtgtcccagggtcatctatataaagagggttacacattattttatcttacctatgctaggttaaacacatttatagcacaatcattctatgaagcatggcgcaggagcagtcaaagggcttgcttgccccagcagagttcccagcagacagaccatggctcttcccagcagcctgtgcaaattctgatagatggccccgaccccggacgcacgcacacgcacgatcagtgcaatcaaccagacaacaatcacaccccgcacccacgcatgggaacaataccaataatagagaataataacatagagagagaaacaagagccatatagaacagaaaactgggccaggacaaaggcatactcagcaccacacacatagagaaaaacgaataccatcataagcccacactcacgtcactctgcctcagctcaagcctaaaccaaaaagagaaagacaaacaaccacaccacaagcgagagcgaggcacaacccccactaagagcgcaccgagacacaggagcaagaaaaaaggaggaacaaacaacaaaaacacacaagacaagcccagaaagaggaacacaaaggaaaacaaacaccacacagcggaccaacaacaaaaaacacaacaacaagcaagagacaacccagaacaaaaacacgcagaacacaacaagcacacaaaccacgcacacaaccacgaggaagacagcacagaacagacaacaaaaagacaccgagagaaacaagcaaaagacacaaagaagcgcgaacaaaaagacacagagaaaaccaacaaacaaacacgaaacccacgaatgaatggagggacacctgcaagagagagacggcagagaaacacagcaggagcacacgcagggacagaaagaaaccagcgaggacgacaacaagaacgcacacagacagagatgaacagagacgacgaagagggcagaaaaacagcgcgaggaagaatgagccgcaggccgacgacgccgcgacgcgcggcgacgacgaccaagagaagaagagaagaagcagacacgagaggaacaaggagaggcgcggagggagaggacggagaggacggcgcgcagagaaaaggaacgacacgaagcaagagatcacccacagcggtc

SEQ ID NO: 653735 - DNA, 776 bp, Homo sapiens
attcaatattgaatatacatataactatataaataggagcatatatatatagctccttaaacatagccataatactcttatcgccacctaaaatttacaatcattccataaattatcgaaatacaagtcaatgtgcaaattgctaatagctttataaatatgcgtctttaagtttgtaggaagaaacattcaaataggtctattcagtctcttagattgtatgttgctgactttatatcccttgacttgagaccttatcatttgtttcttaagacatcgtagttgtatatgtagacttctacgtaagtctgaactccagttattggcatccctcggggtagtatatacatggtgcctctgtaatacgtatgtgtcctgattatcgagagtggaagactaaagtgtgtaccaaatataggttctacttcatagatagtgtgtattactatgaaagcatgcacaagatggggatatatccctgtttctaatactggtgttaaatcaaggtgcaatacctaggatccatacagtaggtgaaagtgtgaaaatagtgacactgctatatgatgctaacaacatagtgcgacattattgaacaggggcacgcttatagccatccataccaagtccagtgtgaattaacgcagagggaacaaagatgaaacacagaccaaaagcagggttaatatgggcatggaaaattagtagaccaaaaaagcaggaacgttggaaaagtataaaacatctccgagcgaactatgcaaagtagggacaga

SEQ ID NO: 653736 - DNA, 1111 bp, Homo sapiens
aaaagggtctgacgggagaaacccagaatgttaattctagggtagaaaggaaaaggggcacactcctggcagagggagatgtatgaggggaaacaagtgaaggaggggtctcaccaggcacaagaagtccgtgagtggctcacagcatgcaggaccgtggcagaggtggtgggtgcagggaaggcgaagtagcagccagcgtgaggtgaactcgaaagcaaggggtgacaggaacaggatcgtgtcctctggcacagggctctcaaggctcccaggggccccccaggaaaggcctccatcagattttggaccagtgtgagagggtctcgtgaagaagtcatggctaaaccagccgatgggtggatatcagagtcaaaaccttcacgaaactcttccgtcgctcacattcacagcccaggatatgcactggcatccccaaacagggcagattcctggacaagcgccttcaagagacggggcccactccacaatccagggaatcccgaagcagcaccaggccgcccaaggccaacagggagtccaacatctccaactcgacgtccggtccctgatctggggccctctgatggcgtcatgacccagtgtccttcctcctcggggtgaaagggggccgagcactcgggcgtactcccagcattaggacctaacataagtcgggcaatgagacggcgcactatgtacaaaatccccaggggcgcgcacaagcaggatgtgagcccatccacgagccctgggcaaaagccgaacggaaaagaaccccgacaaatctcccggggaccgggcgggaacaacataggggaaaagccggacactgggggcacactcccaacggcaaagggcgcaaaagtacaccgagggggacgcaagcataggagaccaaattccgtaacaaggggcccataagggcgaacaaaaacaagacgcccgagataagagcggcaggacaacgacagacacacggacgacaaccgggggggaacagggcacaacgacagagcagcggccaacgacgcgagcagagacggagacgtagtaaacaacacagcgagagaggaagcagagagaagaacagggcaaagcaagaaacaaa

SEQ ID NO: 653737 - DNA, 129 bp, Homo sapiens
ccccccccccccccccccccgggggggtttttttttgggggcccccccctgccccgcccccccggtaaaaaaaaatttatttgttttttttttttgggcccaaaaaaaccccccgggggttttccccca

SEQ ID NO: 653738 - DNA, 237 bp, Homo sapiens
acgagggacaggaggagccgccgctgaatcaccagggggctgctcgcacagaggtcaatctacggaagggcacatgggacaagtgcaacttcctggccagacagatccgggagcaccgcgagccggccacactgtgatgaggaagaggatgaggagcagttgaggtcaaccatgacatgcaaccagcacaggagatgcccatgtacatgcgtattcggaggttagagagacgtccac

SEQ ID NO: 653739 - DNA, 689 bp, Homo sapiens
  misc_feature (14)..(14): n is a, c, g, or t
  misc_feature (246)..(246): n is a, c, g, or t
  misc_feature (255)..(255): n is a, c, g, or t
cttttcactcagcngcagcctttcaagctctgctctggccgtctcaatattcttacgggcctgggtcgcatttctctcatgttggataggaatcagaggtaaacctccaatcttgggatttttggttattgaacgtttccgttcctttccagctggcggccatatatcattctcatgctgagcaatgaagatactggccatccactccatctgggcttgtaaactgtcacaacacaggtgccagtnatgtttttnagaatacacagtcaatccccaacttgttggggtttcattttcttttttacaccaagataaaacttcatcgccctaagaggaaacatcttgtcgtgtttgctgctctttggatccttgtaaataaagagatgcccatctcgtaaaacaacacatcgatcttgaaatttattcccagacagtattttagatggttcttctttgagttttaagatgccttctttgatacttttctctctgcactgtttaatgctgtcaatggttaagaatctcttcaccacaagatacgcagaaccaggctcagctaatgaactccactgaagcacctgctccaacacattctctgtgtagtgaagtggacgttctagctcttcattttcaatgacttcaaaggtggcccaaatatcccctttcataggaatgatattttttatcgc

SEQ ID NO: 653740 - DNA, 848 bp, Homo sapiens
  misc_feature (51)..(51): n is a, c, g, or t
  misc_feature (88)..(88): n is a, c, g, or t
  misc_feature (107)..(107): n is a, c, g, or t
  misc_feature (120)..(120): n is a, c, g, or t
  misc_feature (127)..(127): n is a, c, g, or t
  misc_feature (140)..(140): n is a, c, g, or t
  misc_feature (143)..(143): n is a, c, g, or t
  misc_feature (147)..(147): n is a, c, g, or t
  misc_feature (152)..(152): n is a, c, g, or t
  misc_feature (158)..(158): n is a, c, g, or t
  misc_feature (190)..(190): n is a, c, g, or t
  misc_feature (193)..(193): n is a, c, g, or t
  misc_feature (196)..(196): n is a, c, g, or t
  misc_feature (199)..(199): n is a, c, g, or t
  misc_feature (201)..(201): n is a, c, g, or t
  misc_feature (212)..(212): n is a, c, g, or t
  misc_feature (220)..(220): n is a, c, g, or t
  misc_feature (240)..(240): n is a, c, g, or t
  misc_feature (261)..(261): n is a, c, g, or t
  misc_feature (263)..(263): n is a, c, g, or t
  misc_feature (283)..(284): n is a, c, g, or t
  misc_feature (305)..(306): n is a, c, g, or t
  misc_feature (313)..(313): n is a, c, g, or t
  misc_feature (335)..(335): n is a, c, g, or t
  misc_feature (361)..(361): n is a, c, g, or t
  misc_feature (365)..(365): n is a, c, g, or t
  misc_feature (382)..(383): n is a, c, g, or t
  misc_feature (386)..(386): n is a, c, g, or t
  misc_feature (400)..(400): n is a, c, g, or t
  misc_feature (423)..(423): n is a, c, g, or t
  misc_feature (435)..(435): n is a, c, g, or t
  misc_feature (556)..(556): n is a, c, g, or t
  misc_feature (616)..(616): n is a, c, g, or t
  misc_feature (632)..(632): n is a, c, g, or t
  misc_feature (723)..(723): n is a, c, g, or t
  misc_feature (833)..(833): n is a, c, g, or t
ttggtgggggggacgagagagccagagaaaacctaaagtagaccatgcttntttccattccaatgaaaggttattgtcccgggaaganccccaccccctcgctttcntcctccgtttttnctaaacngtctcgagggggnatntatncttantttttntttttttattttttttttttcaattgtttgtnggnagnggngncctggtactgntggtactnggaacaccaggtcgtttatnttgtttttggcttaggtgaantnaattttgttcatgctatagnncgtgtaaaagtgaaggaaggnnttgggcnggaacatgggggtgaactggtnggagatgggtttgaagaggttctggntggnggtgctgttggggatgnnggngggggggattttgnggggggggggggggatgtggganaggggggtgttnacgttgttggggatgcattttaggaagtagttgttgtttttgttttgcacgttgagtattttttcgttcactttcttcatggacatgcggccccggaagatggcagccaccgtcagtagcngccgtggcgcgggtcgcaggcggccatcatgttcttggagtcgaacatctgctgggtganctcgggcacgtgagcncccggtactgctggctgccccggctggtcaggggcgcgaagcggagcatgaagaagtgcaggcgagggaagggcaccatgttcaccgccancttgcgcaggtctgcgttcagctgggcccgggaagcgcaggcaggtgggtgaccccgctcatggtggccgacaccaggtggttgaggtcccgtaggtggggggtggtcancttcagggtgcggaa

SEQ ID NO: 653741 - DNA, 854 bp, Homo sapiens
  misc_feature (33)..(33): n is a, c, g, or t
  misc_feature (148)..(148): n is a, c, g, or t
  misc_feature (205)..(206): n is a, c, g, or t
  misc_feature (226)..(226): n is a, c, g, or t
  misc_feature (249)..(249): n is a, c, g, or t
  misc_feature (254)..(254): n is a, c, g, or t
  misc_feature (339)..(341): n is a, c, g, or t
  misc_feature (343)..(343): n is a, c, g, or t
  misc_feature (345)..(345): n is a, c, g, or t
  misc_feature (347)..(347): n is a, c, g, or t
  misc_feature (349)..(349): n is a, c, g, or t
  misc_feature (351)..(351): n is a, c, g, or t
  misc_feature (355)..(355): n is a, c, g, or t
  misc_feature (359)..(359): n is a, c, g, or t
  misc_feature (371)..(373): n is a, c, g, or t
  misc_feature (375)..(375): n is a, c, g, or t
  misc_feature (387)..(387): n is a, c, g, or t
  misc_feature (413)..(413): n is a, c, g, or t
  misc_feature (417)..(417): n is a, c, g, or t
  misc_feature (419)..(420): n is a, c, g, or t
  misc_feature (423)..(424): n is a, c, g, or t
  misc_feature (426)..(429): n is a, c, g, or t
  misc_feature (437)..(437): n is a, c, g, or t
  misc_feature (439)..(439): n is a, c, g, or t
  misc_feature (442)..(445): n is a, c, g, or t
  misc_feature (451)..(452): n is a, c, g, or t
  misc_feature (455)..(455): n is a, c, g, or t
  misc_feature (459)..(461): n is a, c, g, or t
  misc_feature (464)..(464): n is a, c, g, or t
  misc_feature (472)..(472): n is a, c, g, or t
  misc_feature (474)..(476): n is a, c, g, or t
  misc_feature (481)..(482): n is a, c, g, or t
  misc_feature (484)..(485): n is a, c, g, or t
  misc_feature (489)..(489): n is a, c, g, or t
  misc_feature (498)..(498): n is a, c, g, or t
  misc_feature (579)..(579): n is a, c, g, or t
  misc_feature (829)..(829): n is a, c, g, or t
gtgggtgtgtctgcacatacctctgcagtaccncaccagggagcattccagtatcatgcagggtcctgtgatctagccaggagcagccattaacctagtgattaatatgggagacattaccatatggaggatggatgcttcactttgncaagcacctcagttacacattcgccttttctaggattgcatttcccaagtgctattnnaataacagttgatactcatnttaggtaccaaaccttttgagtncaacngaccaaaccaaaggaaaagtgttgctagagaaaattagggaaaaggtgaaaaagaaaaaatggtagtaattgagcagaaaaaaannnantnananangtantgantggcaaccagannnanccaaggagaacngaattggctaggaaaaaagaaaaacngcangnnaannannnnccgaagcngnccnnnngaggcnnagncagnnnatngggaaaangnnnaggannanncccngccattagnacccatcttatgtatgttacccctcagtaagttccccccattttagttttctaggactgaaaggattcttttctacattanacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgactttaccaaaaaaaatttaaaaataaaagtaantaaaaaaaataaacacacacactga

SEQ ID NO: 653742 - DNA, 939 bp, Homo sapiens
  misc_feature (33)..(33): n is a, c, g, or t
  misc_feature (148)..(148): n is a, c, g, or t
  misc_feature (205)..(206): n is a, c, g, or t
  misc_feature (226)..(226): n is a, c, g, or t
  misc_feature (249)..(249): n is a, c, g, or t
  misc_feature (254)..(254): n is a, c, g, or t
  misc_feature (339)..(341): n is a, c, g, or t
  misc_feature (343)..(343): n is a, c, g, or t
  misc_feature (345)..(345): n is a, c, g, or t
  misc_feature (347)..(347): n is a, c, g, or t
  misc_feature (349)..(349): n is a, c, g, or t
  misc_feature (351)..(351): n is a, c, g, or t
  misc_feature (355)..(355): n is a, c, g, or t
  misc_feature (359)..(359): n is a, c, g, or t
  misc_feature (371)..(373): n is a, c, g, or t
  misc_feature (375)..(375): n is a, c, g, or t
  misc_feature (387)..(387): n is a, c, g, or t
  misc_feature (413)..(413): n is a, c, g, or t
  misc_feature (417)..(417): n is a, c, g, or t
  misc_feature (419)..(420): n is a, c, g, or t
  misc_feature (423)..(424): n is a, c, g, or t
  misc_feature (426)..(429): n is a, c, g, or t
  misc_feature (437)..(437): n is a, c, g, or t
  misc_feature (439)..(439): n is a, c, g, or t
  misc_feature (442)..(445): n is a, c, g, or t
  misc_feature (451)..(452): n is a, c, g, or t
  misc_feature (455)..(455): n is a, c, g, or t
  misc_feature (459)..(461): n is a, c, g, or t
  misc_feature (464)..(464): n is a, c, g, or t
  misc_feature (472)..(472): n is a, c, g, or t
  misc_feature (474)..(476): n is a, c, g, or t
  misc_feature (481)..(482): n is a, c, g, or t
  misc_feature (484)..(485): n is a, c, g, or t
  misc_feature (489)..(489): n is a, c, g, or t
  misc_feature (498)..(498): n is a, c, g, or t
  misc_feature (579)..(579): n is a, c, g, or t
gtgggtgtgtctgcacatacctctgcagtaccncaccagggagcattccagtatcatgcagggtcctgtgatctagccaggagcagccattaacctagtgattaatatgggagacattaccatatggaggatggatgcttcactttgncaagcacctcagttacacattcgccttttctaggattgcatttcccaagtgctattnnaataacagttgatactcatnttaggtaccaaaccttttgagtncaacngaccaaaccaaaggaaaagtgttgctagagaaaattagggaaaaggtgaaaaagaaaaaatggtagtaattgagcagaaaaaaannnantnananangtantgantggcaaccagannnanccaaggagaacngaattggctaggaaaaaagaaaaacngcangnnaannannnnccgaagcngnccnnnngaggcnnagncagnnnatngggaaaangnnnaggannanncccngccattagnacccatcttatgtatgttacccctcagtaagttccccccattttagttttctaggactgaaaggattcttttctacattanacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacgtttgtctcagagaatgtttttatagaagtttagagcttaacatatgtgaacttctaatgcacgacattctctagagttataaaggagtgtcttcatattccttatttataataataacaaatactgtctggatgtggtatg

SEQ ID NO: 653743 - DNA, 228 bp, Homo sapiens
ctccggcgtagggcgatattagcggtacttccgtcacccgatggtagtgttctggcgtatcgcgctaacaatgctggcgtagtagaagcttacaaatcttctccttctggttgggttcctgttactcgcgctatccatttacctttcaataatggtacgtctgaaattaaggttggcgatactatcactggcgcgagttccggtgcaagtggggtaccggagctcgaa

SEQ ID NO: 653744 - DNA, 125 bp, Homo sapiens
  misc_feature (50)..(50): n is a, c, g, or t
ggccttctcctcactcctgtccggcttccggctcctcttcctccttcagnagcagtcagctgcagattgcaatgcccagtgaggtaggtgtccccctgactaccgactatggtcgatagactcaa

SEQ ID NO: 653745 - DNA, 193 bp, Homo sapiens
ggtgacatgatcgaatcgagctggtaccgacagcatcctaaccagagatgcaactccgaagacctcaggctcctctgggaagttgttagtgctagagacagcctcactgcaacgcctcttctgtggagggctggatcctgggcccagagatagctccctcgtcatccgtaagcaccacaaagagctcgcaggg

SEQ ID NO: 653746 - DNA, 273 bp, Homo sapiens
tcatctccaagtagtgggtacaggtgttgcacacactggctgatattgtatttagtagagatggggttcgcggtaggcaggctgtctcgaactctgactcaggtgatccactgccttgcgctcccaaagggctgggattataggcgttgagccgctgtgtccagccaggaaatcttcagtggtagcactcaagtaacggaatttggacaaggaaagaacttcacaagtttaatgaaatcattcctttaataaagaataaccgatctcttattt

SEQ ID NO: 653747 - DNA, 259 bp, Homo sapiens
actaccgccagtattttcaccctgagccagctcatcacaggcaaggaagatgctgccaataagtatgccctgagggaactacaccattgtgcatggagatcattgaccttgtgtaaggaccgaatacgcaagctgagctgaccagtgcaccggtcttcagggcttctgggttttccacagctacaggtgaggggaacctggttctggcgttcacctcacctgctccatggacacgcctctcaagttgatccatggcacg

SEQ ID NO: 653748 - DNA, 265 bp, Homo sapiens
aatgttcattgtaatgattcattggtctggtttgaggattatggattatgatacactgtcaacactagaacctcactgggactcctcttggatattcagttgttgccctctgtcatggaggttgtgtacctttggatctctgcctttatgcactgcagttcatagacaagtagatgtagttggagtagggctgggtggtaggtcagttggtcagcaactcttccccatacacccactccaccagatcagctctccaggtcgacgc

SEQ ID NO: 653749 - DNA, 211 bp, Homo sapiens
gcacttagcttgtatggaattggtcgtgccttcgcaactcctctgccgagtgctctgggaggccacggtggatggactgcttgcgccctcgagtttgaggaccagcctgggtaacacagcaagaccccatctctacaaaacattataaaaaattagttgagtcatggtggtattgagcctatagtcctggctactcaagaatctgacgcag

SEQ ID NO: 653750 - DNA, 325 bp, Homo sapiens
cgccgggagatcagggtcggctcgggatagccgcgtaacgtcccctcttttccatgagctggctctctccagtcgtctacagccatggatgagtactggccgtgcacgaggaagcaatcactttcccgtgaaaacttctcaaaaacaagcaacaacaacaacaacaacaccattccttcgcttttctagcagagtaaatgttttcaggaaaaaaagaattccaatcatccctccccacagcgtgtgcatttctgcctctaggtctttgctggggccactcctctgcccaaggtgctctgtatcccactaggatacagtagggaga

SEQ ID NO: 653751 - DNA, 386 bp, Homo sapiens
gggtaaccttgattaccctactgtagctctttagctcggattattccagtggtgcgtttcgtccagatgcacacaagactgagggtgctcatccgttcaaagatatgcgtgaagactatttccacgtcttggtgttgactgcctttgctcagcatctctagcagagtccatttgacgatcatggttaattcgcgtgtgaagtgactgaatacgcctgatcctgtgtagctgatgagtcagatgcaaattgagactaatgacttcataccctgactggagaccaactatgcacagatgcaactcttattgacacctatggagtggctgactgctgagctacacatgagcccgctagacaggcgctgattgcatcacatagatgacgc

SEQ ID NO: 653752 - DNA, 113 bp, Homo sapiens
atttaacagcaaatagctgaatcactacttcgcactagttcctcgtgtactatgcatattggtccacgtatcaacaaagtaatgatagcattagaaggactcagggtattggt

SEQ ID NO: 653753 - DNA, 1163 bp, Homo sapiens
  misc_feature (125)..(125): n is a, c, g, or t
  misc_feature (196)..(196): n is a, c, g, or t
  misc_feature (367)..(367): n is a, c, g, or t
  misc_feature (380)..(380): n is a, c, g, or t
  misc_feature (393)..(393): n is a, c, g, or t
  misc_feature (396)..(396): n is a, c, g, or t
  misc_feature (417)..(418): n is a, c, g, or t
  misc_feature (436)..(436): n is a, c, g, or t
  misc_feature (521)..(521): n is a, c, g, or t
  misc_feature (939)..(940): n is a, c, g, or t
ggggcggctgcagacgccgactgactggtcgacctaggagcgcatcggagccccgagaccgtcgccggcgccatggtaggtccgagtaccgatactccgatgcccgtctaggctccgtggtgaangagccccgaaacatgagtccaaccgtcggacattgagaggcgtgaggtggcggaccggcgtgcgtggaggntgtgggccgaccttcaaggcccatctgtagaccgccgtctgaaccgcgtagtcgttccggctgtctctgcagggacctagaaagggttaagtgttacttcctgtgcgaagaactgaatgtgtctgggactcacacgcaatgcctctacagcgtgcaactggccattcccgnacagcgtatgagnaagcggccgatgnttntccgggcgatgctcggcatgnntgacaacttgctggaagnagtgtccctgtcagaagaactgtgcgcagcataactgcatccgagccaaaatggctgggcgtggacactcacacatggacgcgangcccgtgcgtaggattcgtaaataccaggtggacgaggcatagtcgcatgaggcgacttgcgctctaacgctgatcgtgtggtgaacggtcacataggcggagaggttactatgcgggacatccgttatctatcctcgcgttgggatgggggagacaagcaatcctcatagggctcttgatagcgtggccctaggcaaaggcaatttcgccacaggcctggggatcgctggtttgtctacccggtgtacatcatctcctaatgcgcgctggcttacaggcttttccatggggttcgcagcagactatagtgcacctgacgaggtacatacaagtgcgagatactcttaaagcaagcacgactggctcgcgactccagggagcgcgttttatggttcacgaggcagccgataggtggannacaacgaagagttagccttgtggagtgctcgtgacatcgcgtgtcatccgagcccgctcatttcgacgaagcgagttgtcgcaggctggacaaacccaggcgtgccaagtcgagaactggcttgcttcctccaagggtggttggttaactcccgtggagaccaactcaagaattttgcgggattgaattgcccaagggtgggccgctattgtgggcacagaag

SEQ ID NO: 653754 - DNA, 133 bp, Homo sapiens
aactttcataatgtatgcatctgctacttatgaatgtacgttactttccgacatgacactgtactaagtctcccgttttccatacatggacaaatactttgtttcagccaactctcagtggaggggcaaccag

SEQ ID NO: 653755 - DNA, 486 bp, Homo sapiens
  misc_feature (66)..(66): n is a, c, g, or t
  misc_feature (71)..(71): n is a, c, g, or t
  misc_feature (133)..(133): n is a, c, g, or t
  misc_feature (158)..(159): n is a, c, g, or t
  misc_feature (171)..(171): n is a, c, g, or t
  misc_feature (200)..(201): n is a, c, g, or t
  misc_feature (278)..(278): n is a, c, g, or t
  misc_feature (331)..(331): n is a, c, g, or t
  misc_feature (382)..(382): n is a, c, g, or t
  misc_feature (391)..(391): n is a, c, g, or t
  misc_feature (471)..(471): n is a, c, g, or t
  misc_feature (480)..(480): n is a, c, g, or t
gcaactacaggatcgtgcagatgctgctgccggtgaccagccgcacgcgcatacgcgtaggggtcnagctncgtgcacctggcggccgagcgcaaccacgacgaggtgctggaggcgcctgctgagccgcgcnttcgacgtgaacacgccgcctggcnncgagccgcgcgncctcctacgaagaccggcgcagtcctgcnntgtacttcgcggtggtcaacaacaacgtgtacgccaccgagctgctgctgcaacacggcgccgaccccaaccgcgangtcatcagccccttgctcgtggccatccgccacggcttgcctgcgcacaatgnagctgctgctggaccacggcgcgaacatcgacgctatatcgccacgcaccncaccgcttncccgcaacatcatgttcgccatgaagtgctgtcgctgctcaagttctcatggaactgggctgcgaggcgaacctgttctnatgctctanggaaag

SEQ ID NO: 653756 - DNA, 165 bp, Homo sapiens
  misc_feature (7)..(8): n is a, c, g, or t
  misc_feature (12)..(16): n is a, c, g, or t
  misc_feature (18)..(21): n is a, c, g, or t
  misc_feature (23)..(23): n is a, c, g, or t
  misc_feature (26)..(26): n is a, c, g, or t
  misc_feature (34)..(34): n is a, c, g, or t
  misc_feature (39)..(39): n is a, c, g, or t
tgtgtcnntgcnnnnngnnnngnganctcaggcngtctnagtcatcactatttcctgtgtgtttcttcctataagtgaaataatgtgtagtgtctagcacggtgcctgacagctcacagaaaatccccaacttcccctcccccaccgccatgcgtggattgccag

SEQ ID NO: 653757 - DNA, 689 bp, Homo sapiens
caaaaatatggatacatctttattgtttaaaattaagttttacaggtgattctgatgcacatcaaatgttaagacgtgttctgtaacatagttttcctcttttgctggaaggagtttactttgagaatgcatttgaatgatatttcactatttaataagcataccataaatgcagttagcgaaattatcatgggaatatgatcactacatgatcatacatctaatgagtgatgtgataatgaatgtaataaatgcataaatacataaaaaaattaaaatgtattatttaatagatacctccttatatatttaaaagtaaccaacatagagattcagtttaatggtgctacctaaaatgtaaagtggctttactctttatactcgaagtcttattgatattttgggggaaaaactaaaagatctgcaggatccactttcatgtctacgtaagactcatgtaggattgtactcacttgcaagtggcccaagtaaaacttgactcaggactatttttagaaagaggtaacacatttttacaattacttcaaataaacaatttaaaaactttgtccttaagtttcaaaaacacctcagaattcatttgtcccttacacgttaacagccgacctaaaactggaactaagtttctctgtgacagtgaagtggttttattgatagatccaccaagt

SEQ ID NO: 653758 - DNA, 947 bp, Homo sapiens
ggctgcagagtttctgagcgccgcttcctggcggctgcgcacgctgcgcatccttcccctggccaggggggcggcagggcagagctggaagaggcccgcgggggcttcgcgggagtccaaagggcccgacgggatgggatctccggtgctgaaaccccccggggactacctgccacaagctctagaaggccaaaggttaaagaagcagctccaatccagagttcctgacgccttgcttgccggggaactatttcttcggcacgaaccgacctgggtgaaagcaattccctgatgatgtgtagatagaagaaaacccgcgcagaaccagtcacaaagaaaaaagaccccggagagcctaatcctcctccacgaaacttcattccacaaaccgcaacgctgccgggtcacttggcccccaagcaaagccccaatcggggctcgccatggcgccgaggagaacccccatgcagggaagagcctgggactggccctgccccggcgaaacgcacacgacgacgatcgaccggacggaacaccaaaaggaaggcggcaccccacgtggccacccacccatgcaccgggggggcggaacaaaaccaacggcacgcgaactccccatcgtcgaacgaagcgagacaccaaatagcacataagtctaaatccgatatccgaaagaccagagaaccttgcactgttcttaaacccagacacagtgtcctgcgagacatcacactctctataatgcacaattcgaacaaacgcgtggatcgatcgagtgtttacccagagcttttgcacagttgggagttgtcccaccagaccatcaccatgtcattctgcgcctctccaccatcttagaatgaggtccggcgctcaaactcaaaacacttgtccgcgagcacaataatcgaccacagggagcaactacattaccaatcacgagtcgt

SEQ ID NO: 653759 - DNA, 1211 bp, Homo sapiens
  misc_feature (1160)..(1160): n is a, c, g, or t
gtgtcggtttggagtgctctgtttcgtctatgctggtcatggtgagggtttgttctccttcgttgcttgctcctcagctttgtctgtcgttcgttgttctggctgtgtggtgtgtttttcgctcctcctctttttgttgtggtggtagtgtgtctcttggtgctagttgttgtcttctgttgctagtctggttttgtggcgtgcggctgttgtttgtgttgttgtttgtttctccgttgcctgttttttctcgtcgctgttcatggtcgtctcgccctcagtctatcgtctgcgtgcgttggcggttggtgggtgttgttgcgtcgcggtctccggctggctgtggtctatgcttgggaggcggtgggtggtttccgcgtcgtgcgactctgcgtgttggctgtggcagggttttgtgttgtgcgcggcggtgggtgtgcgctgttcgcggtggctggctgtgtgagtggtgtatgaccgccctctaggggtggggcttgctgagtatatattacgttggaaggtgagagtgcgtctgatttttgtgatgtgtgtggtgggtggtggtgggtagggatgtgatacgagtgtagggggggtcggagtaaagtagggtggggatgagggggtttgaatgtattggttggttgatagtatatgttgatggtgtgtcatacatgctgatggagaagtgtgtgtggcgttgtgtagtggagtgagttgtcttcgtctgttgtctcttctccctctcggtgtttgcggctgttcggtcgtcgtgtctgtgtccttgttgctcgtctttctcctgttggtttgtgggctgggtcgttcgtgcctggtggcggcccccctgttcggtcgggcccgttcgtccgctctcggtcggcttgtgtcctgtcccgcccacgcgcgtaggattatgtgttattgtagaataattttttgctgtctctcgtgatgtggcgtgtgtgtgttatatatatttgctcaccagaatgtgtatatgattgtgttcgttgaccatatacgttttgtattgtttgtcgctatttgtggaacaataatttgtggtggagtgtagaaatagtggtttatggtgttcttgtttgtgttaattatttttcttcttctctctgttgtgtgtttgtttactacttgtntcggattatgcttgtagatgtagtatttgtgatatataaataatatataaa

SEQ ID NO: 653760 - DNA, 490 bp, Homo sapiens
cattcttatcctacaccaccatcatacaccagcaactacatcttattattatcgtgctggtataaaagaatttcctcagcaaatacttagccttcacatataatatccatctcataaataatgcaggatgccagaagtcccccggagtagcacagggcaatgctattcccaagctctctaccagaagtggtggtctttctcataatgaggacattatctgcaaatagtgaaagattctggtaacttcaggatgctgaggtctctgtgacaaaccttcatccacagccagaattaagaaagttgtagtagcagttggtgtccagggatgagatggaaggcaggccagcaagaaggggctcatgtagacatagtgctctcagaacttccagtctatggttgccccttgttgagcgagactcaaggtagtctccagtcagtcaggcaatgccacactatctatggggctgaacctcatgcgcacagatgtgga

SEQ ID NO: 653761 - DNA, 213 bp, Homo sapiens
gcctacctcgacatttgcagatgggacgaagatgcagcgcatcttgctcccatcaggatacattgctacagctagcaggatacagagatgatctaaggtggcctcagactacatccaagggacatatatattgggcgttctttttgacagtagcaacgtccatatagcgactctgccagacgttatactatgtctttgtacttgttactttca

SEQ ID NO: 653762 - DNA, 445 bp, Homo sapiens
  misc_feature (23)..(23): n is a, c, g, or t
  misc_feature (32)..(32): n is a, c, g, or t
  misc_feature (49)..(49): n is a, c, g, or t
  misc_feature (430)..(430): n is a, c, g, or t
aagtgtaacccaccaattcccgngtggacttngaccccggcccccactnggcctgccacaccctagaacctcccccgcccgggccctcgctccttccccatctgaaaagtccctggtagttccttgaggtttaccttctcaaatgaaatatttttagtaaaaagtacaggtatatctcggagatattgtgggttcagttccagaccacctcggtaaagccaacatcacaataaagccaaggaagcgcattgttttagtttcccagtgcatctaagtcatgtttacgcatattgcagtccactaaatgtgcaatagcattatgtctaacaaatatacaaaccttaatttaaaaatatttactgttcaaaatgctgacacagaaacgcaaagtgagcacatgctgttggaaaatggtgccaaatagatcttnctgatgccaggctgc

SEQ ID NO: 653763 - DNA, 118 bp, Homo sapiens
catctagaggatcctgtggagagggggtctcaggcaggtaaaaggatggggcacccacagtctctccgcagtgccgcggcccagttggcaggacagctataccttgggtttattccag

SEQ ID NO: 653764 - DNA, 374 bp, Homo sapiens
ctatagaggatcctgcgacgcaacgctggaggagcacgcaagctgcaggtgagtagattgtccatgacaagaaggaagggtagggcctccttcctcccctgcctgagctggttccacctggcacgtgcctgctgcttcctgagagccctggctctccctccagtacttctgtttgtgcccttctgcttcccccattcccttccacagctcatagctcgtcatctcggcccttgtccacactctccaagcacattacaggggacctgattgctacacgttcagaatgcgtttgctgtcatcctgcttggcctggccaggcctggcacagccttgtgttccacgcctgagcgtggagagcacgagttagtttgtag

SEQ ID NO: 653765 - DNA, 1184 bp, Homo sapiens
  misc_feature (287)..(287): n is a, c, g, or t
ggacctgacgtcgacggtggaccctttgaacagcagtcgccctacagtcgctgattccccccgcatcgccctcccgtgcgaagcccagtgcccgcttcgcagctttctcccttctgtctcataacccatgtccactcatgcgagtaatgctaacaccagctgcccgtcttcacagattcaagaacagaggggacaaacgcacagtacagaaactgagtgcgtcgcgagaataggaggatcaactagtggatgctgaggaaagctacatacactggattgaccaagantggctgacaggagcacgagaactcgtaacgctcactccccctgagtgagttgctaccttcttccggttgcatgcgatataaggctgtaatcatactcaggtggcatcttgtagcagttgggtctgtctgattgacctgggctcaaaaggggcgctcatattgggtcagtcacagtgatggtagagagactcacgactcctaagacgtaactccaatggcgtgccagggaaatctcatattttccacgtagaaagaactatggcccgcgcataggatcagacattacatccggagctgggtgttgctcccgtaaacctatgatgtcgcttcctatgggggaggaactcgcaatcgtaagtccccacttcatgttgttgcaatcttgcctttggtgacacgtccaacttaatcaattcgcattctgggtgaccactcccagtatacctagaaacgcaaaggtctgtcgtggccaagattgtgacgtgtcgccgatacccccaagcaattccaattatcctccttagttagggcatgctcccctcatgtgcctcacctggtcgagatgcacaacctgaagcactgtcgaagaggtttcacaagggaaaaatgacttaggacagtggttgattgcgctcaaagttggttaccagaaggaacgttgggatagcatgaaactggtaacaggagcgccagggtggcgaaccgcaacctcgtttgaggcttcaatcccttcgacagagatcccctgattgattggccgattcctttcaagcattcggaggggtaactataactttgatccctgtacctgggggcacttcaggcttacatgcttttgcccgaggaaccaaggatatgcctagcaccccccaggtaagattgctggaggagccaacg

SEQ ID NO: 653766 - DNA, 94 bp, Homo sapiens
cggacgcggggtcgacccacgcgtccggacccacgcgtccgcaccactacaatcttcctaggaactatcaggtaataaaagctttgactccctg

SEQ ID NO: 653767 - DNA, 157 bp, Homo sapiens
ggccccccccccccccctttggttccgggatccaaaaatttttggggcccccccccggttccccttggggtccaagttttccctgttccccccccaccccaagggggttgcaaagtttagttttttgttttgaaaaaaaaacttaattcccctttta

SEQ ID NO: 653768 - DNA, 425 bp, Homo sapiens
ctgacactgtgtatatctctatacgtgctggcttccactcgtgttgtgagatgtggactcgtcaggcatccgaaattgcgacgtgtgctgtgggaccatgttgactgctagcttgcggaggtctgcattgagctgtcctggagattgcggctggtggtgtcctcacttatggtggctgagacaaggtggttcagatccccgtagattgtcttgatcagattcagagtgctgaagcatatatcatagacggcctcgttgtcaatgcaaaatgtctcatcagtattctctaccaactgatggacggagagggtggcattgtagggctcgaccacggtgtcagacactttgggtgaaggcaccacactgaaggtattcatgatgcgatcagggtattcttctcggatcttgctgataaggagagtgcc

SEQ ID NO: 653769 - DNA, 239 bp, Homo sapiens
gtggagctggagacggcggagtgtgatagactgcctaatcaggcgcaactccaccatccccagagggtgcccaagatcgaggtgaccttcgacatcaatgccaaggacatcctgaaggtcacggccacggacaagagcaccggcaaggccaagcaagatcaccatcagcaacgacaagggccgcctgacgcaggaggagatcgagcgcatggtgcaggaggcgaaccagtccaaagcgg

SEQ ID NO: 653770 - DNA, 420 bp, Homo sapiens
  misc_feature (397)..(397): n is a, c, g, or t
gaccttatccccaacaccttctcttaaaacatgtgatttagaaaaatttttttgtaaaaattttacaggcagctcactaatggagatgaatgtgaagattaactttataaagctcctttgcattttctgggtcaccgaatgtgtttatgtgttgtgggtgtgtagttgggatgcttgatagatgccattccatgtgcagaatcctattgacccacataatgtgttatatatatccaaatccatatacatatctatatctgtacacacacacatatatatacatatataaagtattgttgtacaagagcactatggttggtctcttcagaatctgtgtcatttcatattttcagaaagaatacattttaatcaattttctaaaaattgaagttatggntttagtgttgggcgataacatca

SEQ ID NO: 653771 - DNA, 533 bp, Homo sapiens
ccggtctgcacaacaggatgcctgttcatagatcctattgtctctttctttctttctttaagcctctcaatatctcatcttgcaggagcatggtcttcagcagcatcatgataatgggtcccacgtgaggtaaaaactattgtagatataccaaaaattcctaatttgtcgcagaattctgaatcgaaaatcattgtaagaatttttagaccaatccttctacatttccgctttgtttctcagaaagctcataacattcttctgttcatcctttgtatttgactttgctttatttatttaataatatctctgttctctttctggaaacttttcaattttttatctttagatcttaaaatatcaggatgagataccttggtgatataggttttcatttattgtgctggactctctctggatattttcaatctgaaagtgcaagtacttactaccagggaattttcttgtattatttcttccataattgcctatcctctgtttgtatgttagtttgtgtgtgttgtggtgacttt

SEQ ID NO: 653772 - DNA, 1107 bp, Homo sapiens
tatagatgcgcctcctcccttaagagcgttttttagtgtttcagaccgggttttctttgatcactttagcgaggtattcttttaataggccacacttgttgttaagcaacgcggtttttctcccgccaagacacggggggaaataaggtccccaaatgttccccggaaaaattggttcccacaccgtgggccacactcgtgaaataaaagggaattgtctaaacccaaatttaaaatgtttaagccaaaacccccgaacctgggtgacaagactggtgaatttggccacacgtttttaaaatggcctccggggtaaaaagtggcaattagttttttccgcgccgttcttttccaaaaaaccgcgagtgtgcaccgtgaagtttaatacccctatagcccaaaaagtaatgtgttttaaaaatgccctttggaaaagaatctggagtaaccgctcgcaccccacttctaatagattcactggagcctcctcaaaattgtcacatgggcacaggcccactaagtttctacactttaatttgaagagagggcccaaattccctcgctggagagaactaatatccaccctaattgtttttctgaggaattaaagtaacctccttgaggcccgcctaactcgttcgttaattgaataaacaattctgtgtgaaagcccaaggccccgctggttgcccactaggaaagggtcccttggttcacatttcacaccccaatgaaaggtgtgaaacctgaatgtttctcggaatgccaaactcacggctcacgggaattcaattttgtgttttaagttttaaaagcactccctattttttaaaaacccccgcttcaacgtccctaatgttgggaaagtccacaaatttgtctcgctttttcttgcacagcacatcatttccttaccaataactgtccggtggaccaaaatgcaccaattgataatagtttttttgataataaatatacatttagctgccactaaccagtaccaatagcttgttaataggtttaataataaggccgggcgaatactactttgtaacttttaaagtcttaaacttttccaataaaattgagtgagacttataggcccca

SEQ ID NO: 653773 - DNA, 999 bp, Homo sapiens
gatcccagctgtcagcgtgctcacggaatcctacccagtccacctgtcctgtaatggagtgtcagcatccaccccttggttgtcatcgaggtcgccctcccattcctgggtgaaagatatttaggtgccaccatgggctccctctggccccttcacgatagtgcacatgtagacacgtgcttatttattgctaggacactattgagatgttacaaaatctgtaaacctgcgtagatagggtcactgatgttgaggacacgcgttgtgtactgccctagagttgcgtgactacggacagggacgacacttgttgcacaggtgtctctggtgatggggtgtgtatgtgttaaataaactgcacgtcaacaacatacaattacatctgtttgctcgtgaaatatactggcacctactgggcataacgcctttacatgtgtaggtattaccctagtgagggcgctacatgggtacacccacgtctcccggtctcgtctaaagactcctttggaaactttaaatacgcttgcgattgctagacgtctgtgagttcacgccaaaactcagccctcgttagctaagagacatccctcatctcaaaggcccctgagggcgagagacgggggccaatctttctcatacattgggcacggccgttacagtgcacggcgattacctattctcgccttagcataaaacagttctaacgaagcgcactcggcagtcgcatcggtggtctctgcatttcccggcagtccccaagttcttagctcccggcgtagatatgcatctggattgatctggcgtatgcagccctctgggtagcccgggcgtcttatcgcgcccgagtgttttaaccgtggtgcggagaacattctgctgtgcctgggtaaccacaccgtttgtctgaatccaagggttgggtctgcgttaggtacctgacactcgggtttgggtagctccctgtaccttgttgcgcttgttggtcatctatccacctct

SEQ ID NO: 653774 - DNA, 127 bp, Homo sapiens
aacccgcgcgctcaagagcttcgaacaggagttcactcaaagaacaggtggctattgcgccaccgagctgtgttgttagccgactaacaagagcttcgcgatcgcctttcgtcatgctgacttcacc

SEQ ID NO: 653775 - DNA, 159 bp, Homo sapiens
acagatgtaccttctgaacagtactgaattccagcctcaaattagaacagttgacaagagtcacagtgactcatgcattctttcttcaaacaacctaccctaccaaggatcttctttcagctctgttagaacaaggcaataaactgcgtaatgccaagg

SEQ ID NO: 653776 - DNA, 855 bp, Homo sapiens
  misc_feature (19)..(19): n is a, c, g, or t
aaataaaggaagaaagaanaaagaagagggaagaagaaaaagacaaaatctagctttccccggaaaagggtgtcatggggagcacctagagcaatgcagattcatccataatccctttcttttgttcaccaccacccatcatccatctgtgtagtttctgaacagtcagcgattccagggtttaaatagtttgcaaattttcattttctacacactttataattctactcgtgatttatgaacaaaacttttttcattaatgtatatgataatatatatttattcagaatggatctttcttctatttattcatgtcctatctattttatatcagtttccttgagttacgcgtagttgcaaagatcaccgtcttcacctgcgtccccccccacagcctactgccacctgacagagcctacctccgacgtctcattcagttcacatcaccatgctgctttacttgtctattgactatcttcgggttctgtggcggtttgtgcatctgggggttattgttattgcattctgtatctcacgtgaagtgatgaagattattccacacactttattttaatttttttcgttctgttcgccttggtcataatacgtaggtagtacgatcatgacctactacactctttttctattcctccaaccctttcgtcttcgatccttcagacaacccaacaggatcgacacttccgaccgcccccccctcgccccacatcttgccacatcacacatccaccacaccgcatattaactgacatatctcgactgacaacaatcaacacactcttctccccggtgagtcccgcccgtgttttcttcgcatcagtgaagaccgcccggcct

SEQ ID NO: 653777 - DNA, 1140 bp, Homo sapiens
agcggacgtcggccgccatgtcgccgagtgtgggctggaaacagacccggacgcccagcggtagccctcctatgcgcctccgattcccagacatggcacaggtctattacatgtaacatattacaatggttacacctaaaggcatgctctcactggctgaccagcgactactccgtaccatattcactctgcaacatacgaacgcacacagcatggatagtcactccataggctgacagcagtgcgcacaacggacgtgctgaccatagtctaggcctatcctgcaatccacgcactgacaacatgacccaatccagccctctggcacccggagcaccggggcccacctgccagcccactccctggacccaggcccacgcggcaccaagatgccgcactggcgccacaccagccccccccccacccaggaatcctctatgaaagccaacccggaaatcctagagtcacaatccacaccatacaacttacaccttgaacaaccagcccatgaccacccccacatacgcaacacaccccatggacacgcaacaaggactgcgcaccttgccaagcaggcctagcaacgccgacaaacccctacggcccacaacaccccaccaacccccaccacaactcacgcgcatggcaacacagaaacccccaccccccaagacaaagcaaacatcgcaaacacacaccgaagcccacccaatcaaccctaccgcagacgccacacccaccggacggcaaaacgagaaacacaccatccaccgcactatccccccaatggcggaaaccacaccacacacaggaacccagcactacccaccaaaaccgccccacacagcaccaccacccccccgaccaaacccgcgcgccacaacacccacgcccacccaccaccacggcaacaacatagtcataccattactcccccacaacctcacccgcacaagcaacgtacacccccctcttcatactttcttatatatctcccacattacgagcacaacgccacaatctacatcttctgggacaactaccacacaacatattgactaatccacaaccctctgccccccacacctgccgcaatatctcatcaacccaccattcacccatcataaacatcctacacac

SEQ ID NO: 653778 - DNA, 318 bp, Homo sapiens
gacaatttaagggggatgggggggcacgaaggctcatcattcaaaataaaacagagtaaaaaagtgttaaggcgaagattaaaaaaaagtttgcattacataatttacacgaaagcaatgctatcgcctcccatgtgaggacttgggagaggactcggccattctccttagagagaagaggggaggcttttaggatggcaagggacttcctgtaacaacgcatgtcatatttggaatgactattaaaaaaacaacaatgtgcaatcaaagtgctcggccacattgcgaactttgggggatgctcgctccaacaggact

SEQ ID NO: 653779 - DNA, 245 bp, Homo sapiens
  misc_feature (9)..(9): n is a, c, g, or t
ggatccttntgagcagcgggaggaggaacgaggaggattaaggaggaccagtgagggcgacagagagacaccatcctggggaaaagccactccggctgagaggagaagacaggaaaagtgaagtactcacggcttgccaaagtacttctctcaaataaaagaaggggatttttaacaaacctgtccagcttgctcaggccggggtaccgacgctccgaatttcggtaactcaatggttcatagcc

SEQ ID NO: 653780 - DNA, 177 bp, Homo sapiens
cgctcgccacgcgctccatcatcttcacatcggtctcggtgaagttctcccccttggtggtggtggtgaccgtgtgctgcttgatggtgatattgacgcagtcgtgcacgaagttgttctggttgctgtactgatccactggcctgtagtacacttggttagggagcggcacatgcg

SEQ ID NO: 653781 - DNA, 683 bp, Homo sapiens
  misc_feature (30)..(30): n is a, c, g, or t
gcctgtgactgtgaccctgtgggtgtctgnaaggggatttgtgtgatgctcacattaatgagatccatggcctcctctctgggcagtgttgctgcaaagtgtgtgtatggggtcagcactgtgactcctactggcctggtcactatggcctgagctccacccaacctcagagctgccagtgtgagtgacactcagggtgggcccccgcctccatgtcctcctggctctgcccccagttactgccctgataacacacgcacctacccacctcactgcagttccattagcaagctaagagccctaagccttcgcctgcaggtgtgaccccagggttcaggtccctggtactcatgtctgttatccctccagtggtacctgtcactgcaaatgctttgtctctgggcaggacggtagccattgtctggtgaggcttggcccaccttctgatttaaccttgacctttggcactgagcttcttggagctatagccttataatgagtataaggctatagttatcatgactgtggactgagccttgtacttgggtgggtgccgctcactgacttggtcaccagggtcagcatcactttggctagctgaacctgtatatgccctcaggtgggagtttcggaaacaaaagggaaattgattaaacttgtattatacactggaaaaaaaaaaa

SEQ ID NO: 653782 - DNA, 253 bp, Homo sapiens
acccaggcgataacccgagaacacgggcgtacaatagagccatgacccgactgcagcatctcttctggctcccaagcagagcccagaatgtgagaacttcctggatgtaggactgggcagagagtgtacctcaacacaaggagtacttaaacgagaatctgggagtgattctgacctctttcactcacccagtgctgacatggacagcatcatcttcccacagccagaggccgcgcatttggcctgtgatatc

SEQ ID NO: 653783 - DNA, 469 bp, Homo sapiens
  misc_feature (306)..(306): n is a, c, g, or t
  misc_feature (441)..(441): n is a, c, g, or t
ccctaaaggaaccctgtacccatccacattttttcctaacctccccagctctaggcaactatcaatttactttctgcctgtacagattttcctattctgggcattttgtataaatgaaatcatacagtacatggttatttgtgactggcttcttctatttagcataacgtttcagggtttcttcatgcctagcaggtttcattatttcattcattttatcgccaaataacattccattgtatgaatataccacactttacttattcattcgtcagttgacgggcatttgggttatttccatttttnggctgttattagtaatgcttctgtaaacattcaagtttttagtggatatatgttctcatttctgtggattatatacctaggagtggaatttctggatcatatgttaactctatgtttaaccttttgaaaaacaancagactgttttccaaagtggatggacaa

SEQ ID NO: 653784 - DNA, 151 bp, Homo sapiens
gtgtggttcgaagaaatatacaatattattagttctgtggctgatgaatgttataattaacgagatttgtaaggagatcagatatagtagacggtagagttttctttcgctgatagtggtacactgcgattagtggagttggcttatcgag

SEQ ID NO: 653785 - DNA, 201 bp, Homo sapiens
ctggccaacacggtgaaacccggtctctactaaaaatacaaaaattagcggggcggcgtcttggcgcgcgcctgtagtcccagctactcgggaggctgaggcaggagaatcgcttgaacccaggaggtggaggtagcagtgagccgagatcgcgccactcgattgccccactgggcgacagagtgagacttcgactcaaaa

SEQ ID NO: 653786 - DNA, 1093 bp, Homo sapiens
attatgataaaattgctgcaagtacttatgtgcaggatttgaatgaacttaagttttccaaagtgactgtacacttttgatttccactagctatggagagttctggttgttcctcatcttcgacagcatttggtgtgttcaccgtttgtgtttagccattctgataggtttacagtgatatctcgttttaatgtgcaattccctcacaacaaatgattttgagcatctttctcatatgcttatttgccatctgtatatcttattaatgaggtgttcagatctttcacctttttgtatataaggggcaatggggagaggtaaaaagttcccgagaaaattcgtccaataattatgggggggacgagcgagtttatcccgaccagagaacttattgcgggtcaagttatttccccccaagttggtggtgcacgtggcctttaccacaagtccctctataaccggtgtcttttgcacacaaacgagaagagtgttaaatgtacagacaggggagcgaccaccacagtcaaaaatggccaggtgcagcaatgacgacgaagaatggggtcacctagagagagaaaggggggaacccctaaagaaagagcgccgtcaaggtgaacacccgagggatacccccccaaaattttgcgccacacaacaggagcctcaagagggaatacgcaaagtgggtatgagccccccgtaaacactttcccccgggtgtgcagcgaactccacagtgctacaacaagggggccactaccaagacgcgggtgcacataacgacggggacctccaagtacaaatacgaagggacaatgggcggcatagccacagactggtgctaaaagcaacccagaaaaactgggcaaaaggagagaaacacaggacgcagaaaaagcggcgcttaaaaagcccaccaggggaaagaaccaggcgactcggaatatagcagccgcggaaacataaggggcccccagaatgacccagacaaaacggcacacacatcaagggaggaggagagcacccatgcgccgaaagcacgtaccagaacatgcggacgaaacacagggcgcaacgagggacacgcagg

SEQ ID NO: 653787 - DNA, 220 bp, Homo sapiens
tgtccgtgtgtttgaccgtggcttcagtgacacactggtgccttcgggacagacgaggcgcactgcctctcccacggcaggttccttgtgagagacctccctgtgaggtttgggcacacacctcctgctgctctgaacatggaccctgtatgaccaactgcagctgtggtgctcagtgaagtgactggccgtgcgcgtcttcatccttataccatgcacc

SEQ ID NO: 653788 - DNA, 304 bp, Homo sapiens
agcatgaaatatctctccatttatttagttctttgattctttcatcagatagtgttatagtttccccatagagatcttatacatattttgttagatttatacctaactctcatttttgggggtcctaatgtacatgatattatgtttttaatttcaaattctacttgttcattgctggcatataggaaagtaattgacttttgtatattaaccctgtatcctataaccttactgtaattgctttttagttccaggagtctttttcaattctttttgattttctacatagatgatcatattatct

SEQ ID NO: 653789 - DNA, 126 bp, Homo sapiens
ccaaagagatactgtggtctctgcacctgctccagcccctattcacaaccagtttacagcgtggaaactggttgtgaataggggctggagcagtgtgcagagaccacggttatctctgtggacact

SEQ ID NO: 653790 - DNA, 817 bp, Homo sapiens
  misc_feature (817)..(817): n is a, c, g, or t
tcttccttcttttaaaaatggttgtttaaaactttaacaatgggaaccccttgtgagcttgctcagtatcatggtggaaaaccaaaagggcctcttaactgtaacaatgtccatggttgtgatagatattttttgttttttttaaaatataaataattcccaagtgtttttattataaaaaaacaaaaaaaaaaaagaaaatagaaaaaaaacaagacaaacaaaaacaaaaaaaaaaaaaaaaaacaacaacacaaccacaccaagacacggctatcatacgccgacatcgtacttttctccgagaacacacccatgtgtcatagcacccgacacaactatactgctgcaacgagaacctactacctaacgctccgtcacgcactataaaaaagaaccaaacacttgaacacacacgataaacaaaacactaccataagaagcaaacaaaatatcaaaacaaaaaaacaatataataaatatagaaagagacacctaactactctctctacattgtcagcaacacaaagtagtaacatcaaaaacactatcacacgcaaactataacatatcatcaccaaatcaggcatcaatacattacagattaaataccacacaatacacatacatcagattctgtatcctaactcaacaacctcgcacaatgataattacttaccctcatcggtgactaaataaagttcctatatctgacacgtcacgacatatcactatatctcccaccaaataactatatatcctacccaacatcaactcatctcatcaacaaaaatttacccaaatcaagagacacagn

SEQ ID NO: 653791 - DNA, 151 bp, Homo sapiens
  misc_feature (33)..(33): n is a, c, g, or t
gccccttgccacttccaatgagagggggctggnggcaggctcacattggtctgggtggcaaatgaggtgctcctgctccaacccaagaggctttctgtcccaggctgtgtccccccctccactgcccggacgtgctccaagcccagtagag

SEQ ID NO: 653792 - DNA, 587 bp, Homo sapiens
cggccggctatttggtttttgtattttttgggggttttactgtgttgcccaggctggtcttgaactcctgagctcaggcaatctgcctgcctcagcctcctaaagtactaggattacaggcatgggccaccacgcccggccttatttttatttttgagacagtctcactctgccgcccaggctggagtgcagtggtgcgatctcggcttaccacaatctctgcctcccaggttcaagcgattctcatgcctccgtctcccaagtagctgggattacaggcacctgccaccatgcccggctaatttaacgcccagctaattttggtatttttagtagagatggggtttcaccatgttaaccaggctggtctcggactcctgacctcaggtgatccgcccgcctcggcctcccaaagtgctgggattacaggcgtgagccactgtgcctggctgatttttattcttttagttaaggctggttgatattaccttgtgtgtatataccacatgttgtttatccattgttgttgatggacatgtgggtggtttcaccttttggctatgtgaataaagctgctatgaacactg

SEQ ID NO: 653793 - DNA, 553 bp, Homo sapiens
agcgcccccctgctcagggatttggggttctaaaggcgacaaaggcctctcgttcaggggccctttatcctttatgataagggtattctccggcagatccctgaaaagaccctccctgttggccgctctgtggatgaaactttgagactagttcaggccctcccgttccctcccaaacctggggaagggggccccgctggctggaaacctggcagtgatcccctcaagcctgatgtcccaaagagccaaaaatatttttcccagccgaagtgggcgctgggctgttttagggcccgggtgcggggggcacccctgagaacaaacccttttttggatttttttttttcccttaggaaaaccccagacttcagattcagccgaattgtggtgtcttcccaggccggccctttccccccgggggggggaagccccccccttcttcctttgggaggaatggcccgagttggggttgggggccggccactggtttgtatgatgtattagtagagccccccctttatcttttgtggtttggtttaaccttggcctgaga

SEQ ID NO: 653794 - DNA, 642 bp, Homo sapiens
attagtatagatggtagaccagatcgagctagctccacaggatagagatcgtaatcctgcctcttgtggtcggaagcaccgagtgtgctacttctatccgtggtcgtaccttgatggagcggaaggcagattagacatcgaggcttccggaaaacaaaggctgccagctcatggacacggccacactcaagaggaattctggcgcctgcctgtgggtggccgtgaaaaggctgatcctttgctatgagatccagagaacgaagccattccacagagagttcactgagattgtgtggtcccggcagcgtgcagggcctggcggtgctcatgggacaggctctgtgtaggctacccttctgggttctggctgctgagcatcgcaggcggaggggcagcctctagaccgtggtaaatcccaatgacccctcgcttgcgttcctctcgcgactgtcttttgacgccctttgtgctgtggagctcgaaagcgaggagtacctgctttgcttcaggctcgtgggactgtacgtggacccgcaaggccggagggcacgcgcgcaggagctcatgtggcctgcggctcctgtcgcctgtagtatgtatatgttttctgtcgcatatccctgttgctgctttcccaccgac

SEQ ID NO: 653795 - DNA, 250 bp, Homo sapiens
atgcagattcactggagccagacagtgagtaaggcatatatgactattcctctacccactctcacatgtaaagtgtgtattcagtgaaaggctgatcacagactcaaaagaaagcaaacttttggccgggcatgctggctcacgcctatcatgccagcacttatgggaggctgagatgggtggattcacctgaggtcaggcagttcaagcacagcctgggtgcacaaggcaagactctgtctcaaaaaaa

SEQ ID NO: 653796 - DNA, 1395 bp, Homo sapiens
  misc_feature (183)..(183): n is a, c, g, or t
  misc_feature (218)..(218): n is a, c, g, or t
  misc_feature (1245)..(1245): n is a, c, g, or t
ggtgacagtcgtctttaaaccctgcgtggcaatccctgacgcaccggcgtgatgcccagggtaatggacagggcgaactgtggatggtccagacttacttctctttaaggatcatctcacacgtagttggatgagttattccgaaatgatttcacttgttggtgagcagacaattgctgggcntcctaagtcacgtatgcgaggcatggatctccagncaattggtcaccgattccggctggagtgaatgtgacgtggtgtggatggccatggagtgggtgccagaagcaaaccacctccatgtggaaatgtccgccacaaggtccctatgtcccggaaggggggcgacgcttgagcgttcacaccgcgcaaatctcgcaagttacgtccgtgagtgaagctgaaaaatctttggtcctgtgcctttcagaattatttcgccgcgggggcgaaaggactgcctgtgcggtccctgttgtgctgcctttgcagagccaatagggaaagggcacactcggttcgaaccttttggcactggagttccaatgcgtgcaaaaccaatttggtgtggggctctaggggcaccaacagatcacaaaggggtgtggcacctaatggcgtcgggcgtgtgcccccacgtgaattggccattaggggttaaggtcgcgaaggtgttatgggcgacccctcggaatgggcgttgggccataagggctttcccaccgttgcgctttgggccccgaaggaccccgccgaagagaagaaacctaaccgtggggaggttcccttggccgggaatggtcctccccgggaaaggaaataaggaaacccatttccacacttttttaatagtcctcccaatgggggggtattaacttacagggcggctttattgttccaaacctccggaatcgggtttagacccaccagagattcttatccccacgaagtggggggttgggcaaaaccgcccgaaattttgtggcgacgcaaaaggcttcccaccttggtacacggattaggaacattgggcgtggccgaagggcccctctgaggggttccgataagcgagaaaccttgggggtgataggcgaaaccccaccaagagggggtctgaaggcgggcaagggcccccccaagagcaccggcaataaagataccccaattcggggctctttgggttccgttgtggaaaggcgcaattgttcgcgtaccaaaagcgaaatgtccttgtcgcctccccanttgtggcgttcccctgtttgtggaggcgccctgtggggggttccaaaattcccgagagaccaagggggtgggatatgcgggaagccaaagaatcgggggccaaggggggaatatccttagacaaaaaaaagggcccttgtgaaaacagag

SEQ ID NO: 653797 - DNA, 485 bp, Homo sapiens
agagctgactctagaggatacactgccgtactgtatcctacagaaataaaaactaccattagaaaagactctaaatatctctatgcaaataaaatagaaaatctagaagtggggtcattcctgaacacatacaccctcccaagactaaaccaggaagaagtcgaacccttgaatagaccaaaaacaagttctaaaattgaggcagtacttaatagcctaccaactcaaacaagcccaggaccagacagattcacagccgaattctacatcaatattctgttgatgtggggtgtagaggagctggtagcattccttctgaaactattccaaacaatagagaaagagggactcctccctaactcattttatgaggccagcatcgccctgataccaaaaccagacagaaaacaaaatttcaggccaatatccctgatgaacatcgatgcaaaaatcctcaataaaatactagcagggtaccgagctcg

SEQ ID NO: 653798 - DNA, 732 bp, Homo sapiens
gaacagtccgtaatccagaaacctgatctgacggaagaggagactctgcgcacagcagtatgagtccggagggcgagactccgccggaagcattctcgggcgggtgacccaccatggtgcctcttgtaattggattcgccattttatttttcttgctgctaaattaccgagcccggatgattatagagacgtatttctgggatttctgtagacacacccacccacatacatacatttatatatatatatattatatatatatatagatatctctattttatatatatattggatgtatttgactgctgtggactcgaggtgggaggggaatgttcccactcatatcctgtcagggaagaggaggagatgagagactctggcgtgatctttcttttgtcccacttggcggggccagagtgctctctcctgcccacgaatgtgcaaggccacggcatgccggacaatataaccacattttgggaacaccgacaaactcagtcctgtcgctgagcctctctaccccacttcagacggacagagagacagatcacaggtacagggatgaggacacttgcctctaccaggagattgtggagttcatgacattgctgtgctttggggattccttcactgctggacgcgcttctcagccccgcgcttgctggaggattcatgaccagggcggccctcgttactctccctgccttttagtgccacgaggccttgccgtcc

SEQ ID NO: 653799 - DNA, 1421 bp, Homo sapiens
gaaccgcgtaccgaccccgtcgagcacagagcctacgcctattgccgataccgccgcccgtaccacacccgccgccagctacaccataggatagatagataatacgccgcgctacgtacgtacgacaacggctaccggcatagtagcaaggccggctatacgcgggcgacgatagccccccgggccgtactatacccctaccatacgtaggggcgccccagtgcaccagggcgtagataggtagggcatagggtacagaaggatatcctaatagtagggcgacgccggcccagcagcaagacgaggcatacctacaccctagaagtaacctccatacgcagcactggcatacgtacatccaactagggcacgcacataggacgacaaatactagtgcacccaccacctatactaacacatagacgctaagcgtagtagtgctacccggagcgagcaacctccgttagcttagctagacccgcagggctcccccctagcacaccccgaagggccccaacccgccgcagcaagcatagacccccagcatacataggtactgcatgaacccctatacaacacactccccaagtcccatagtaaccgtatggcctaataactccagcggctagctgcctcattccccttagttaaccggccctacttaggcccggtaacccaccttaggtccatatacggcttgcacttcggcggcaccctacccggggcatagcaaccgctgcgtgcctacacatcctccaatccatcctaggttgaggaccccctccgctcgctaacgccaagcgggggctacattagcccccttaacccccctcgacccatcaagccccaaataccccactatggcctctctactcaggcgcaatctccttaacgccccttcgccccaccatggccgcaaaccccttgccaacccttagccaccttcaaccacttacacactcgcccaatcgccataacccctctctcatccctgtcaacgcccctgctccgccacgaccactatacccccccgccccatatcatccatgctccacatcctcctcaactcctgacgccctccgctacctcctcccggtgtcccaccctcactttctccctatatcccccggcatttcaaccccctcccatttcacacccgcgtctcccgaacactaccctccacttccagaccccacttccaccaacctctcctccccaccccctatatattaccacactcatttttcccctcaaacccccccaataactcaacacgaccacatgacgcgcacaccaccacaccaccaccaccattgcaccacttactcacacccaactacaccttcccccacttacaccccccactccgccacaactcaccccctccctaccactcccttacacccatcccacatacccca

SEQ ID NO: 653800 - DNA, 274 bp, Homo sapiens
taggattgggactttcagcctaccccataacctttggggaaaaaaaaggggctgccagttaagttgatccccaatggcttagtttaatcaatcatgcctatgtaataaaacctctgtaaaagcccaaaaaggcagtgttcaaagagcttttggatagctgaacacgtggaggttcctgggagggcatggaagctccatgccccctcctccatacttcatatgcattttttcatttatatcctttgtaatgtcctttgtaataaactgataaaca

SEQ ID NO: 653801 - DNA, 435 bp, Homo sapiens
gccacatggcagtgtgtgacacttccaggaaaactcgcgcacatctttcgcgagatacacgaagcgtctgtcctcagataagatacaaaagtggtctttctgtgttaaatatgggccgcaaagagaattgcgttacacatctattgggaaagcttaaacacgagcacacacttggcctggtgcggggggagaagaatagcctaagaataggttagacacaattctgaaaacgaatttaccttataaagaaggtcatggtagaactgggaaaaggaacaaggtatttttctgtgcaagccctttttgtgacttgcgcgcgtattacatattttagaattattttttattttcgaaacatccacaaaaggaatgcttattagtgagaaaggaagaatttccatttcaacacacttatgaaactgacttgacatcctg

SEQ ID NO: 653802 - DNA, 160 bp, Homo sapiens
gagaaccttgcagacccgagtgtgagggggccaacggggaagggtcgtctagaatttctaaatctaaaagtaggggcccactccccttggggagaattttttgattggcccttgttgaacttgtcaagggggttctttatttctttgggtgtggtaggaa

SEQ ID NO: 653803 - DNA, 903 bp, Homo sapiens
  misc_feature (5)..(5): n is a, c, g, or t
  misc_feature (93)..(93): n is a, c, g, or t
  misc_feature (142)..(142): n is a, c, g, or t
  misc_feature (196)..(198): n is a, c, g, or t
  misc_feature (328)..(328): n is a, c, g, or t
  misc_feature (349)..(349): n is a, c, g, or t
  misc_feature (354)..(354): n is a, c, g, or t
  misc_feature (375)..(375): n is a, c, g, or t
  misc_feature (522)..(522): n is a, c, g, or t
  misc_feature (561)..(561): n is a, c, g, or t
  misc_feature (620)..(620): n is a, c, g, or t
  misc_feature (658)..(658): n is a, c, g, or t
  misc_feature (660)..(660): n is a, c, g, or t
  misc_feature (696)..(696): n is a, c, g, or t
  misc_feature (711)..(711): n is a, c, g, or t
  misc_feature (715)..(715): n is a, c, g, or t
  misc_feature (723)..(723): n is a, c, g, or t
  misc_feature (726)..(726): n is a, c, g, or t
  misc_feature (784)..(784): n is a, c, g, or t
  misc_feature (786)..(786): n is a, c, g, or t
  misc_feature (794)..(794): n is a, c, g, or t
  misc_feature (800)..(800): n is a, c, g, or t
  misc_feature (847)..(847): n is a, c, g, or t
tgcangtagtaacttatagatatatttggaaaactgattatcttttaaaaaatgactactaaacagattaaaatgcagagttcattaaaatanagaggatgcctctggttctctggtattgactctttttgtctactaaganaagaagtctgggctaggctgaaaaactcagaatccagagtctggggtttcccannnctatgctcccatttcccagtactgtgctcccatttcccagtactatgctcccatttccgagtactgtgaactcccctttcccagtactgtgggctcccatttcccagtactgtgctcccatttcccagtnctgtgctcccatttctcagtnctgtntgcccatttcccagttctgtntgcccatttcccagttctgtgctcccatttctcagtagtgtactcccatttctcagttctgtgctcccacttctcagttctgtgctcccacttcccagttctgtgctcccatttcccaatactgtgctcccattttgcagtgctgtnagcccccatttcccagttctgtgctcccatttcccagtnctgtgctcccatttcctagtactgtgctcccatttcccagttctgtgctcacaggtgtnagcaaacatgcccggcccatcagctcttaagcagcaanangccctgcagctggctggctggctggacagcacagtnaagcaggtggctgcntccnctgcagtngcnggcagcccatcttcctggagatgtaaaccctcctgcaaggctggctcttctttgggtntnatgaagangatganagaaatggatgctgggctctgagggtcctggttccttcgaaggacanccaggggcctctgagaagatgggctctggttcctggcctgtagcatgggtaggagc

SEQ ID NO: 653804 - DNA, 412 bp, Homo sapiens
  misc_feature (113)..(113): n is a, c, g, or t
tgctgggtttacaggcgtgagccaccatgcccagccaactggcggtttcttaaaaggttaaacctattcttaccagatgacccatccatttcacttccagatatttacccaangataaatgaaaacatatgtcctcacagtgacttatatatatgaatgttcatagcagctttttttttttttcaacaatagtcaaaaccgggaaaatacaccagcaggtaaagggataagcaaaatagggggtactcgtacaaaaaaatccgggtgggaactaaagggtacaaactagggataaccagaccaagggggatgacttccacaaatataatcctaaggggaagagggtgggcccaaatgagcacatacggaatacactcggttcatataaaactcatcagaactggtcctggat

SEQ ID NO: 653805 - DNA, 301 bp, Homo sapiens
  misc_feature (298)..(298): n is a, c, g, or t
ccaagaattcggcacgaggtctacattcaacgttattgacaagtaaagacttactcttgccattttgctatttgttgtctggttgttttgtgttcttctcttccttcttttccttccttcctgtcttccttttagtgaaggtgattttctctggtggtacgctttaatttcttgcttttttgtgtatatatccatcatatgtttttctcaatttgaggttaccatgaggcttgcaaatactatcttatgacccattgtttttaaactgatagcagtgattgcagaaacaacctaccancca

SEQ ID NO: 653806 - DNA, 953 bp, Homo sapiens
tctggatgtcatgacactctgcttgtatactaactctgtgtgctacttgcccgtgttttctatacgtgcattcggtgtaccccggcgtctcttcaccacttcgggtgccaaacgcccattatcgttttccaggatgtccttagtacgtgttatcgctcagcacactgggtacaatcgttcaacatagacatttggtgggattgatcacgagggaccgcttttatgctggtgttgtcccatagcgcccccggatctaattctgcgaacagctttttgctccccgattttttgagagggtggtgtcacccgcgtccgttctgtgtccggccccattgttgggcagccctgttgcttatgtctcgtccacgctggtaaatcgtttacgacggctcttgttcggagcgtgtggttgcgagcaccaccggcttgggtgggcccaccaggccacccgtgtgtgcggtccctctcgttaccccgatctgtgcttcctgtacgacgcttgttcaaaactctgcgtgaggccgcacgtgtgcgctcgtgacgcagaggcgccacgcttcgggagattcttatcaaaatagaagggggctcccggctccggcgctgggttgtacccccgttgtgtgtcgcagccccccttttgggtgtgccccgattgggcctaatttactctgacgtgctctctggcttcctgcgtccatcactggccccaacctgcctgtgtgcctcgacgtttctctggctccgcatcccgtgcctgcgctcccacgaacttgtttcgccgccgggctcgcaactcagccgcttcttgtcctcgtgatttttgcgcggcgcccctgccacagggggagtttcctgggcgcccggtggcacgcgggtccccgtcgtctgagcccgggcccccacgggccccccgggggggccgcccaaaaagttttctcccaaacaaaaca

SEQ ID NO: 653807 - DNA, 321 bp, Homo sapiens
ggacactgcactataagcgagagttcaagcctctgtggcgagtatgaagagacatcgtacattctacagaaggtcacgcagcgagaacgatgacatgtaccttgatcatcgggcttcctctcaagctagccagagggggggagcctacaggaaggcgtggggtatacagatggagataatggtcacgaggtccagagcacaacgtcccaaagtctcagagcatgccaggcgtgccctttcgtgcttcttcgcacaggtcctatcctgttacgctcgtggctggttgcagcatctgcttggtagggtggagcgtgtagagga

SEQ ID NO: 653808 - DNA, 148 bp, Homo sapiens
ctagaggatcccgtgaccagccagctttcttttgatcagcctgaacggggcaagggggcgatcgatgccaaggtgcacatgcccctcaggagccctggacggagtgctatgtcacagaaattgaccaatggtgatgtgccctgttccc

SEQ ID NO: 653809 - DNA, 237 bp, Homo sapiens
  misc_feature (63)..(63): n is a, c, g, or t
tcttcttccgaatcgtcgactgcagtccactccagagtttctgggtacagtctccaccaaggngcttccacgcctccatcctgtggcaggtcctggcagtgcgaggtcgctgagtggtgacctgagcggtcgtgactcgcaacacctctcccgatagacgtaagagcaccctcgatgcttcgacagccagacatggtcgttggtagcgtggcacacgagcccagggtgcgggggctg

SEQ ID NO: 653810 - DNA, 1223 bp, Homo sapiens
aggatcgcttgagcccaggagtttgacaccagcctgggcaatatggtaagaccccttctctaccctcccccccaaaaaaaaaatttcagtagtggcatggtaggtgggtgcctgtggtcccagctacatcgggacgcttgaggtgggaggattgcttgagcccaggagtttgacaacacagcatggagcaatatggtaagaccccattatctacaaaaaacaaacaagaacaaacacaggaacaacaacgacaccggcgcgcgagacgagcgccgagcagaggaggccacagaagacaaccgaacaacgccggaacacccaggggccgcgacgcatcgacagcgagcacaacaccacacgcttatcacaacccagtcaacttgggatcatatagagcgaatcacaccccatctttcgatagcaaagagaataacaaacctaacccagtacgacgaaaatatctgactaccgccgcccacagtcgaggcgcgcccggcgccgcggggcaacacaaccaacagtaagggaggagctatccagaggggagggaaaagcagcaacagaacagcaaccaccacagcacaacgcggaggagcacagggagagtgtaaagacaaccatcgcccacaaccgaccccccaacattgcccacaccacccccccaccacacaaccaggaggccttacgcggcacccgcggagcagcagatagagccacccacaccgagaggacacacctcaacacacggacgcgcggccaaccaccacccggggagccgatgggccaccgagaccaccgacacacaaaacaaacccaccgacccaggcaagcgcctattctctccccaccctaccttacaaaaacaatccaaacatcaaaacaaaactcaccaaaacaccaacatataaacatcaaaaaccacttaatatcactccccctcatcccaagcccacaccccacactctagcacccaaccacaacctcacaccaccacaccaaatacacccgacttcccctccacactcgcaacagcgacaacacggcaacaccaatagcagagtggcgccgagccaataagcccaccggcgcaccaccacacacaccaccgagcaaggcaccaaccacgcccacgcaccgccacaccacgcgcacagcacagcgccaccacccacgccacaccacgcaccagcacggcaccaccgcacacacgcccacgacgaaca

SEQ ID NO: 653811 - DNA, 317 bp, Homo sapiens
  misc_feature (167)..(167): n is a, c, g, or t
  misc_feature (207)..(207): n is a, c, g, or t
  misc_feature (215)..(215): n is a, c, g, or t
  misc_feature (249)..(249): n is a, c, g, or t
aggcgctctagaggatccttttgggtgctttcacttcccacctgagaaagctaatctatcagagtaggtaggggttctgtgattggctcacggaaatcaggtctaaatgaaactagagaaagatcattctatgagcaggatttggtttaaggcaaaggaacaataanccccttacccaaaaagaattacaagcaattccatactaanccttctanccctggaaagatgtctcatctaaaaggtcccaanaatgaccaggacaaagtggtgatattatgtgacttgaggagaaggaaggggagatatatcatagtttt

SEQ ID NO: 653812 - DNA, 211 bp, Homo sapiens
tgaagaggagctgacccaagtcttctcgggttcttcgtgccaccccctatgcccagcctgggcatctgcccagtcctgctgaccccagcgggttgctgacttaccaggtcttagagaagaacactctataggtgtccacaacctcatgccataagccagtctcacaagagtgtcaggtgtgcaaaaattccccagcaaggatccagcaggc

SEQ ID NO: 653813 - DNA, 980 bp, Homo sapiens
  misc_feature (298)..(298): n is a, c, g, or t
  misc_feature (497)..(497): n is a, c, g, or t
tcgagcgcgcaaaagggcccagaaaaaggggacacaagttccagaagaatgggtaagatgagaaagcaccccgcaaaggcgcacaaatagagaatattgggaagaccggctcgtcaccccgggacccaggggccccaaagggccatctcgagggttctccaaagggtccctttgtttgaagtgagtcttcctgaattgccagaatggatggaaattgccatttagaaaatttcaagctggagttacccgaaaagatgtttcacgggtaaaaaactggcccggactaactgtccactgngcatggggtcttacccgctggagccaaaaaggtggtgtgccactggtgccacaaaaatggggcacgaccacatggagttgtaagcttcaccgcttgagagtgtccaagagactatccgagatggtgtaactttgcttcgttctcgtttctcgtgttggttttaaactaaaataccgccaccacaatcacagagatatcnggagaagagccctctttaatgcctcacagcaccccaacacaggtcccgcccaaatctccggagaaaaagagatgagatggggaaatcacaggagccccgagagagaggtggcaagaccacaatgagactctggaaagagaagtggtcacaataaaattgagattccacgagacgcaattggagaaaagaaactaggaaaaaggcttgccacaatctaatttaatcctctccacatgagatgttttcgttatgagaaagtataaaatgctcgaagaagccccacgtttgagattggggaaagctcactggaggcttcactggtgaaaggcacgtaagtttctgggaaaagccacctcggggaacgagaacacaggtggctaaaagttgaaacgaggctgagtggatatggaccccccgtcccagaatctgtttataagttcagacttcaaatagtggccaaataaaaagtgctatttgtgatga

SEQ ID NO: 653814 - DNA, 595 bp, Homo sapiens
  misc_feature (416)..(416): n is a, c, g, or t
caactttatttggccaagggggtcaatacggttgtgaaacagaaatgcctgaagaactagaaccgactgattcaactgcagcatgcttgggcacctggccacccggaaaggaagggtagtggttatggcttgaacagaccacaggccgtgctagagagaggccagtggctacaatgcgcccacgactggaggtggagccctggcttggagaaaggggaaggcccagccctgtgccgagccccatggatgtataacaccatctcctcttcacaacatggtgaacaccctggcaggatccagaagtctccatttacccaaaaacgcaagagccatgatcagacatggccacactgcaagctgtacatgagtgaccatgtccagtccggattcgtcctgtgcacacagcagactagttnttcctatgtggactgagcgaggtgggacagagaccctgcctgctctaaaggcctaaaaaggccacagacggaagttgtcagatgaggagaaaccttccgcgggagggaggtatcatgacttcatacacggttgctagcgacttggacagactcatgtattaaaaactacatgatggctt

SEQ ID NO: 653815 - DNA, 108 bp, Homo sapiens
gcctgcaacaggttgatgccaaactcctctcaactcatgctcaatgtattagcattcccaagtctcgtttttaccaggaaaagaccctaagaaaaatctattgaagac

SEQ ID NO: 653816 - DNA, 345 bp, Homo sapiens
atgcaagaatacaggcactagccctcagccaggacgatgcaaccgtggccacagcttctgcttttgatgtcgtgatgttatcccccaatgaggaggggtactggcagatagctgcggaatttgaagttccgaaactggttcagtaccttgaaatagttccagaaaccagaaggtaccctgtggcagtagccgctgctggagatctgatgtacctgctcaaagccgaagactccgccagaaccctcctttacgcccacggcccgcctgtcacatgtctagacgtctcggcctcccaaagtgctgggattacaggtgtaagtcactgtacccagcccaaaagcagtt

SEQ ID NO: 653817 - DNA, 222 bp, Homo sapiens
cacgcagtcagtggaatcagtctgctatgcggcctctgccagagcgcatacgacgattgctcactcagagatatcagtacccccgtagagtatgtatctgctaagtcttttgacaccatgacaattcacaaatcaagctttattgttacggctttacagatcttctgccgaagaaactgataggaatcttggatctttccgggtagcgaactgaatctcgct

SEQ ID NO: 653818 - DNA, 674 bp, Homo sapiens
ctatgtctcgatcgttattttctcactacctccccgggtcgggagtgggtaattcgctgtggtgaatggttaaatcagcctttttctagcagaatagccccatactttaagattttggagtgagtaagctcccttttggcttttggacttaggatagttctgaactggtgaggtgtgctcacaatgaggtttcctctaaaggttatttttctgctttcttctgttagcaaagcagtggcggctacaggtggaatgcattggggccatcgacgggttcctgggttaaggattttggatagaaaggctactggtggtcagtggcttcagagctttgcgggctaggccttggtttgacacggacaacaaaagggtatgggagtgttatggggtcacagagaagaccttcaattatcaatgataggtttgaaatttacccgggcttttaaagaaatagggtacactttttttctttactactcctatctttctctttctctctttctttctcctttctgtcttggtagatggcttggggaaacccagtggaaggatgtgcgctcatggcccccatttgccactataggactatgcgcctcccttttatttactcaattggcttttatcctgatctattatgttgttgtagaccagttcccagttgtacatatgggtac

SEQ ID NO: 653819 - DNA, 1108 bp, Homo sapiens
  misc_feature (710)..(710): n is a, c, g, or t
ggaggtggaggttgcagtggcagtgagccaagataccggcactggactctagcctggtggcgacagagacaagactccactctcacaaataaataaatcatataacaaataaacataggtgaaacacaaagttataacagataatacacattcatgcaactgcgaacatacataaaaccataaacaattacatttaaacaaaatttcaaagagagccgggcgacagatggcgttcatgccctggtaatccacagcacaattttgggcaggcacgagtgccaggagagatcaacttgcagccccggagagtaccaagcaccgagcactcgcttaactataactgacgagacgttatcactctactacaacaacaatacaacaacaattagaccagagcatggatggcgatagtgccttgtagattccacgcgtactacacggagagcatgagagtacggacggactcactcagacgcccacaggcggtaggagagagacagtaaaagccacagatatctagcgcacatgagacatcccagacctcggactggacaagagataatgacaccatactctacacaaaagaacacaaacagacacgcacacgaaacaagacgaaagtaacagcaagaacggcttgaacaacgataaaatgcagaacacggatagcagatacgctacactgacctagtacagtccacagataactnaagaggaagagggtcatgacagagcgagacttacatagcaggggtcaacagagattatgaaaaacacaggactggagccaaacatagattgaacaaccaatggcagcctaactacaaagctacacacaacatataagccacgcacaggatgggggggcaccagtaagacaccaagaaacacggcagggctgagaacagaagaatacttgaaacctcagatatgaaagttgacttggagtgagccaaatgtgcaggagcccaccaggggacgatagacacaccgcaatagaagacccacagacagagacacaaaccactacacaagcagatcgcctccaacgccacaggcgaccacagaacaccacaagggacagaacgcacagacagtaggggcaccg

SEQ ID NO: 653820 - DNA, 329 bp, Homo sapiens
atactctagcctcgtgagaccgatcctagaatgccgtagcgcgtacgaaggtatgattctctcataccgtctactagagaaacatgtaccatcaatagctgatatctgacttgcactagggagacttaggcggaggtaatgggagtggtcaggggccatgggctgtcctacctgccgttttggtcacagtgactgccacgtgctcttccaagggcactgcagctggagaacactaactcttcttccaaaggggtctaactggctagttaggaggccgctctggggctgatggattgttgattggtgaatccctggtctacgggtcgtct

SEQ ID NO: 653821 - DNA, 122 bp, Homo sapiens
ctctagagtatcccgctggagaaaaccaagctttggcgtcacattaggtctcacccattagagcatctgactagtatttctcatcaccaagtcagttagattgaaagttccgttgaagccgt

SEQ ID NO: 653822 - DNA, 860 bp, Homo sapiens
  misc_feature (1)..(1): n is a, c, g, or t
  misc_feature (71)..(71): n is a, c, g, or t
  misc_feature (83)..(83): n is a, c, g, or t
  misc_feature (91)..(91): n is a, c, g, or t
  misc_feature (95)..(95): n is a, c, g, or t
  misc_feature (98)..(99): n is a, c, g, or t
  misc_feature (140)..(140): n is a, c, g, or t
  misc_feature (162)..(162): n is a, c, g, or t
  misc_feature (165)..(165): n is a, c, g, or t
  misc_feature (174)..(175): n is a, c, g, or t
  misc_feature (189)..(189): n is a, c, g, or t
  misc_feature (214)..(214): n is a, c, g, or t
  misc_feature (216)..(216): n is a, c, g, or t
  misc_feature (286)..(286): n is a, c, g, or t
  misc_feature (308)..(308): n is a, c, g, or t
  misc_feature (313)..(314): n is a, c, g, or t
  misc_feature (331)..(331): n is a, c, g, or t
  misc_feature (361)..(362): n is a, c, g, or t
  misc_feature (371)..(371): n is a, c, g, or t
  misc_feature (376)..(376): n is a, c, g, or t
  misc_feature (435)..(435): n is a, c, g, or t
  misc_feature (489)..(489): n is a, c, g, or t
  misc_feature (644)..(644): n is a, c, g, or t
  misc_feature (654)..(654): n is a, c, g, or t
  misc_feature (667)..(667): n is a, c, g, or t
  misc_feature (744)..(744): n is a, c, g, or t
  misc_feature (838)..(838): n is a, c, g, or t
natttttttaagttaaaataaaatgatataaagtaatttgaatgttccaaaaaattcaaaacttaattttntgaatgttttanataaatgngaantanntgttcgcattggtaacctgctgctgtatttcatgtcttaanggctattttgaggttcattaanaanatagaaagnnttgaactgtataancagctagattccttaataattagtnantagagaaagcccaaagacaaatattgggcaggaaatcagttctcactgagcccggtttccatgtaaaatntctgttgtggtgggcatagggnggaannatctaaaggaaaagagngtatttttttttttttaaaaaagtttgtgnngggagtggnaaganatctgtttataaattcaaaatatttgatttactgctaaacatcactctgaactttatanatgtgggatactaacttacatacattatatcgggcatatgtccataaatatttntattcttttaatgggaaaaagccattcaatattcaatatgaaagggatcacatataaaaaaaacccaatacataagaaacagcctccaagaacattcaagcagcagtcagagagaaaaatgtttcgacagccaagttttcttcaaaatattatgngacagaatangactcaattcacnggctacaacaattcatagaatttttcaatgttttcttgagatgcaaaagttcactgttgcagtgttttcaaatgacnaatcaagtactacttcttggttaacaggccacgggtagagtcatctgagtgtagagaatgtccattcactgctggaaaaatccactggctccanagaaaagaaaatggtctgaagc

SEQ ID NO: 653823 - DNA, 161 bp, Homo sapiens
  misc_feature (56)..(56): n is a, c, g, or t
tgccgaccacaggagccaagccttttcactgtgtggactcatgtgccaagcttagncttggtacccaggcccttaccacggtgaccccagccaatcgggacagttcaaggaggaggagaccccttattacacaggttggaataaaatatttaaatctcgta

SEQ ID NO: 653824 - DNA, 646 bp, Homo sapiens
cgatggtcctcagtctaaggtgatcagtcaacatcaacagtgataggtcatgttgacagtacgtaccccgtgatgtgatgtaataggaatggtcctttacctctgtggtcttcctccccgagacccagaacccagtctaaccatgagaaaaaacatcagccaaattccaacagagggacgttctacagtatccctgaccagtactgctcaaaactgctaagattatcccaaacaggtaaagtctgagaaactgtcacagccaagaggagcctaaggagacatgacaacgaaatgtaatgtaggatcctggatgggattctggaatagaaaaaggacactaggtcaaaactaagataacatgggctgggtgcagcggctcatgcctgtaatcccaacactttgggaggccaagacgggcggatcacgaagtcaggagatcgagaccattctggctaaccacggtgaaactccgtctctactaaacaaaaaatgcaaaacttagccgggcctggtggtgggcaccttgtagtcccagctactcgggaggctgagtcaggagaatggtgtgaacccggaaggcggaacttgcagtgaacgagatcacacacaccctgcatgggggaagaggagatcgtttcaaaaaaga

SEQ ID NO: 653825 - DNA, 339 bp, Homo sapiens
gatatcacatagtatgaatgatgccacgttcacaggccccggagccgaggacctagatactctagaggctaaataatacaccgtgtggccgggcgcggtggctcacacctgtaatcccagtactttgggaggccgaggtgggcagatcatgaggtcaggagttcgagaccagccctgaccaacatgatgaaactctgtctctactaaaaatacaaaaattagccaggcgtggtggtgcacgcctgtaatcccagctatgtgggaggctgagacaggaggattcctggagcccaggaggcagaggctgcagtaagccgagattgtgccactgtactccag

SEQ ID NO: 653826 - DNA, 717 bp, Homo sapiens
agcgggggcgcccccggcggcgtgtgaatggcggcctccgcggcggcagcctcggcagcagcggcctcggccgcctctggcagcccgggcccgggcgagggctccagctgtgcgggcgacaaaggcgctccagacgccccctttcggcgcagcctcggccttctgccctcagccgcggcgtcgtcgcccgcggggggcggcgccgaggcgcttggagctgctggagcactgcggcgtgtgcagagagcgcctgtcgaccgagagggagccccgcctgctgccctgttttgcactcggcctgtagtgcctgcttaggggccccgctgtgccccgccggccgccaacagctcgggggacgtgggggcggcgggcgacggcaccgttggtcggacttgtacccgttgtgcaagcaacagtgcttctccaaagacatcgttggagaaattatttcatgcgtgatagtggcagcaaggcctgcaccggacgcccagggatgcgaaccagtgcttgaactagctgtgaggatacatgcccaggcaacaggctacagtgtgaagtgctcggagcctctgagtgagacctgtgtaagaggcgcaccaagcagggtgacagtacaccaaggaccatacatgtgcgctctactgggagccaagcaagacctcggggattggtgaacgtactggcatattgcaacgtacaccaaggcatgaaccccag

SEQ ID NO: 653827 - DNA, 1315 bp, Homo sapiens
  misc_feature (272)..(272): n is a, c, g, or t
  misc_feature (463)..(463): n is a, c, g, or t
  misc_feature (552)..(552): n is a, c, g, or t
  misc_feature (576)..(576): n is a, c, g, or t
  misc_feature (579)..(579): n is a, c, g, or t
  misc_feature (626)..(626): n is a, c, g, or t
  misc_feature (724)..(725): n is a, c, g, or t
  misc_feature (731)..(731): n is a, c, g, or t
gagaacacaaagaaacgcactttcgtggcagccgatcgggagatcctatcaagtgccaatgctggcccgagctctccgtgtaccggtgtgggtctgacaagtgcccccaatgatttatggtacgaacttcattgaactgccctaccacggggaaagcaatcgagcaatgcttgattgcactgcgcgacgtgcagagctccattccggcttgtctgccatctatcccacacatcagcaccaaaagaccatagacatgctggtatgagctatcnatggtgcccgaaggagtggtgctaggtgtagatccatgccggcaagatgcacagctgttaggcacagaacaggactttgccaggagtccgctgaaagttctaggtcattactggacatgtaggatatcatcaaaggcaaattttgcaaaaataacaaggtcagaaaacctccatgtttctcatatcttgcnaaaagcaaaaattgaagtcagtgaagatggaaccaaagcttcagcagcaacaactgcaattctcatgcaagatcatcgcctccctggtntatagtagacagaccttttctgtnttncatccgacataatcctacaggtgctgtgttattcatggggcagatanaacaaaccctgaagagtatacaaaagaaaccatgcaaagcaacgactactttgctacgaagaaagactcctttcctgcatctttcatagttctgttanntatttngtacatcgcttctttttcaaaactagttcttaggaacagactcgatgcaagtgtttcctgttctgggaggtatgggagggaaaaaacaaagcaggatggctggaacactgtactgaggaatgaatagaaaggcttccagatgtctaaaagattctttaaactagtgaactgttacctaggttaacaaccctgttgagtattgctgttgtccagttcaggaaattggttggtttgtctatatgtgcggctttcagaagaaattaatcagggtgacagaaagaaaaaatgtttatgggtagcttaactttttagtgacacaaaattatttgcttttaattctttcccccatcccctccaaagtttgatagcaagcgtaattcggggtagaacgggaattccaagctctagggtgtagagtagtgtgcggggtatatatgtggttcctaaataattaggatctggttgtaaaggtgctgtggagggcttccacggtgagctggaaggttggttggaaggaaaagggggggaaaaagcttgtttggaggaaaacaaaaattgggggaaataaatgggaggagaaaata

SEQ ID NO: 653828 - DNA, 858 bp, Homo sapiens
caattattctaactttatctttaaatattgctagagcatctcataagctaaagtgctttaatatatatacatctgcatacatataaatatacatacatatacgtatgtaattactgctgaaaacaatcccaggagagagattttcacattatgtgtttctgggttacaaaagaaactggagcatggcaaggttaagtggttgtcaggtaatcgcaagcagagccacgaatcagatatggtgatgtaggcagaatttgttctgctcacttgtagaggttgtagactgtcctgggtttcagtctataaaagaagtcatgactttggaagtaggtataggtatcacaaaggatttgggtaggtgagagggtgtcacaggaaaaaatgcaggagtcagcctgtcagggtctcctctctctagcacagggtcccctctctctaggtcactgctccagcatctgtatttccaagccagcctcatgggctaatgaggttacctctggcttgttcctatccggtctcaggcagcagagactcagctgggagaaagttttaggtttctgctctaacacctgaaatgagttctgctcactgctcttcacccataccccattatcaagtcagttgaaaccatcaaatagaaaaagctgccattatcagggtttatgcttataaatacatgactttaaaaggaaaacacaaaagcatacacaaaaatggctgatagtatggtaaaagccggcagaataccaagagtaaaaaatgagggataataggccttcttctggctcctaatttcattaccagaaaaaagaaaaaaaaacaatatatgcgaggatgggacgagaagaattttaacaa

SEQ ID NO: 653829 - DNA, 226 bp, Homo sapiens
gcacacattgccttctttctcattgggtccagcaataaagataagtgtttgggtttttttttttccctccacaatttagcaatttctaaggaatacagtttatatctcctcctatgctctccagtaccactatttatgcggctactttgtccaggccacaaatcccgtgcagttactaactaaccccaaaaactccttaatacagtttgatttaaaattagatatt

SEQ ID NO: 653830 - DNA, 324 bp, Homo sapiens
  misc_feature (31)..(32): n is a, c, g, or t
  misc_feature (135)..(135): n is a, c, g, or t
  misc_feature (165)..(165): n is a, c, g, or t
  misc_feature (174)..(174): n is a, c, g, or t
  misc_feature (264)..(264): n is a, c, g, or t
ggcttagtgggaagactgagaatacaccggnnatatagagacccacaccggtaaaactgagaccacacccggcaagacagagacaacaccggcaagacagagacaacaccggcaagacagagacaacaccggcangacagagaccacaccggcaagacagagacnacaccggcnagacagagacaacaccggcaagacagagacaacaccggcaagacagagacaacaccggcaagacagagacaacaccggaaagacggaganaacaccgacaagacagagacaacaccggcaagacaaaaacgacaccggcaagactgaaaa

SEQ ID NO: 653831 - DNA, 226 bp, Homo sapiens
tttcagcttcacttcttcaagcaccaccactgagaccttcacacagtactcctggcttctcttcttcaatcgccacctccaagaccacctcaaccagtcctcccagattcaccttgtgatcgccaccaccaagaccacctcacacagtactcccaggtttacttctgtgattgccagcaccgagaccacctcacacagtactcccagttgggcacacattatggag

SEQ ID NO: 653832 - DNA, 99 bp, Homo sapiens
  misc_feature (60)..(60): n is a, c, g, or t
  misc_feature (70)..(70): n is a, c, g, or t
ggagcacacggaggagggcctccggagcgacttgccgacgccatggccgagtcacctagncgggacgtcntagcatccggaacagaactttagcgagag

SEQ ID NO: 653833 - DNA, 236 bp, Homo sapiens
tatgagccggaccagcggctgattagttcttgaaaagtgatgaagatatctacaattaggtataggtgatggtgcacaacgtcgtttaaatatactaaaaaaccactaaatcgtacattgaaagtattatttaaaagctggttttaaaaaaagtttgcattgatctaagaattgctcccataccttgtcaccttggtttctctgctcatatctttcctctacctgaaatgcacatc

SEQ ID NO: 653834 - DNA, 1216 bp, Homo sapiens
gctcgtgcctctctgtgacctagccctggctactcgttcatacatatgtactacgtgatactacagagacctcgcatgatgccacgacttccgagtgtatgtacgcggtagcactcgactgcgtagctggccactcaaagttcgccgatagtggcgattcgtcggtcaagaggctcgttactcaccttatccctatggtagtgcctcgaagacagaggaatatctcttgaaagcttcctgaaagcaggccaatgctaggaggcgaagaggtcgatcgagcgatctgagcgatcacacgcaatctgttccagagcacgttctttcgaagctcatgctcgcgcaagcccctatcgggcagcacgcaggaaccccgcggaggtattagccactcctcgatgctaaccccaaaaaggctaatacacgtacacaccggaagagcgccagagctactgtcacaattccaacgccccaggcgtggacccacctgtgccaagtccatcctttacattcattgggggccacccccactgtgggggcacgtatgcacgagggtgcatagtctatggccgaggccaacacgttaaactgtaaaatccccgaaagcggatgcgtggcccatcgacgatcaggtgggaaccaggccttctactttcgagaggtcccgttacacaccggaaagttggtcctcacccaagaatagcaaaagggcgcgaagttctgtgcagtgccaatccgtacggcgcccgggcaccgtgggagctgtcggatagcggcctaggctatggaatggcatgttcaaactcccagcgcccagtcggcaacggggaaaaccccgcgaaaggccccacgtgcaatggggccatgccccatggggcacccccgtaaagagcgccaccgcaagcgttccataaccccatggggcaggccagacacaactggctaagccaaaagtgacaccacttggaaattccgttggggaatcgcacccacttgggacccaggttaacaccctagaggcctaggcgaatcggaccccccttggaatgtggaagggacactggtggtccccccgcacacaggtagggccaattggccacattgcagaggttcgaagcgccgcaaagttgacccaacgtgagggaaagaggggggcttaccgaaagaagggaacggaccagagagaaccggggacacattggtgggcgaattcgaaaag

SEQ ID NO: 653835 - DNA, 952 bp, Homo sapiens
agcggagctggcagtgagccgagatcgtgccactgcactccagcctaggtgacggagactccgtctcaaaaaaaaaaaaaaaaaaaaaaaaaaaaatccccttttttgtttgaatattggaaaattgcccctttggttatttttaaggcacttgccgtgattttggctctggaaaaatggtggaagttgaaaacttatttaaaaccagtattttattacccagaggctctcattttctttccctggtccgcttacgtgcaaaggacaaaccccgcacaaagaaagacttcttcaggaaatttgctggcgtgaattgacagaatgtgaccttgtgattaaagtgaagactttcttctcaacattaccttgaatgtgccttagaaccattcttcttaaattattattcatgaaatattacaccgttgttgacccattgaacattcattctcatctcatttttcccattcaaacacttttttgaaaacattatccctgggattctcatttttattatagaagcctttaatattttctcccacattcttggcagtatcccctatagaaagtttctatcacaggataaatttaaccctttttatttcgcttagaatttggcggcagagaggagaccttttcgccctataaagggctctccctttattatttaacaactctcttttattctccagtagaacatcgcacatttttaaaacactatatctctcagggtaaagaaagaccttctctttataaaacactatttgcgcacgcgccatatagggctctatatttcgggacacagattggggatttttcccaataaatagcggcccagcgagacagcattcggcgatctatttctaacacatatctcttgcggccattcccgggtatctaacgacagcacggggggtttttttggggttaaccccctttattttaattaaaatgg

SEQ ID NO: 653836 - DNA, 320 bp, Homo sapiens
tcgtcttgtgtgtgtgtgtgtgtctttatgtcttgttgctatttcttgggccactcctgaggcaaatggagggtcccaggcgaggggttgaattggagctgtagccgctggcctaagccagagccacagcaacgtaggatctgagccatgtctgcaacctatactacagctcatgacaatgctggatccttaatccactgagtgaggtcagggatcgaacccacaacttcatggttcctagtcggattcgttaaccactgagccacgacaggaactcctgtttttggggttttttagggccgctgctccgcttttgtgtt

SEQ ID NO: 653837 - DNA, 160 bp, Homo sapiens
tgccccgcgcaccttggcaatcttctcactatttggctacatagacgaggtgtgctcttttagctagtttattaggtagctcgtctggttgcgggggtcttagctttggctctccttgcaaagttatttctagttgattcattatgcagaaggtataggg

SEQ ID NO: 653838 - DNA, 952 bp, Homo sapiens
tgttgtgcccctctgcttcttctattcgttgtactacggtcggtgcggtgactgttcatttccctcgttcgctggcttgtcgttatgttgactgttccacggggctctcgatgttggcctctccgctgtgcgtcacgtggccttttcctttcggctttggggtgctctcctgctcggtattccttgcggtctgcctctgtaacgtgcttttcaacgtgtctatcctgttcgggatctcgtttggtccttctaggtaagtgtcccccgtgagtgcgctctccctatgcttcgcttctatactacatgatcattggcttttactgctctcgcctatgatggctatggatcgactgttgtcttgggtcctctgacctctacctcgaatcctttttctagagtatacattatgatgatcatccgctcaccatgataccttagtgatttcatgtgttgtctggtttgagcttgccctctccgaatatcctaagcctagagtatgctactattccctcggtccagtctctagccttactagtaccataaagtgattctcttgagtgtgcctagggttaaaggcttccagttgctagcctctagttattttagacaatctcgcgatcgttaatttcttagcttcctgtgtctaatataattgctacggctgtacctttccgtgtcagaaataaactcaaggctctaatatagatgatgttcccttctgtaactccgctagagccatcaggttctcattccttttcacacagtatacttctcacaagtcagatttctatgagttgtgatcacctgatttttttaacaatatatttctaacgggaatgggtgggagtgtctggtgaaaagaggtgtaatgtgggttgtatgagccaatcatatttgtgaatttataaaaaaagtttaaataggaaatatctgttctgaaaccccacttaag

SEQ ID NO: 653839 - DNA, 827 bp, Homo sapiens
caatagatacttgccgcgaagtttgactcttaaaactaggcggcatatggtataatacgccgtcacactcattcttcaaccccgctgactaaaacacactagcctaccccttccttgtactatccctatgaggcatatattagtaacaagctccatctgacctacgacaaacaggacctaaaatcgtctcattgcatactcttcaatgcagccacatagaccctcgtagataacagtcatatgctcagtccaaagccccactgaaggcgtgtcaccggcgcagtcattctcataatcgcccacggacttacattcctcattactattctgctcaccataaacgcccgcttatctctccttgcaaaaaaaaggcttcaagggccttaaattttttctccacaaatatttgtgggggcagccgattagacttctctagcaacgtctcgaataaccgcgtctataacaccacaatataaacactagtgagaaaactacgggagaagaaacatctctgggtgcataggtaaccccaatgttcgtcggtgaaccagagaatatcacctctccagatcttaacgagaacataagaagggacgtacgaaacaatacgtagaacacgaagccataatatacccctctatagttgttttaccacacaacaaaggggggtcaacaaaacacacaccaatataataaacataaagccgtcataagaccgtgagacaaacgagaaaggtccctcatgctgtcattcactatccacatttcctactatcatcagccgacgtacttacgacgggttcctcctaaaacacaaaaaaaaaaaa

SEQ ID NO: 653840 - DNA, 1024 bp, Homo sapiens
cgaaagcgaagaaggaagctcctgccacctccgtaaaggctgaagccaaagcgaaggcttgagaggccaagaaggcagatgtgaaagggtgtccacagccacaacaaagaagaagatccgcacgtcaccgcagccttccggcggtccgaagactactgcgactccggagacagcccaaagtatcctcggaagagcgctcccaggagaaaacaagcgttgaccacgtatgctatctatcaatgtttccgctgacacactgagtctgccatgaagaagatagaagactaatcaatcacacttgtgttcattgtggatgttaaagccaacaagcaccagattagacaggctgtgaagaagctgtatgacattgatgtggccaaggtcaacaccctgattcggtgagttgggcctcaagggatggggagcaggctaggaccagatagtctggagccaaaataaaaagcttggattaccatgtaagcttttgactgttcatggtagtcctggtaatgcaggactacacgtgtagtccgagctatgcaggaggatctcgttgaggccaggatatcacccgaggattgccccgattgtactcctagcctgagcaaccggatgcaaggccctgtatgaaatagtaaaacgaataaaaaaattccttggactttacaaacagggggaaaaagggattgctttgactttagacactgggtagttaagtgtacacagtagttggtaatactcatagaaggaatgagaataacaaggatagcttgagaatattcagagaccgtagtggaggggaacccggaagctggcacatagagaaccgtgcgcacagcgggcaggacattgcacaccccctcacaataaaccaggggacccccctaaccacacacaataggcgaacacagagaacaacaaccaatggcaaaacccaagttgttacacaaatctcaccccggcgaaataacaccctcatcaacatcggttcacccttgaggggaggaacccccataaacaacaa

SEQ ID NO: 653841 - DNA, 749 bp, Homo sapiens
aagacactgtcttggctcacttatacagcaagtgacaaccaatttagttcagacctttcttgcttctagacctgcaccatccactcttatccacttctcattcttcctggaagctgccacggaacatgcagacccccgtatccactttgccagtagggacacccacttttgaaaagccacggacccctggcaacgcagctgcagacataccatttaactcaccctgcctggaaaaggaaagtaaatgttttcttcccaatttttgctagggaaatccaggcacatacatgtattcagtaactcaatgatataaatttcagggcttgtgtctgtgtgttattggaaaagcatttgaggctggctgtcatggttcatggctgcaatctcaacactttggaggctgaggcaggaggctcacttgaggccaggagttccagaccaggctggacaactctacctctacaaaaaaataaaataataagccccgcatggtggtgcacacctgtagttctagctactcaggaggctgaggtgggaggattgcttgagcccaggaattcaagctacgctgagctatgatcacaccactgggcctgggcaatggagtgagattctgtctctaaaaaaaaaatgctttgagaattttagcaaatctaagtacatttggagtctgctaatattactgtatatgggatctggtgggaccatccctaaggatttaataataaaatgtccctttatattgttga

SEQ ID NO: 653842 - DNA, 174 bp, Homo sapiens
ggagtagtcaagtctcgttggttcagatctcgtcgcgaccatgtcctggactcggtccatgagtctcccccagtgtcaagatggaatcaaatccatgtcgcgatcgaagagtacccccaagtctcctgaagatgaatgacggtgtctcttaagaaaatggtaatgtctgtgaat

SEQ ID NO: 653843 - DNA, 234 bp, Homo sapiens
actcttaggatcccccaattctggctctctgggccacaaataaacacagaaatagtccagaatgtcacaagtcccaggcagaagaccaacatgggcattttgtttattaaccaggggggtcttaaaagtgaaccgcgatcaaaaggccaagaaattctaaatccattgaaacaagctctaaacaatagcatgcagtcccaccacttgtaccaacattcccaaaaaacccgaatt

SEQ ID NO: 653844 - DNA, 136 bp, Homo sapiens
ttgaagttctcaatgtagtgtagagatctaaactcatacttaaagggggtcatactggtgattgtggacacagcctagaagagacaaagtataacgtcactggatagcgcaggtatagtctgcgcattggcagaag

SEQ ID NO: 653845 - DNA, 607 bp, Homo sapiens
gaatatcgacaggcttagtctccaccctcaggcatggaaccattcagggtgaagcctggtgatgtgggcacaggagactcaggctgatataacaataacaacatcagtaataagagaagaattataaaacctgttgcttgtctgaatagatttgagcaacagtcttgcttctgttagaatcctggagccgttatgtcctgaatattcttctggacatcattgctggctggagaagggagccccaggcccggctcggttgacatctgtcaggtatggaagtcctcatccagctgcctgtgcttccttgagagatccttaggggctgcttgggagcatgcctggggctggtgatctggggcgactcacagtttgggaattcatcccccaggggattggaacagctccctcgggtgtcttgtcgacttttggctggctcccccctgccggaagccgggaagcgatctcatcgaaggtccggcctttagactcaggaactttgaagtaggtgaaggatgaagaacagaatccaaggagcacaggtgaagatattacgatgtagggacacacagttgcctccaatagtggagcacatcccacaatgaatttg

SEQ ID NO: 653846 - DNA, 187 bp, Homo sapiens
ctgccctcaagggtgtgtatatggtataggggcaactgtatgaaaaattggggaggagggggccgggcgcggtggctcacgcctgtaatcccagcactttgggaggccgaggcgggtggatcacgaggtcaggagatcgagaccatcctggctaacatggtgaaaccccgtctctactaaaaataca

SEQ ID NO: 653847 - DNA, 445 bp, Homo sapiens
cacagggtgcagagatgatggatatctatgtgcaacagaatgaagttgaactccttgcacaccatatgcaagaagattaactcacaatgtaccaaagacttagctgtaagaactataagcatgttactcctataagacaacagaggagtaaatctttctaatcttggattaaatcatggtttcttagatataacactgattagtcagggttctccaaagaaaaaaaccaaataaaatacatacagacatatcagaggagatctactatgggaatcggctcactcaattatgaagactgagaagtctcacaatatgctgtgtgcgatctggagacctaggaaagctggtggtgtatttcagttccagtctgaaaacccgagaaccaggggagtcacaggtgtggcttctagtccaagccctaaagcctgagccctgtggacgagta

SEQ ID NO: 653848 - DNA, 549 bp, Homo sapiens
gttacaagatatactcatgcaggctagaattagaaatcaaagactgaaagatctttcaggcacctgcagcaagagaggagtcaaaacctatgtactgatctcaactagtaaaattttctccttggccaggaatcatgctgagttgagggacagaaatgcaccgtgcagcctgggaaagtgttcaacacacaaaaatagaaccacctgtatgtagtcttttggaaagcacaaaataaagagcagtcctacagggttcactgctatgtcctgaatgttgatgtcccttccaaaattcatatgttggaacctaatgtcaatgtaatagtattaagaggtggggcttttgggaagcaatggagtcatgagggcttcaccctcatgagtaggataagtacccttacaaaagaggctcagggaggcgctcttgcctcttccaccatgtaaaggacacgtagcaggcacccatttctgaagaatgggccctccccagactccatatctgctggtgccttgaatctaggacttagactctaggactgtgcgtgacat

SEQ ID NO: 653849 - DNA, 114 bp, Homo sapiens
  misc_feature (1)..(1): n is a, c, g, or t
ntgtctacttactacgaaccctgacactactttaacgtactgggacgactttttgcctgactacttcttcacgtcttgtcactcacctacctgattaacgctttgtaactctac

SEQ ID NO: 653850 - DNA, 521 bp, Homo sapiens
ggcggggcgcggtggctcacgcctgtaatcccagctctcagggaggctaagaggcgggaggatagcttgagcccaggagttcgagacctgcctgggaataataggcgagaaccccgttctccagaaaaggaacaaaacaaaacaccaaagggacaaaaaaaaaacaaaaacaaaaaaaaaaaaaaaatttgttttggggcgcgccttgcgggccctgaaaaaaagtttttataaaacaccactttgtggtgggggggcgccgcgggccccccgaaagggggaaccgggcgagcacttggggccaaaaccggggtggacccaaaaagaaggatccgtggggcacaaacggctaagtggcgtgggttcttcccaacccaaataaaaaaaaagggcgcggggggacaaccggggtgctgttggaagcaaatccccagagagggtcgcggggggcacaaagcgggctgcaacaacaaacggggccaccagagaaggctcgagaaaaattagcccgaggcgggtgg

SEQ ID NO: 653851 - DNA, 503 bp, Homo sapiens
gctagagggtccgagatcgctaacattaggggaactatggtgtcttcacatcatccatttagcactatttataataagcacaccaagttatatgactaagtataagttgaaaattttttatagctgaggggttggtgataactctagaggatgtaatgttagagatacgtatctctaacattcagtacagatgaaataacgaatagccgaggtcccactggccgtgatccaaaatgcagtggtctggttccactaggaagtaaactacattgtcctaataaaatgtatttcttttcccgttgaactgggtgatttccttgtaaatgatcaataccatctcaaagaagtatatttacagttaaagtggctaatgactcatacttggtttttgagaatggttcctttaccatcttttcatggtctctcaactttctatcatctactttaagaatttccagtgcctcacatctttattaacaaagtattacaatccaggaatgaaa

SEQ ID NO: 653852 - DNA, 132 bp, Homo sapiens
gaaacttagtactcatatacataactaatacgaacttaaaattcatcatacatttacttcatttttatagcttgaccttctagtaaatcttaagcttcatatgatttatggctagctatatacaggagatcc

SEQ ID NO: 653853 - DNA, 222 bp, Homo sapiens
accaccctatttcacaacatccatggatattgtgcaagtcagaatgtcgcaagacttagtgataacagtgggcctgtagctcaagagaagagttgacctctgagacatatctagaaattgtctatcgtgctgttctagcactatatgtgggtgcctgtgcagtcctttcactaccgctatgaagaagcgcaacaagaaactcaatgcacaacagagtgattt

SEQ ID NO: 653854 - DNA, 192 bp, Homo sapiens
ccctggatttaaccaagaaggtctgtggcgatatctgtgcatactaaccattctaaagccttatggcaacagggatttcgcaacgtttcagatcctccagagagcatttgccgtgactccagagccacaaccgacattccccatccgactttcactcacttcctatgctccatccatgggcatcgtccaaca

SEQ ID NO: 653855 - DNA, 582 bp, Homo sapiens
attggacaatgtccctgaccccatgagttcaatactgaaggtgtcaaagtggtctatttgcccccagacataacatctctaaatcatcctctagatcagggagtcataaggaccattaaggctcattacacacagtactttatggaaaggattatctaacactatgcaagagaaccctgatagaacatcatgaaagtctggaaggatcacagcactgaagatgccatcgttacacaaaaagctgtgaaagcatcaagcccaacacaacacactcccctgctggaggaaactgtgtccagatgttgtgcatgacttgacaggatttacaatacagccaaccaaggtaatcacgaaagaaatcatgaacacggaaaaaagggtggtgagtgaaggctttcaagatatacaccttggagaaattcaagagctaatagataacacacttgaggaattaacacaagatgacgtgatggagacaagtgcttttgaaccagttccagacgataaggaagaccacccccaaggagtgccacaaaaacacctggcaaaaggttttaaatatttaaggctggatttgacttt

SEQ ID NO: 653856 - DNA, 251 bp, Homo sapiens
ttaagtactctggaaggagcgatgaaatcattaatttctatttacagccggagccgcgggcgcagcatcgttggattatagtactgaaaaatcatgatacaaaaataggaacctgtggatttcattgttggtacagggaacaaaattgtgttgatataggttatgatttgcaagaagcattttggggacagggaataatgtcagaagcgctgaaagctatcttgtcattttcctttaaaaatatgaaagtt

SEQ ID NO: 653857 - DNA, 936 bp, Homo sapiens
ggtttctcgctccttccgagttaccgccgccgtcgccgcgctcctcctctcccggtcctgggtttccttggccgctgcggccgccgtccctctgcgacctgtatgaggaggaggaggaggaggatgtgaagatggggagtgcaagatgttgtggaagaggaaaatcccgggggaccgccgggcctctttcgacagctacacaattttgaactgggtggcgattacgtgcggagcaacaatactataccagtcaagcaagataggctagaagagccctagaagaaaaccaaagagcgttaaccaagcacaatcctttagcactggtgttgccctatcgtgataacccacccttggcaaaccaattgtcctgcaacgattgttggataatccaggcatccccagctaccgacggatgcactctccaatcaattcaatattgccaccgaaggcggtgtgatattcaattaagcgcagaatgttggcacagaagagacaatggtatctgggactaccaataaaaaccaccttccagggaacacattaagattatgccccagcccaaacttggacacgaccagttctgtctttatgcaaaaacaaccctatggagctataccattctagatgatatgccatcggagaacggggacgacccagacaatgaaactgcgtgggttgctgggtacaccacctcaataagaagcccctagtcctcttttgcagggaacggacccttgggggcacccccttattcgacatggaggcgagggtctcagtggaccaatgtatgtcataccacacgtatatggtcctcggaaagacctggaagagttcggagacaaaaccacatcgcggcggattgcgccccaatgtgggccacacgacaggctggggcggcttgcgcacccccgtacacgaagaaagccgtcgaccagg

SEQ ID NO: 653858 - DNA, 400 bp, Homo sapiens
acatcagtggtctggacagagaaagccacatactgtatgattccacttttatatgaaatatacaaagtggacaaatgtagagaggcagaaagcaggttagtggttgctgggagttgggggaggaaacagggagtggccgcttaatgggtacaggggccttcttaggtgataaagctagttaaggaatataatactgaacaaggctaagtccaaatctaatatacaccaaatatacaagtaaacttggcatttatactagtgcagtacaaaagttcagttatatgtatcttacccttcaaggaggaaaaagataatctagaatgtaattgctaagcataggaggatattttacaaagggtaagaatttctttgttcactttctgacatttctggagtaact

SEQ ID NO: 653859 - DNA, 382 bp, Homo sapiens
  misc_feature (368)..(368): n is a, c, g, or t
tgctgggattataggtgtgagccacggcacccggcctggatgtcaagactttgaaaaacagtctatactgggaagattccacagttttctgtattccagggttaaattaaaactttgtctaacaaactgttaactcagtttaagtttttaattagttgtctgtggatataaagaatgggtcaacagagtattttccttggagcatttcacctcagcacatttattgagcacctttttagtgcaagcattgtgccaggagaacttaagaactatacagaggcccagcattagaggtggtttaatgtggtgaggaaaacaatttgatacatgtataattacttttaaaaagcaggggattgaaactgcanaccagaatcaggaa

SEQ ID NO: 653860 - DNA, 189 bp, Homo sapiens
tgatccccgacaccctaataacgcagattgagagaacatggacaactcaagtgatatcataaaactaaagaaatggaagacatgcatcctttgagtgcccagtcagggaagacccttagcagagcgtgggtgggggcagtacggcggaaggaatcggtgttgcttacagaagcctctaggcccgaattc

SEQ ID NO: 653861 - DNA, 316 bp, Homo sapiens
  misc_feature (263)..(263): n is a, c, g, or t
tcggctcggcccccaatatttgcaggaacataatatacatcgttttttttttaaaaaaggttaatttaggaatgatttcatcttcaaccacataaagtatctttttaagaccagtgaaacctctgtgtcatggcaagacttttcagttcatggtatctactttcccaagttttaacttcttaaagggaaaaaaaaaaaggatggaaaggggtttataatggtattccccatggagaaacctggtgggtagggatctaatccantaaccagggctggtctccccttccttttggtttcccgggactacccaggatca

SEQ ID NO: 653862 - DNA, 254 bp, Homo sapiens
ttttttcccggggtttttccccccggggcccggcgggggggtttttaaaacaatttttgggcctttttgcccaaccccgggggggcggttttcccggggcccctttttttggggtgaaaagggggacccaaaatttttttttgccccgtttttttttaaacccctttccctggggggggggggggggccccatgggtttttttttttccgccccccctgataaaaacccaatttgggggaataaaaatttttta

SEQ ID NO: 653863 - DNA, 438 bp, Homo sapiens
  misc_feature (89)..(89): n is a, c, g, or t
  misc_feature (108)..(108): n is a, c, g, or t
  misc_feature (117)..(117): n is a, c, g, or t
  misc_feature (132)..(132): n is a, c, g, or t
  misc_feature (146)..(147): n is a, c, g, or t
  misc_feature (182)..(182): n is a, c, g, or t
  misc_feature (199)..(199): n is a, c, g, or t
  misc_feature (226)..(226): n is a, c, g, or t
  misc_feature (347)..(347): n is a, c, g, or t
  misc_feature (422)..(422): n is a, c, g, or t
  misc_feature (424)..(424): n is a, c, g, or t
gcggccgcctactactactaaattcgcggccgcgtcgacattttattcaaattcctctgatagttctctagtagcaggttttaggatanctgttttgatccagatttnctgttaaangatttagatgagggnccaagcggggtggnnctcgcgcctgcagtccgagcacctttggagggtgngagggcgggcggatcancttgagggccgggagttccagacaagncctggccaacatggcgaagccccatctctactgaaggtgcaaaaattggctgggtgcggtggtgcttgcctgtggtcccagctgcacgggaggctgaggtatgagaactgcttgagcctgngaggtggaggttgcggtgagctgaagtcgagccactgcagtccagcctgggtgacggagtgagactctgtctcananaaaaaaagtcgacg

SEQ ID NO: 653864 - DNA, 355 bp, Homo sapiens
tttaacattaattccttttctttcttaacttataaaactggtagaaaaaaaatgcaaactagaccaggctcggtggcttacgtctgtaatcctagcacttcggtaggccgaggcggtggactgcctgagctcaggagttctgagagcagcctgggcaacacggtgaaaccccgtctctactaaaatacaaaaaattagctgggcatggcggcgtgcacctttagtcacagctacttgggaggctgaggcagaactgcttgaacccgggacgcagaggttgcagtgagccgagatcgcgccactgccctccagtctgggcaacaaagcgagacgccatctcaaaaaaaagtcgacg

SEQ ID NO: 653865 - DNA, 110 bp, Homo sapiens
atacacacatactccttacactattcctcatcacccaactaaaaatataaaacacaaactcacactaactccctcaccaaagcccataaaaataaccacattataacatc

SEQ ID NO: 653866 - DNA, 394 bp, Homo sapiens
ttcatggtggctcactcctttaatcccagcactttgggaggctgaggcaggtggattacctgaggtcaggagttcgagaccagcctggccaacatggtgacacctcatctctactatacataaattagctgggtgcggtggcatgtgcctgtaatcccagctacttgggaggctgaggcaggagaatctcttgaacccgctagggggaggtttcagtgagccgtgattgctccattgcactccagcctggctgacagagcacgactccatctcatcaaatacctctcaaagccacctaggcccagcaggatagctcaggcctgtcatcccagcactttgcaaggccacggtggccggctcacctgtggccaggcgtttcggaccagcctcgctc

SEQ ID NO: 653867 - DNA, 870 bp, Homo sapiens
  misc_feature (814)..(814): n is a, c, g, or t
gtgccattgagcggccctcaaggtaataggattgcaggaggcagagggtgtcctgctactgaaagcccaggcacctggcagctacctcatctccatcaagtacggtggcccctatgcacattgggggcagccccttcaaagggccaataggtcacaggcccccgtctcgtcagcaaacatcagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctttacagcgtgtcctacctgctcaaggacaagggggagtacacactggtggtcaaatggggggacgagcacatcccaggcagcccctaccgcgttgtggtgccctgagtttggggcccgtgccagccggcagcccccaagcctgccccgctacccaagcagccccgcccttttcccctcaaccccggcccctgggccgccctggccgcccgcctgtcactgcagccgcccctgccctgtgccgtgctgcgctcacctgcctccccagccagccgctgacctttcggctttcacttgggcaaagggagccatttggtggcgctgcttgtcttctttggttctgggaggggtgagggatgggggtcctgtacncaaccccccactagtttttttttccagccaagaggaataaagttttgcttccatta

SEQ ID NO: 653868 - DNA, 289 bp, Homo sapiens
acgtcgggcaagcctggcaagtgggaatggctgggaatcggcctgacctggcgtaccccttggtccggccagctcaccgtgggcgcggagaacgtgatcagccgcggcaagaatccgttctcgccgcgcaatgaaagcaatgacgacggcactgtgccgtatgtgcgttacgaacaggatctctgatcccaccgcgcggttcttcctgcagtgacttctcacgggcgccgaaaggcgcccgttgcgtatgcgtgatcgcgatacacgcatcgcgcttttcggcgggtcg

SEQ ID NO: 653869 - DNA, 1058 bp, Homo sapiens
  misc_feature (814)..(814): n is a, c, g, or t
gtgccattgagcggccctcaaggtaataggattgcaggaggcagagggtgtcctgctactgaaagcccaggcacctggcagctacctcatctccatcaagtacggtggcccctatgcacattgggggcagccccttcaaagggccaataggtcacaggcccccgtctcgtcagcaaacatcagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctttacagcgtgtcctacctgctcaaggacaagggggagtacacactggtggtcaaatggggggacgagcacatcccaggcagcccctaccgcgttgtggtgccctgagtttggggcccgtgccagccggcagcccccaagcctgccccgctacccaagcagccccgcccttttcccctcaaccccggcccctgggccgccctggccgcccgcctgtcactgcagccgcccctgccctgtgccgtgctgcgctcacctgcctccccagccagccgctgacctttcggctttcacttgggcaaagggagccatttggtggcgctgcttgtcttctttggttctgggaggggtgagggatgggggtcctgtacncaaccccccactagtttttttttccagccaagaggaataaagttttgcttccattaaaaaaaaaaacgaaaaaaaaaaaaaaaaaaaaaaaaaggaaaaaaaaaaaaaaggaagaaaaaaaagagagagagaaaaacagagaacgagggggggcacaggagggggggagcgcccgcggggggggggggggggggccaaaaagaaagggggggggagcagggaaagagagggagggaggggagag

SEQ ID NO: 653870 - DNA, 425 bp, Homo sapiens
gccgcggcctcaatcctagtagttcctctgggcgcttaaagatttcagctagcgtcaacgcatgatccagcccctgtagtgtataagcagcatgtccatccgtaggtatcaatatggctgggtgtgtatagggaacataaggctacatctctccgcttggtgaggttgctatagcatctcagactggtagatctacatcccgtccaggtggagctggtcgtctctcttgagcatcggagggagcctctacggtaatgtaaggtcacggctcggcactccggcctgtgtggcagaccaacatctctgtcggctaaagagcagacgactcgcatccgctcggctcacacagagtaatccgagcccagtgccagcgtcacatagcgcgctcacgtcagcccaggagattagatccggctgcggctcgc

SEQ ID NO: 653871 - DNA, 1190 bp, Homo sapiens
  misc_feature (946)..(946): n is a, c, g, or t
gtgccattgagcggccctcaaggtaataggattgcaggaggcagagggtgtcctgctactgaaagcccaggcacctggcagctacctcatctccatcaagtacggtggcccctatgcacattgggggcagccccttcaaagggccaataggtcacaggcccccgtctcgtcagcaaacatcagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctttacagcgtgtcctacctgctcaaggacaagggggagtacacactggtggtcaaatggggggacgagcacatcccaggcagcccctaccgcgttgtggtgccctgagtttggggcccgtgccagccggcagcccccaagcctgccccgctacccaagcagccccgcccttttcccctcaaccccggcccctgggccgccctggccgcccgcctgtcactgcagccgcccctgccctgtgccgtgctgcgctcacctgcctccccagctgtgccccgggcctgtgtcctgactgggactcttgggacgccagcaagcccgttaccaatgcgcgagaggccatgcagcaggcggatgactggctgggcatcccccaggtgatcacccccgaggagattgtgcagccgctgacctttcggctttcacttgggcaaagggagccatttggtggcgctgcttgtcttctttggttctgggaggggtgagggatgggggtcctgtacncaaccccccactagtttttttttccagccaagaggaataaagttttgcttccattaaaaaaaaaaacgaaaaaaaaaaaaaaaaaaaaaaaaaggaaaaaaaaaaaaaaggaagaaaaaaaagagagagagaaaaacagagaacgagggggggcacaggagggggggagcgcccgcggggggggggggggggggccaaaaagaaagggggggggagcagggaaagagagggagggaggggagag

SEQ ID NO: 653872 - DNA, 315 bp, Homo sapiens
  misc_feature (193)..(193): n is a, c, g, or t
cggggatctttgttttaatcttgcgatgtgccttgcttgttgctgggcggatgatgtttactaacccatgaattttacatcccaaggggataggcccttggacccccccctttccaaggccgggggggcggtttcccatgggatgtgaaaggctggcccttattaagtccctgtaactcaaaatgtcaacccnccccgaggcccccccccgtcccccagaattttggctgtttacaaatcacgggtccatcgagcacgtttgaaacccctgggagccccggcttttttttaattaaaataaggtaagcccctcca

SEQ ID NO: 653873 - DNA, 909 bp, Homo sapiens
  misc_feature (853)..(853): n is a, c, g, or t
gtgccattgagcggccctcaaggtaataggattgcaggaggcagagggtgtcctgctactgaaagcccaggcacctggcagctacctcatctccatcaagtacggtggcccctatgcacattgggggcagccccttcaaagggccaataggtcacaggcccccgtctcgtcagcaaacatcagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctttacagcgtgtcctacctgctcaaggacaagggggagtacacactggtggtcaaatggggggacgagcacatcccaggcagccccagactcagggcaccacaacgcggtaggggctgcctgggataccgcgttgtggtgccctgagtttggggcccgtgccagccggcagcccccaagcctgccccgctacccaagcagccccgcccttttcccctcaaccccggcccctgggccgccctggccgcccgcctgtcactgcagccgcccctgccctgtgccgtgctgcgctcacctgcctccccagccagccgctgacctttcggctttcacttgggcaaagggagccatttggtggcgctgcttgtcttctttggttctgggaggggtgagggatgggggtcctgtacncaaccccccactagtttttttttccagccaagaggaataaagttttgcttccatta

SEQ ID NO: 653874 - DNA, 358 bp, Homo sapiens
  misc_feature (21)..(21): n is a, c, g, or t
  misc_feature (23)..(23): n is a, c, g, or t
  misc_feature (26)..(27): n is a, c, g, or t
  misc_feature (32)..(32): n is a, c, g, or t
  misc_feature (35)..(35): n is a, c, g, or t
  misc_feature (114)..(114): n is a, c, g, or t
ccggacccccatttgcccacnanggnnactcnccntgtctgagcaggtaggacacgctgtagagccggctgcccacgtgcttcaccaggatctcctcgcagggggtcctgtacncaaccccccactagtttttttttccagccaagaggaataaagttttgcttccattaaaaaaaaaaacgaaaaaaaaaaaaaaaaaaaaaaaaaggaaaaaaaaaaaaaaggaagaaaaaaaagagagagagaaaaacagagaacgagggggggcacaggagggggggagcgcccgcggggggggggggggggggccaaaaagaaagggggggggagcagggaaagagagggagggaggggagag

SEQ ID NO: 653875 - DNA, 1096 bp, Homo sapiens
  misc_feature (852)..(852): n is a, c, g, or t
gtgccattgagcggccctcaaggtaataggattgcaggaggcagagggtgtcctgctactgaaagcccaggcacctggcagctacctcatctccatcaagtacggtggcccctatgcacattgggggcagccccttcaaagggccaataggtcacaggcccccgtctcgtcagcaaacatcagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctttacagcgtgtcctacctgctcaaggacaagggggagtacacactggtggtcaaatggggggacgagcacatcccaggcagcccctaccgcgttgtggtgccctgagtttggggcccgtgccagccggcagcccccaagcttggggggccgccccccccccggcggccttttaaaaacccccccccaaaaaagacaacccccgcccttttcccctcaaccccggcccctgggccgccctggccgcccgcctgtcactgcagccgcccctgccctgtgccgtgctgcgctcacctgcctccccagccagccgctgacctttcggctttcacttgggcaaagggagccatttggtggcgctgcttgtcttctttggttctgggaggggtgagggatgggggtcctgtacncaaccccccactagtttttttttccagccaagaggaataaagttttgcttccattaaaaaaaaaaacgaaaaaaaaaaaaaaaaaaaaaaaaaggaaaaaaaaaaaaaaggaagaaaaaaaagagagagagaaaaacagagaacgagggggggcacaggagggggggagcgcccgcggggggggggggggggggccaaaaagaaagggggggggagcagggaaagagagggagggaggggagag

SEQ ID NO: 653876 - DNA, 729 bp, Homo sapiens
aacaatgccgcgtgttgcgaggagatcgccattatccccagcgagaacagctccgcaagaagatagcaggttagtgtcacgcatctgtattgaagcgaattcagagatggcccagtagagaggtatctccatcaagctgcaggaggaggacgagagaaaggagagacacattatgtggcctgaggtctcagccttggatcaggagattacttgaacgtagatcctgacagctataggacaatgtctgaagcttgtcggacttcgtgcagttctgtccgaaccattcgagggtcagctcagccatagcgagttggcgcatgagagttctcagaagagcgccctcgtgggggagcctggtttgagagttcttggagcgtgatagatgcatggtgattattggtcaaataagaagtcgttggggaaacagaccaaggcgcgtctagacacagaaaacacacagaagataaacacagggtgggaacgcgaccatctgctatgatgtgactccgggggtgtgtgcgtggggtcaaaacgagcgagggggtcaagatgtgggagagatgtggggggcaacctatggtggggccccatttgaggacgactggtttccccctgtggtcaccccaggaggcctggtgcctgtgttggttcctacagagggggggacacaggaaactcttctgggcggggggcgtccaccgcgcggactatcggtcgtggaggattccg

SEQ ID NO: 653877 - DNA, 984 bp, Homo sapiens
  misc_feature (3)..(3): n is a, c, g, or t
  misc_feature (68)..(68): n is a, c, g, or t
  misc_feature (71)..(71): n is a, c, g, or t
  misc_feature (75)..(75): n is a, c, g, or t
  misc_feature (78)..(78): n is a, c, g, or t
  misc_feature (90)..(90): n is a, c, g, or t
  misc_feature (92)..(92): n is a, c, g, or t
  misc_feature (104)..(104): n is a, c, g, or t
  misc_feature (108)..(108): n is a, c, g, or t
  misc_feature (116)..(116): n is a, c, g, or t
  misc_feature (121)..(121): n is a, c, g, or t
  misc_feature (137)..(137): n is a, c, g, or t
  misc_feature (140)..(140): n is a, c, g, or t
  misc_feature (156)..(156): n is a, c, g, or t
  misc_feature (168)..(168): n is a, c, g, or t
  misc_feature (170)..(170): n is a, c, g, or t
  misc_feature (172)..(172): n is a, c, g, or t
  misc_feature (191)..(191): n is a, c, g, or t
  misc_feature (214)..(214): n is a, c, g, or t
  misc_feature (236)..(236): n is a, c, g, or t
  misc_feature (264)..(264): n is a, c, g, or t
  misc_feature (278)..(278): n is a, c, g, or t
  misc_feature (288)..(288): n is a, c, g, or t
  misc_feature (307)..(307): n is a, c, g, or t
  misc_feature (315)..(315): n is a, c, g, or t
  misc_feature (317)..(317): n is a, c, g, or t
  misc_feature (329)..(329): n is a, c, g, or t
  misc_feature (386)..(386): n is a, c, g, or t
  misc_feature (393)..(393): n is a, c, g, or t
  misc_feature (401)..(401): n is a, c, g, or t
  misc_feature (413)..(413): n is a, c, g, or t
  misc_feature (420)..(421): n is a, c, g, or t
  misc_feature (427)..(429): n is a, c, g, or t
  misc_feature (435)..(435): n is a, c, g, or t
  misc_feature (442)..(442): n is a, c, g, or t
  misc_feature (445)..(445): n is a, c, g, or t
  misc_feature (450)..(450): n is a, c, g, or t
  misc_feature (458)..(458): n is a, c, g, or t
  misc_feature (466)..(466): n is a, c, g, or t
  misc_feature (469)..(469): n is a, c, g, or t
  misc_feature (494)..(494): n is a, c, g, or t
  misc_feature (517)..(517): n is a, c, g, or t
  misc_feature (573)..(573): n is a, c, g, or t
  misc_feature (726)..(726): n is a, c, g, or t
  misc_feature (729)..(729): n is a, c, g, or t
  misc_feature (735)..(735): n is a, c, g, or t
  misc_feature (752)..(752): n is a, c, g, or t
  misc_feature (756)..(756): n is a, c, g, or t
  misc_feature (776)..(776): n is a, c, g, or t
  misc_feature (781)..(781): n is a, c, g, or t
  misc_feature (802)..(802): n is a, c, g, or t
  misc_feature (816)..(816): n is a, c, g, or t
  misc_feature (827)..(827): n is a, c, g, or t
  misc_feature (876)..(876): n is a, c, g, or t
  misc_feature (909)..(909): n is a, c, g, or t
  misc_feature (921)..(921): n is a, c, g, or t
  misc_feature (970)..(970): n is a, c, g, or t
canctggaatgctccacaagagccagccccacccttagaaaaaatgttttccatgaggaacgtctgcntgntccnaantgtggtgggcanancaaggactgcanaaantggtgaangtgantttctagctgaaggangangcgtgcgtggcccaanggttgtggaaananancaatctgcctgcaaaaaancaaaaaggcccttctgctctgangaaaacaggaaaaaaaaaagcncttctggctgcaggaagaaaaggttgantgaagaagtcaaanaaaaattaanaaaaaaaaaaaaaaagcanaaaaaaananaaatagaaaaanaaaaaaaaaaaaaagaatcacaatcgttgaccacaaaaaaaaaggaaaaattaaaangcgaatnatcctcanccaaaaaccganaaaaaannaaaaannnaatgtnaaaggancanaaaancaaaaatnaaatccanaancgcaaagacaaaaaaaaaaaaaaanaaaaccagcttcagcaaaaaaangtaaaagcacaataggatgaaatgaaacgactggaggaggacaatgaaattaaganccgaacatgacagaaggtcatgcagtagggctttagctcgtgaagtagatctgaaggactatgaagatcagcagaagcaacttgaacaggtcattgccaaagacttacttccctctagagataggcaacacttaccactgataaaaatgaaancanttccanacttggttcccgggaantttnagagccagcttcagaaggtnccccngagtggaaggcattaacaganatgccgcagatganaatggagttanagagacctggtggaaatgagattactcgaggaggctccactcttatggnaccggatcagagacggaaagcccaggaacctancagtgctggaantggaactctggagctctggactggaagtctggaaacgaaacctgggagnctgggactgaggac

SEQ ID NO: 653878 - DNA, 337 bp, Homo sapiens
  misc_feature (30)..(30): n is a, c, g, or t
  misc_feature (38)..(38): n is a, c, g, or t
  misc_feature (185)..(185): n is a, c, g, or t
agggaaactggcacagagatccctgtgtgnaaccacgncaagagagtctgccagttagaatactggggcttgtgccaggagagaagaattcagaaagtccaaaggctggaatgtaggtgaaagagactatgggactctgcccttccatgtccatccagaaagtgcccctgcacacctgtcctgtncctaggtcctgtagggatgtgatataacaagccatggagctgtaccttagtgtctgtgttcccagaactttgttggctcccgaagcacctttccctcctcccaagaggaataagccaaatgtaaataaatggtgcccaggcatttggctcac

SEQ ID NO: 653879 - DNA, 265 bp, Homo sapiens
  misc_feature (14)..(14): n is a, c, g, or t
  misc_feature (92)..(92): n is a, c, g, or t
ggggccttaccccncccctgggggtaagggggttttggcaaatgggggggtttggcccccaaaacccccctgggcccgtttccctggggggngggggcccccaaggaaattacccaaaaggggaggccccggaggaagggttttttggggcttttgggggggaaaaaaggaaaagggtttccaaaaactccccggcaaaacccccctggggaaatttttttggggggaaaaggaggaaattttaaaaaaaaaacaacaaagttca

SEQ ID NO: 653880 - DNA, 980 bp, Homo sapiens
  misc_feature (286)..(286): n is a, c, g, or t
atatatcgttcgtctctttctttcgtgcttgtctgcgcaatttgatctatctgctactgttcatacgatagagtatacttattacatgagtctaaaaagaaactcgcttgcttcgtttatactaatctccaccttgtacctctagttgcatggaactgcacaccttcggtagtccggaaatctttttcccccaacactcgctctctggaagccatctttgttccgggtgacgcacaattattgtttcttattattcatctcatccttgtcgtcgcggcagataatntgccctgtaacacacaaaattctcagttcactgggttcccccacaaaccgtttgtgtcgctcgtcaatgaactcgattccgtgatttttagccacgacctcaagccagatatttgtttagtataggccccacactacatgggcggccgaatccctcgcccaaattcgtcaaatattgcagagcgggtagcagatgtaattctgaataaaaaagagatgtgggtctcacgaacaccttctcatcacaggcaccctctccaccagagtgcaataccactactactgcggcatctggcgggtgaatagtgtccccgaggctcttccgcctctctatgttgtgcgcgagcacaagatgtgctcgctcccggtcctgtacatcaggcctgcgactgcaggtggcggcgatgctcgggctcgcctccctagtgtggtgcctgcccaggttccgtgctgagttctgcgcttgcggccagaactcttgtgttgactgggatacacacggcgcttatcggccccagcctgggctaaatatgtctgctgtacatttcagtagagaataggggttttctccatccgatcggaccagtacttggtctcccacgctggagtgatcatacaagtggtcgggctcacggtggtcctccccttgtcccccccctgcgggccggagcccaacacccctcccccacatagac

SEQ ID NO: 653881 - DNA, 358 bp, Homo sapiens
cagtggggatggaaatggacgcagaaggggtttggggggtgatattaaagatgacaaccgcaaacgtaaagggcctatgaactcctaggtcatgccagaacgcagctctttgtttagtcggccaggcagattaagttgggtcttatatgaaaagcctctcggggtctggccctagtagccctggctcgaacgaaagaagtctgtattgaagttctctttctgccacttcctagagctttctgatctctgacaatgtactcaaccttgccgaacttaagtcttctcacctgtaaaatgggaataagaatgatacacacttcaaaggaatgttgagaggataatatgagatgacgtacat

SEQ ID NO: 653882 - DNA, 117 bp, Homo sapiens
ttctgtatgaggttcgtcctactactcaacttaaactccagcaccactgaccctactactatctcgcacctgaaacaatgctaacatgactaacacccttaattccatccaccctcc

SEQ ID NO: 653883 - DNA, 950 bp, Homo sapiens
acggggaaaaaaaagcacgcctgggcaaggaacaccaagtccacagggtaagggcggaaaaacaggctagccccccgcccgcagcccgattgtcagggataaaccacaaagcggccggtacatacgacgggaaaaacatgcatcgttgtggaaagtcaagaaaagaaaaagtgttcgcaaggaggggcccctcagacccagagcgcagtggggtaaacgcctccattgtataaaggaagctctagtgggcttatggtcgcgaactgcgcacggaaagtgctcgcgcgctgtagaagcgcctagtgtccaagaagaagtatgcttaactcgtgggagtacaattccattgggtggaacaaaacagctggttatttcctacaataggaacccttcctcgaggttattagcagcaccagatataactagtgacaagcatagtttgtatctgggccaacacaaataagcagagccgctccttttcgtttatgcggccatttctaaaaaagcagtatctcgcctttaggaacgacactctctcaactggcgtcccaccagataacttggcgcccttagttaccacaaagttccggaccacaagggggagtattttattgaaccaaattattgagaagaatacaaggaaaaatccttagatgtgtcttacgcataaaaacgccttccacttcaggggagatcccccaacaacatagttggcgctgtacatagaagaatagaataattttaccactttagatggtcaagaagaaggcgcccctactaaagtctcttggggccgaccactgcaccgagggcgggggcgctaacacactcaaactcatgttacagaagcagccgggctcagaggaagaacactcttgccgcgccatagcgtaggctacggccccccccgggaaaaaatggaaacaaataggctgggcaaaaaaaacaaa

SEQ ID NO: 653884 - DNA, 2709 bp, Homo sapiens
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagcccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653885 - DNA, 2046 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagaggtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653886 - DNA, 2055 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtggtaagggaggtccagacgggctccatgatttggataacaactaattagaacctgagcctcctgacctccaatacggtgcactctgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653887 - DNA, 325 bp, Homo sapiens
tggttccccttcctccttgttgtttctctccctcgtggcatgtgctgcgtttcttcctgggccgcgtcggcctcagcagttttggggtcattgcttcccgcagcggtgcgggggcctctttctcctgctcgtgcgcattcgtggtttcagccttggcctttgctgcgccctccgtcttcttcggtccgctttcgtggcctcctcttttgcagccgccgcgtccttctcgccttccttctcttcgccttcccttggcgtccttgtcgggcttctcctttgttctccttggcctcggcggtctgcggcccaagcttattccctttag

SEQ ID NO: 653888 - DNA, 1913 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagaggtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653889 - DNA, 330 bp, Homo sapiens
atacgtgttgcacatctggtccagttatcatgtgtgggtatgcaggaggagggggtaatctagaagccccacatctagtgggcttctatggaccccagatatgtccccttagggcagctcacatgcaaagcaaagcagatgagtcagcctggcttgggttgagggctcagtgcctcttagccttgcctggggttcttgacccttccggaaactgagccacatcagctcacgttactagcataaggtggtgatacaaacaatgctgaaatccattaagagcacgaaaggaaccagggatcccaggcccaggtagcacagaaacccaggcga

SEQ ID NO: 653890 - DNA, 872 bp, Homo sapiens
cgcagtggtcacacctgtaatcccagcactttgggaggcccaggcaggcagattacttgaagccaggagtcgagaccagccttgcaaatgggaaatgtgtctctaccaaaaatacaaaaattagcggggtgttatgacacacgcctgtaatcacagctactcgggaggctgagacacaagaaccccctggccgagtgcagtgctcatgcctataatccccagcacttgtgggacgacaaaggcagggtggatcatcaaggtcggaagtttgagaccagcctggccaaaatggggaaaacccatctcgtgaaaaaacacaaaaattagccagcgccatggtggttgcattgccttgtaatccccagttactgtgggcagacctgacggcaggagagtcgcttgaagccttgagaggcacaaggtgtgcaggtgaggccaaagaatccaacaaggtgactccagcctgggcgaccacaggagttaagactcttgtcttaacaaaaagacaaaacaaagacgtcactgtgaaccctgggcagacggaggttgggcaggtgagcccaaggaatcaattgcaccgcatccaagctggatgacaggagtgagaactcggtctcaacaaaacacaaaacagaccaaaaaaacacttggggcgccccagagaaagcttacaacccaacttggtgcgccgcgcggcccgatgaaaggtaacgagcctagcaggctcacgacacgcgccgagcagggggatcaccaaaaaacggcgaccggggctgcaacccagggcggggcacggggccaaagggcggccaataccccgcgcggccaacacggcgcacccacagacccaccacagaacgacacaaccaaac

SEQ ID NO: 653891 - DNA, 3040 bp, Homo sapiens
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagaggtagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtggtaagggaggtccagacgggctccatgatttggataacaactaattagaacctgagcctcctgacctccaatacggtgcactctgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653892 - DNA, 1076 bp, Homo sapiens
ccagcactgagagcctaagctcctcgacctgcagatgcaaacaggcagccttagctaagcgggacaccctgaagctgcccagaagactgaggctgtggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653893 - DNA, 426 bp, Homo sapiens
  misc_feature (127)..(128): n is a, c, g, or t
  misc_feature (145)..(146): n is a, c, g, or t
  misc_feature (159)..(159): n is a, c, g, or t
  misc_feature (164)..(165): n is a, c, g, or t
  misc_feature (286)..(287): n is a, c, g, or t
tggatttccctctcttggagagtaacccctgtctgtccagcctcctcccaacgaggaaccagaggaagcatatgtttgagagtgctttgtcaaactatcccaaagggttcagaatatgacgtcttcnnttcaaatgactaatctnntctgggtggttcntggcnnctctcatgtacttttcctgatgcagctttgtgttggagcccctgtacttggacgagctcacacaccttttttccaaatgccaaacccttctgccatgcctttcctgccccacaactggtanngtggtgaccctccaaggagggtggcaggcaggcagtgtgctaaaggccctgggacttgattcccaatccattttccatgtggctttgctctccttactgttctctaggcctctgtttccccatttataagtcaaggagg

SEQ ID NO: 653894 - DNA, 1654 bp, Homo sapiens
  misc_feature (246)..(246): n is a, c, g, or t
  misc_feature (260)..(260): n is a, c, g, or t
  misc_feature (285)..(285): n is a, c, g, or t
  misc_feature (290)..(290): n is a, c, g, or t
  misc_feature (293)..(293): n is a, c, g, or t
  misc_feature (437)..(437): n is a, c, g, or t
  misc_feature (770)..(770): n is a, c, g, or t
atcgcctctgaagaatacacccccagaaagaagtgactgcatggggttgggtgggaattccagggccctctgagcccggcttccccttgctgccagcaaggcagaccctctcccacagaagatgacagagaggaatcaagtgaaaagggaaaatgacccgggatgacagggaagctctaggctgagaagagcattcggcagggcatgtcagacattctggagtctgctgtggagaagatcaaagcngcccctggaagttnaactgtggaaaaatgggattctaangaagnggncagcccatgcaatttagtgagccaggatgccaacttaggtcagtgaaaagagaaatactttgatatttaggagttaaggttgaagagcctgttcccttaatagtgttctaggttgagagtgtgtgtgtgtgtgtttccaaagcngatttagaagaaaatcatatatatacccatggtgaactattaaaaagcaagcagttggggagatactgttgtacgtgaatactgacatcaagtaggatgatcatacttacccaaactgtttcccctctgcagcagatagtgcattcatgattaggtgaaccagggtgtcaccagagtgatactttgtacagggaacattgcaggacattgcagggtgagagtgtgaaaggaggtgagataatggaagtaaagcacagaattgggtgacaggagagttgagtggtcaggatgggatgggtgtggtactcatggtgtaggtgaggactgagcctnaaggaaacgagcaggccatgacagggagaactgctggggcacacgggccaggaagcggacagaggagcatgcctgccgggtcagctcagttcatctctccgtggaaggtggctatccttttgctcttctctccctaccacccacttccttctctagcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653895 - DNA, 1718 bp, Homo sapiens
  misc_feature (310)..(310): n is a, c, g, or t
  misc_feature (324)..(324): n is a, c, g, or t
  misc_feature (349)..(349): n is a, c, g, or t
  misc_feature (354)..(354): n is a, c, g, or t
  misc_feature (357)..(357): n is a, c, g, or t
  misc_feature (501)..(501): n is a, c, g, or t
  misc_feature (834)..(834): n is a, c, g, or t
ggctgggggatgtttctgtccccaatctcattgcctgagaaatttgaggcacagaaggcaaggggtccaatccctacagtcaaccagagcacttggcacagcaggtaccaaggctggggagggccacagacactgggatggtgaggtgagggtagacagacaggggagaatgccgcccacagaagatgacagagaggaatcaagtgaaaagggaaaatgacccgggatgacagggaagctctaggctgagaagagcattcggcagggcatgtcagacattctggagtctgctgtggagaagatcaaagcngcccctggaagttnaactgtggaaaaatgggattctaangaagnggncagcccatgcaatttagtgagccaggatgccaacttaggtcagtgaaaagagaaatactttgatatttaggagttaaggttgaagagcctgttcccttaatagtgttctaggttgagagtgtgtgtgtgtgtgtttccaaagcngatttagaagaaaatcatatatatacccatggtgaactattaaaaagcaagcagttggggagatactgttgtacgtgaatactgacatcaagtaggatgatcatacttacccaaactgtttcccctctgcagcagatagtgcattcatgattaggtgaaccagggtgtcaccagagtgatactttgtacagggaacattgcaggacattgcagggtgagagtgtgaaaggaggtgagataatggaagtaaagcacagaattgggtgacaggagagttgagtggtcaggatgggatgggtgtggtactcatggtgtaggtgaggactgagcctnaaggaaacgagcaggccatgacagggagaactgctggggcacacgggccaggaagcggacagaggagcatgcctgccgggtcagctcagttcatctctccgtggaaggtggctatccttttgctcttctctccctaccacccacttccttctctagcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653896 - DNA, 633 bp, Homo sapiens
  misc_feature (590)..(590): n is a, c, g, or t
gggacctgtgaattcagcattccgggccttcagaaagggaaaaattaaaggcaaaaagaattttttttttccccatttttttgaaactttcccccctaaaattccaaaattggccccctttttaaaaaaagggcccttaacccccaaaaaaaaatttttttttggccccccccgggggggaaaaaacaaaaaaaaaccagcgggggaaaaacaccacccccctcttttttagaggaggggggggttgaaaaaaataaaaaaaaaaaaatttttcccccctcttggggggaggggttcccccacaaaaaaaaaaaaaggggggggtgttttttttgggaggggcttaaaaaaccccccccaaaaattttttttttttataaaaaaaaaaaaaaaatggggggggggggggcgagacaacaaaaaactaggagggggggggtgttttttttttgttttttttggtttggggccgcccccccccctttttctttattattaaaaaaaaagattttttttttttttttttttccgaaaaaaaaagagcgccccatattttttttttttttttttaaagaaaaaaaaaaaagggncaccccgaaaaaaaaaaattttttttttttttccccccccctt

SEQ ID NO: 653897 - DNA, 2140 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggcaaaaaaaacacaaaactgacagcacaaacaccagcacagaccaccacccggcaccacacaccaccacgacccaccaagacactcaagacagaccgaaacacgcaacgacacagacaacagttacagtcgagaaacaaacacagagagcacaacaacaaacgagagcataga

SEQ ID NO: 653898 - DNA, 830 bp, Homo sapiens
  misc_feature (18)..(18): n is a, c, g, or t
  misc_feature (99)..(99): n is a, c, g, or t
  misc_feature (147)..(147): n is a, c, g, or t
  misc_feature (155)..(155): n is a, c, g, or t
  misc_feature (268)..(268): n is a, c, g, or t
  misc_feature (354)..(354): n is a, c, g, or t
ttgggggttcccctgggnaaggaagattctggtccctggcctttaaaccccaccagggtaagcattcaatgaactgccctgcaagggaaaaatatccanttgaagaccagcagaggactattattcccagccccagaaactttccantgtgcaanttggccaaaggagacaccaaatcagaatggcttgttcagcagtaccatgctgtaggaggtacatttcccaggtcctgtaggcacaaacccctacttagcctgccttcccacantgccagtgtaatccatttgggacattcagcgctccaaacatttactagagctgaggcaaacctgggcttatggcgccacctagagntgaaaaggaggtagcgacctagcagtgaagatttgttgagcaaatatatgcaataaaaaccaaaacaagctggacagagaaaactggaataaataactaattcttccagtgcaaagacataggaaagacccacaagaaacaacagcaaacagggaatcatgaccttctcaaaaggacaaagcaaaaatcctggccgggcactgtggctcaagcctgtaatcccagcactttaggaggctgaggtgggcagactacctgaggtcaggagttcaagagcagcctggccagcctggcgaaaccctgtctctactgaaaatacaaaaaaaattagccaggcatggtggtgcatgcctataatcccagctacttgggaggctgaggcaggagaatcgcttgaacctgggaggcggagagtgcagtgagccgagatctccccactgcactctccagcctgggtaacagtgagacttccatca

SEQ ID NO: 653899 - DNA, 1936 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653900 - DNA, 518 bp, Homo sapiens
ggcatccacacattgctggtgcatgggctggttatttcagcattgggtccaaagaagcggtgactggaaactgctggctgtctgggccgcacactagcaaggactctgagcagtgggcaggaggactccatgtggaacatgtgtgagcgcctagctgtatcagtgagagatggccttcttgcctggcatgagctctgctcacactcatggtaggtcttgtctgctggctcagcagtgaaatacgccagtggaacagagaaggcaaaattagggagctgggacaggtaccgatgagcctcccactcctggaagaggcggatcaggtactcgtagttccgggcccgcaagtccaggtgatcgatgagcagcagcatgcagagggggtcctcatccggctcgagactcaggttgagcttgaagtactccagtgccgtgcgctggcggcctcgctttctccaggaagctcatctgcttgtagagggcaggtagaagctctgtcctcgggtctgcggtcatcc

SEQ ID NO: 653901 - DNA, 1643 bp, Homo sapiens
  misc_feature (952)..(952): n is a, c, g, or t
  misc_feature (955)..(955): n is a, c, g, or t
  misc_feature (1343)..(1343): n is a, c, g, or t
  misc_feature (1643)..(1643): n is a, c, g, or t
taaggtttgagggggaatgctgggaaatggtaatggggtatggagacaatttcatataagtaatggctagggtgaggtggtaggaagttttttctcataggagggtgtattgagttgggctcgatagcggaactcgggggtagtgcgtggttcgaatttcataagaaacgaggggaggttagaaagttagggctctggggtgacaaacatagtggtgtggtggtagaagtgtctcagggggagagaggtggctgctcaatatgtgtgtgtggtctccatagagaagaattgggtaggtgggtggacggggtggttatattatatataatataagtggtgtgggtggtattcgcgggctatgtgaagaacaatagggcgcgagaaggtgggccttgtgcggagcggatattctccagaatgtgttagaaacgcccttggagagacatatggtctcgcgagactctcccccttatcaggcgaaatgtgctccacgaatgtggggtgtcctcgcggatggggagctccctcttgtggcatagcgtgtgtgggacgacaataaaatctccaatacttatagtgtgcgcccagaggtgtctcccagtgagagtgggccacgagcgagatgataaactccacgagagcggtgtgtcccctgggtgtgtggcgcgaacatacaagggggggcgacgccagggtgtatacacggcgtgaaagcgcccaccttttatatctagcctcacacgctggtgcgaacataagcgtaacacagtgtacgtggggccatagggggggtgacacactcccacatatgtgacagaccactgtgggtgaagagaggggaccataacgtgggctctccgccagtgtgggggcccgaaaatcaaggggggcggtaacgttcttgacgagcgttttcttgaggagtagtggtgtccccaacacccccttgtgnagntcccaacgaagggagcattctgacgacgtcgtcacaaacccccggcgtcatcaacaggggcataaagaaggggtgggggcgattacaaaacaaaatcacaacttttatcggggaaggggggcccaatggggttcgtcagccggttgttgtagcacccccacaggggcggcggtctgcggcgcaccacaagggggaggcggaaacgacaggcgcgacgggttccacccaacacacagcctcccacacacacacacaagaccgccgccacacatcgggcggctgcgacgaaacaagcccccccaaccaaggaggaccccgaccgagcgcgcaccgagcgtcgaagcttatccgggtaaccaacacagcgcgccatgcagacgacctggangcgcgacacaactcgacttgcacggcgggagggagaccaacagagccggagcggccacccatactggcgggtagtaaaacacgacacgtctgcaaatcagtcgccggcggtacaacggcagacaacagcgggagtggactcagccgacagacaccccccccgcgagaccgtacggccgaccacaacgacaagcgtcgtgggccccctagcgaggccgcgaccaacactctcgcgcgcaccacaggcagctgttaaacaccccccccaacaacataactcgcaccaaaaccaccacacagn

SEQ ID NO: 653902 - DNA, 411 bp, Homo sapiens
agctcctggtctgcggcaccaggagagcaagctgatcatcctggcaatggtgtggccatggcctcgtgcagatcatgcgtaactacatgttatgaaaatgctgctctggaccacagtctgtgtgctcataggtgctatcctgtgtgtcccacgcaataatgcctgccatttgtggaggcttggtgggatgcatgtgcctggtgtaaagcaccgtgaccagacaacagccccctgcttgatgcagaactgcacttgtggacccttgcgcaaccatctcagatgtggccaccaagcaggagggcctggagagtgtgctgaaggattctggtgaatcagctgagtgtggatgagcgtccacgaattcaactgtgccacgggcaaactctccaagctgacatgcagacacagctt

SEQ ID NO: 653903 - DNA, 631 bp, Homo sapiens
  misc_feature (564)..(564): n is a, c, g, or t
cctcacattgccttaaaattgctcttgttgaacatcgatgcaaaaatcctcaataaaatactagcaaaccgaatccagcagcacatcaaaaagcttatccaccacgatcaagtcggcttcaaccctgggatgcaaggctggttcaacataagcaaatcaataaatgtaatccatcacataagcagaaccaatgacaaaaaccacatgattatctcaatagatacagaaaagaactttgacaaaattcaacagcccttcacgctaaaaactctcaataaactaggtattgacggaacgtatctcaaaataataagagctgtttatgacaaacccacagccagtatcatactgaatgggcaaaaactggaaacattcccgttgaaaactggcaagacagggatgccctctctcaccactcctattcaacatagtgacgaaagttctggccagggcaatcaggcaagagaaataaataaagggtattcaagtaggaaaagaggaagtcaaattgtccctgtttgcagatgacatgatgtatatttagaaaaccccattgtctcagcnccaaatctccttaagctgataagcaacttcagcaagtctcaggatacaaatgaatggtgaaatcaca

SEQ ID NO: 653904 - DNA, 433 bp, Homo sapiens
aattaatagatctgcctatatgcggtcagttaaataggtatcatgagcagccactcctaagttcccagtcgtctttcagtgggcaccgttcgtcttatcaagtcagcaatcatttggctgtgacccttacccaaggctaagccaagtcccagctgtcagaccccgtaaagacatgatccttgcctttcaggagcccacaatgtgagctggctggtgaaatttggacacgaacacatggctgacaatgtaatgagcaactacgaagctacacatgaaagcatctccctatttgacaagtcagaagttattcgacgtgatatttaatccagtgcctcatgagtcatatatacttcataccacatagcgatcaaggtacggagagtagtactactcatcacccgcatgctgacgtgggtctgtaaggaccctcggg

SEQ ID NO: 653905 - DNA, 272 bp, Homo sapiens
ggagcttctgggagccccctttcagccttacctgggcccctcctctagagaagagctcaactctctcaccaacctctccatggaaagggaattattatgtatggcgctgaggctatgaggccctacctcatgcctaacaaagggttcaaggctgggtctagagaggatgcttaaggaagggaggtatgagtccgtaggtcaaaagccccatcctcggactgttgtccctaggagcttaagaaatttgataccattaaatggtaaagtcttga

SEQ ID NO: 653906 - DNA, 169 bp, Homo sapiens
ttccccgtctctctctgctgcggagtgggtcctgaagtgacggctgccagcttggggaattagagggctcagacagtctgctgtggatcgtgtgggggcagtggacgccctgacatctgcaggccggttcttctcaatcacctctcgcagccctttggccaagtggaga

SEQ ID NO: 653907 - DNA, 588 bp, Homo sapiens
  misc_feature (154)..(154): n is a, c, g, or t
ccaagttatcccggaacgctttgccctgccccggagaaagcgccctttttctttttcatttatgaggtggagccctcgcgcaccaagccttttccccgtaagaagcttggggaccggaaggcgcaaagaccaatgctggagtttttaacccagntggatggcttccagcccaacccccaagttaaggtaattgcacccccaaacagggtggacttcttggacccccccctcctccgttggggcccccttgcccgcaaaataaagttcccgatgcccaatgaggaggcccgggccaaattcatgcagttcccctcccgaaaaatgaatgtcagtcctgacgttaattaagaggggggggccccctgcccaaataatttcaatggggcccagtccaaggctgtgtgtttggaggcgggcattttccccctgcgcaggggtcccccggggttccccccccagggataacatggaaggcttcttggaggtgcaggccaaaaaaaaaccccccctccaatattacccctagggcccccaggcccccccccttttcccggttgaagggcccaataaaaaatggtttagggtcca

SEQ ID NO: 653908 - DNA, 343 bp, Homo sapiens
  misc_feature (53)..(53): n is a, c, g, or t
  misc_feature (101)..(101): n is a, c, g, or t
taagacttttccttttggtcatggtgggagggctggttgctgaaaacaaatanccagagcccattgtggaggtcagctgacaaggccgcatgaccttggcnaatggactacctggtcatctgggactgcttaggactgtgcaatggaacttgggggcaaaactgatggagacagccaatggcctttaaacccagcagccaaaaacatattaattttttagtgggcgaaccccagggcttatcaaagtgtggttcttggaccacgtgcatcagtatcagctgtaagtatttggcaaaatgcagattcccgggccctgcaccaacagattgactttgaatctctg

SEQ ID NO: 653909 - DNA, 246 bp, Homo sapiens
ggcagagggtcagacacttccattagcttgtggtcatcttcactctcacatggtacacacattctttcttctgctcctgggggacgacttcatttgaagaattatctttatttttaccttctagagatttttcacctaaatactcagtcctacttatttcattgtctgttgtggcggatatattcctttcctcttcagtatcattttaactgaccttaacccctactctgaacttcctggagagac

SEQ ID NO: 653910 - DNA, 490 bp, Homo sapiens
ctgtacacatcagacatcatcaagcaagctctcatgttttatccatttacaagatgaacctcagagaggggaagtcacttgtcagtgtgactcaaggcaaatctgaggctaagtccagaagtttcctacctccctccagccacttccctgattgcctggaactaatccagagtttccttgggttaatttctgattctgctcttctcaaggtatctgaggctgggtcttaggacatgaaaccaagccccagccatcagacagactgggtatcaacaggtttctctctgactgcctgggacctgccctgcatttgtggaggttcacatctgcttggtgcactgggctgggctctcagtagaccagggttcaaatcctgcgtctgcaaactgcttgctatgtggcgttaagcaaaacaaaacaaaacacctcctggtactccttttctgatagaggttttgtaacagggagagagtaaagagatgagaccaca

SEQ ID NO: 653911 - DNA, 415 bp, Homo sapiens
ctcagaggatcaggagccagccctgaagtccagaaattttgactaagcctctgtcattagggtctcccagctcatccataggctaatgccaaactttcacaacagctagtggttctcatgacacctcctcctggtagaaaggaaagaataagtcaaaaggacctgggccacagattctgtcctcttgagtcattgattttgcctccctaaactatatcttaagatagattactctgtgaaagctggatgaccattgccagacaatttaaaaagtatatatatcaatatgaaatggattgatgataatattgcatattatagtttatagcacatggatggtattgcttttatccattttctttattttttgaaaattgaatttgtgattttaaacattaaagataatagaaaaatt

SEQ ID NO: 653912 - DNA, 208 bp, Homo sapiens
  misc_feature (4)..(4): n is a, c, g, or t
  misc_feature (26)..(26): n is a, c, g, or t
  misc_feature (30)..(30): n is a, c, g, or t
  misc_feature (55)..(55): n is a, c, g, or t
  misc_feature (91)..(91): n is a, c, g, or t
  misc_feature (93)..(93): n is a, c, g, or t
  misc_feature (129)..(129): n is a, c, g, or t
  misc_feature (144)..(144): n is a, c, g, or t
  misc_feature (156)..(156): n is a, c, g, or t
  misc_feature (171)..(171): n is a, c, g, or t
tgtnttcacacagtttcatagagagngtgngtgtgtgcgtgcatttgtgatgacntgagagcaatagagagagagcctagtctagagacanangatgctagatgtgcatatgtgttcctatgcaatagntgttttcccagttantcaaagcagctntctatatgtagagancaaattattaagtgttccaatcaataaataaagcact

SEQ ID NO: 653913 - DNA, 390 bp, Homo sapiens
ttccaaataaataaataaccaaccaaccaaccaaataaaccaaaaaaaaaagggaaagggttagggaaaaaaaaaaagaccatttttaatagtttttaaaaaaaaaaaagttgggggtagtggctccccccgtaatcccagccctttgggaggttgaggcaggaggttctttggagcccaggagttcaagccctgcttaggcaacatggcaaaaccctgttttttttaaaaatccaaaaaaagtagctggacgtggtggtgtgcctgtagtcccaccccctcgggaggttaaggcaggaaaattgtttgaacttgggaggtaaaggttccagtgacccaagttcgcccccctttattccagcttgggcaacaaagcaagactccttttca

SEQ ID NO: 653914 - DNA, 384 bp, Homo sapiens
acagcattcccagtggcaaacatctacttgaggcaaaatgtcccccgtgtattgagtgccactatcgccacgacaagtgactggtatctattgtgtggcaccctactttggtgtgtccttggcgaagtgtgggtacacaaatggttgttgcttgtgagcccactggaaagctacactgtgtcctggtagtctgggcatctggggcccattcacttagcacgacggcatctcatcttctccatgtcatagtgagaaaccatccaggaggttctgcacagacaccaactcctggccaggcgtggtggttcaactccagcactttgggaggccaaggtgggtggatcacttgattgcccggagtcatgaccaacctggccaaccaca

SEQ ID NO: 653915 - DNA, 204 bp, Homo sapiens
  misc_feature (21)..(21): n is a, c, g, or t
  misc_feature (53)..(53): n is a, c, g, or t
  misc_feature (63)..(63): n is a, c, g, or t
  misc_feature (178)..(178): n is a, c, g, or t
tttcattatctataaaattangaaagcaactacctcctaggatggttgtgaangttaaattangtaatatatacgaactcctaatacagagcatgacacttagtaaatcagaaatgttagtagcattgttatttaaataaaacaataaaaaaccctgagtaattaactataaaaatcnactgtaaaaaaattagctgacagata

SEQ ID NO: 653916 - DNA, 275 bp, Homo sapiens
  misc_feature (115)..(115): n is a, c, g, or t
  misc_feature (126)..(127): n is a, c, g, or t
  misc_feature (259)..(259): n is a, c, g, or t
  misc_feature (268)..(268): n is a, c, g, or t
gcgagaaggactgcgggcaggaccggcgggctcctggggttcagccgtgccgcctcgttacgatgaccagtgtggttaagacagtgtatagcctgcagcccccctctgcgctganggcctgccacnnctaggacacacaaactcgggccacttctaagagtctcttacctgttaggtccaaagaagtcgatgtttccaaacagcttcattcaggaggtccagagaatgatgttacaaaaatcaccaaacttgagacgangagaattgnggcaaat

SEQ ID NO: 653917 - DNA, 305 bp, Homo sapiens
cgaggaagtaaatgtccccacttgggaatggggaaattgtccccactcggggctgggcaagatggaactgcagagccagcatcactaggaaagctccaggttcacatctcattgtcaggagcccgcttaaaaaaataaattacaaaatggttatttggggaagagacagataaactgctttttccccttcaggtgcagcaggaattgggcagactacagatcagtccgtgcgctggctgccttgggggcgtatttaggcatcagttcatttatcttccggatatagtcagacttttctgcacagc

SEQ ID NO: 653918 - DNA, 936 bp, Homo sapiens
  misc_feature (7)..(7): n is a, c, g, or t
  misc_feature (271)..(271): n is a, c, g, or t
  misc_feature (583)..(583): n is a, c, g, or t
cccccancccgccctccagctcccagcatggttactacggaaaaactttgcctagagaagtcacactccccaaatccaggatgtccccaaagaagatatgcaaaggccccaggaaggagtcccagctctcactgggtggccagagctgtgcaggagagccagatgaggaactggttgtgccttccctatttttgtccggaatgccatcctaggccagaaacagcccaagaggcccaggtcagagtcctcttgcagcaaagatgtggtaagnacaggcttcgatgggctcggtggccggacaaaattcatccagcctactgacacagtcatgatccgcccattgcctgttaagcccaagaccaaggttaagcagagggtgagggtgaagacagtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtgncacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaa

SEQ ID NO: 653919 - DNA, 245 bp, Homo sapiens
tgctcttttgacagagtccagcgagaaactaggtcttcgcatctgtgatagaggaagcctcacaagccgaaacttcttcctatgtggcaagcagctcaaccaccattgtggggttacacattgctgctgcactaagaccgactcaaatacagaaggctccatgacgtgactgggtccgtattccccagacctacctcccgtggcagcaggggacctgacagcgtttcacagacacaaccgggggg

SEQ ID NO: 653920 - DNA, 1174 bp, Homo sapiens
  misc_feature (7)..(7): n is a, c, g, or t
  misc_feature (271)..(271): n is a, c, g, or t
  misc_feature (323)..(323): n is a, c, g, or t
  misc_feature (332)..(332): n is a, c, g, or t
  misc_feature (363)..(363): n is a, c, g, or t
  misc_feature (422)..(422): n is a, c, g, or t
  misc_feature (445)..(445): n is a, c, g, or t
  misc_feature (487)..(487): n is a, c, g, or t
  misc_feature (490)..(490): n is a, c, g, or t
  misc_feature (492)..(492): n is a, c, g, or t
  misc_feature (544)..(544): n is a, c, g, or t
  misc_feature (821)..(821): n is a, c, g, or t
cccccancccgccctccagctcccagcatggttactacggaaaaactttgcctagagaagtcacactccccaaatccaggatgtccccaaagaagatatgcaaaggccccaggaaggagtcccagctctcactgggtggccagagctgtgcaggagagccagatgaggaactggttgtgccttccctatttttgtccggaatgccatcctaggccagaaacagcccaagaggcccaggtcagagtcctcttgcagcaaagatgtggtaagnacaggcttcgatgggctcggtggccggacaaaattcatccagcctactgacntatcctttncctgtgatgttgagctgggctgaactgtggngcccatactatgcctcacctatacccccagcctgccagtgccaacagcctcaggtgtgnagtgctgggcctcattctgtgtntcagcgccgcccacccccggctctgagcctttcttgccctgnatngnagtcctttctcgccctgcatggcagtcctttctccatgcctcttccttaacngctcctccaaactaaaacagtcatgatccgcccattgcctgttaagcccaagaccaaggttaagcagagggtgagggtgaagacagtgccttctctcttccaggccaagctggacaccttcctgtggtcgtgagaacagtgagtctgaccaatggccagacacatgcctgcaacttgtaggtcaaggactgtccaggcaggggttttgtggacagagccccactttcgggaccagcctgaggtgtaagggcagacaaacaggtgagggtgagtgtgncacccagagactgctcttcctgccctcaccctgccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaa

SEQ ID NO: 653921 - DNA, 1081 bp, Homo sapiens
  misc_feature (7)..(7): n is a, c, g, or t
  misc_feature (271)..(271): n is a, c, g, or t
  misc_feature (323)..(323): n is a, c, g, or t
  misc_feature (332)..(332): n is a, c, g, or t
  misc_feature (363)..(363): n is a, c, g, or t
  misc_feature (422)..(422): n is a, c, g, or t
  misc_feature (445)..(445): n is a, c, g, or t
  misc_feature (487)..(487): n is a, c, g, or t
  misc_feature (490)..(490): n is a, c, g, or t
  misc_feature (492)..(492): n is a, c, g, or t
  misc_feature (544)..(544): n is a, c, g, or t
cccccancccgccctccagctcccagcatggttactacggaaaaactttgcctagagaagtcacactccccaaatccaggatgtccccaaagaagatatgcaaaggccccaggaaggagtcccagctctcactgggtggccagagctgtgcaggagagccagatgaggaactggttgtgccttccctatttttgtccggaatgccatcctaggccagaaacagcccaagaggcccaggtcagagtcctcttgcagcaaagatgtggtaagnacaggcttcgatgggctcggtggccggacaaaattcatccagcctactgacntatcctttncctgtgatgttgagctgggctgaactgtggngcccatactatgcctcacctatacccccagcctgccagtgccaacagcctcaggtgtgnagtgctgggcctcattctgtgtntcagcgccgcccacccccggctctgagcctttcttgccctgnatngnagtcctttctcgccctgcatggcagtcctttctccatgcctcttccttaacngctcctccaaactaaaacagtcatgatccgcccattgcctgttaagcccaagaccaaggttaagcagagggtgagggtgaagacagtgccttctctcttccaggccaagctggacaccttcctgtggtcgtgagaacagtgagtctgaccaatggccagacacatgcctgcaacttgtaggtcaaggactgtccaggcaggggttttgtggacagagccccactcctacgactgggagctgacatgaccagcccactgatcctgtcagcaggtcctgctcctgttgccaggctcctgtttatagccatgatcagatgtggtcagactctttctgggcctggagaccacggtcacttgttgactgtctctgtggaccagagtgcttgaggcatctcaggcagcctcagcccaagcttctacctgcctttgacttgcttctaggcatagcctgggccaagcagggtggggaatggaggatagcatgggatgtatggagaggatggaagattttcatgtaaaataaaattaaaaaaaaaa

SEQ ID NO: 653922 - DNA, 151 bp, Homo sapiens
  misc_feature (116)..(116): n is a, c, g, or t
tattctgtgtgcgcgtgtttcatttcagttcagaagatcatttgttatctggagtctctatgctgagcatctcttcacttcagactgagatccgctgtcactctaagatgagcacntttgcctcggagtgttctagcagcggagcatggta

SEQ ID NO: 653923 - DNA, 115 bp, Homo sapiens
accgtcatcgaaaccctatatagtcaatcacactagtacaccattaattgaaataaaactattaataccactgtctatagggtttgatgaccagcgtttgtgacagaggtttgat

SEQ ID NO: 653924 - DNA, 759 bp, Homo sapiens
gctgatgtacgaggacggcccgggtgtgtacttcatcacgggctggggtgttgctatcttgtgcttggtcgtgcctcaaattcctggactcaagcaatcctcctgtctcagccttgagccaccctgcctggcccctaaggcacagttttaaaaataagtaaatagcgaggcgcggtggctcacacctgtaattccagcactttgggaggccgagctgggcagatcacttgaggccagtaattcgagaccagcctggccaacatggcaaaacctcgtccctactaaaaatacaaaaaaattagctaggcatgctggtggcgcaggcttgtagtcccagctactcaggagactgaggcatgagaattgttagaacccagaaagtggagactctgtctcacaaaaaaaattaaaaataaatagctgggtgcggtggctcaagccagtaatcccagcactttgggaggctgaggcgggcagatcacaggtcaggagatcgagaccatcctgggctaacacggtgaaaccctgtctctactaaaaatacaaaaactagctgggtgtggtggcgggcgcctgtggtcccggctgctcaggaggctgaggcacggagacatgacgtgagcctgggaggcggagattgcagggagccgagatcatgccactgcactccagcctgggcaaccagagcaggttcatctcaaaaaaaaccacaacaaacaaaaaaaaatttttttttttttttgggaaaaaaaaaaccgg

SEQ ID NO: 653925 - DNA, 312 bp, Homo sapiens
ctcacctaataaatataataataaataaataaataaataaataataaaaacaaagttgattaagaaaggaagtataggctaggcacagtggctcacacctgtaatccttgcattttggaaggctgaggcaggaggatcactttaggcctggtgtgttcaagaccagcctggtcaacatagtgagacactgtctctaccaaaaaaaggaaggaagggacacatatcaaactgaagagaactcacaagagaagattcatttagaaaaataagtgggatgggggtagagggagaggaaactgccctttctggtgg

SEQ ID NO: 653926 - DNA, 337 bp, Homo sapiens
tatagaggcggctcattaaccaaggcctgtttgttcagattcttttctatgtccctgtgtttcagagataagggcattcctttcatccaggtatagggtagatacttctggtaatgaaggttgttgttgttgttgttgtttttgagatggagtttcgctcttcttgcccaggctggagcagtggcacaatctcagctcaccacaacctctgcctcccgagtagctgagattacaggtgcctgccaccatgcccggctaattttttgtatttttggttgagacagagtttcactatgttggccagactggtctcgagctcctgacctcaggtgatctg

SEQ ID NO: 653927 - DNA, 249 bp, Homo sapiens
gtcgaccagcatctgtgtgtctgtgtgtgtgttcagcatctgtgtgtctgtgtgtgtgttcagcatctgtgtgtctgtgtgtgtgttcagcatctgtgtgtctgtgtgtgtgttcagcatctgtgtgtctgtgtgtgtgttcagcatctgtgagtctgttgttttaacctgtagccatcttgtatttgtgtatatctcggccgcttatgtacagtgtgcgtgtttgacctgtgtgactttacgtcgacg

SEQ ID NO: 653928 - DNA, 489 bp, Homo sapiens
  misc_feature (149)..(149): n is a, c, g, or t
gaacggagccgccttggcctcggggtctccgtacaccaacggtccggtccaaaatgcattgcggtcttcacaagagtcagtgagccaaggatacaatttccagcttccaggatcctaccctcatccaataccagcaaagactttgaatncagtctctggacagtctaactatggtggttctcagggatctgggcagactcttaatagaccacctgtggcctctaatccagtgacaccttcgcttcatagtggtcctgctccccgaatgccattacctgcttctcagaacccagctactacaccaatgccttctagtagctttcttcctgaagccaacctgccaccacctttgaattggcaatataactatccatccacagcctcacaaacaaaccattgtcctcgtgcatcatcccaaccaactgtatctggaaatacaagtttaaccacaaatcatcaatatgtttcttctggatatccttcacttca

SEQ ID NO: 653929 - DNA, 407 bp, Homo sapiens
gtgggagcagatgctctcatcctcatgtcgggctgtgcagtgagccatgatcaccagcattgttgatgatgacagctaggctgtcagactgtcgcaatggacttcatctcccttcttgagaaagacaagaggttgcctgagtacaccgacatgctgggggggtcccaggttaggatgacttcccctgagcttgaaggtatgaaagtgggagaccgggcgtatcaggtcctctgtctgtgaatagcatccgctggggtgtgctgctctggacgtcttccccattcactcggcagcagatctttaagttgtgtggatctgctacactgtccttggtcaccaaggcagggcccagagggcagaaggtgtcgaaggtttttcccagcagccactgtttcccagtgcttcag

SEQ ID NO: 653930 - DNA, 180 bp, Homo sapiens
cctgtgcaatggcttagaagcaggcactccccagcctgctgcagcactcactgtgctcaagcctgcagtgctcatcatggtagctgggagctgtggactgggagtcaccagtgtgtgtggtgtgccaatgccagtgtactcatagactttttgccgcctcccattcatgagcctgtgtca

SEQ ID NO: 653931 - DNA, 3214 bp, Homo sapiens
  misc_feature (2302)..(2302): n is a, c, g, or t
  misc_feature (2305)..(2305): n is a, c, g, or t
  misc_feature (2311)..(2311): n is a, c, g, or t
  misc_feature (2318)..(2318): n is a, c, g, or t
  misc_feature (2344)..(2344): n is a, c, g, or t
  misc_feature (2347)..(2347): n is a, c, g, or t
  misc_feature (2349)..(2349): n is a, c, g, or t
  misc_feature (2353)..(2353): n is a, c, g, or t
  misc_feature (2357)..(2357): n is a, c, g, or t
  misc_feature (2379)..(2379): n is a, c, g, or t
  misc_feature (2382)..(2382): n is a, c, g, or t
  misc_feature (2384)..(2384): n is a, c, g, or t
  misc_feature (2386)..(2386): n is a, c, g, or t
  misc_feature (2388)..(2388): n is a, c, g, or t
  misc_feature (2390)..(2391): n is a, c, g, or t
  misc_feature (2393)..(2393): n is a, c, g, or t
  misc_feature (2401)..(2401): n is a, c, g, or t
  misc_feature (2412)..(2413): n is a, c, g, or t
  misc_feature (2416)..(2416): n is a, c, g, or t
  misc_feature (2422)..(2422): n is a, c, g, or t
  misc_feature (2438)..(2438): n is a, c, g, or t
  misc_feature (2451)..(2451): n is a, c, g, or t
  misc_feature (2460)..(2460): n is a, c, g, or t
  misc_feature (2465)..(2465): n is a, c, g, or t
  misc_feature (2468)..(2468): n is a, c, g, or t
  misc_feature (2471)..(2471): n is a, c, g, or t
  misc_feature (2475)..(2475): n is a, c, g, or t
  misc_feature (2477)..(2477): n is a, c, g, or t
  misc_feature (2488)..(2488): n is a, c, g, or t
  misc_feature (2494)..(2494): n is a, c, g, or t
  misc_feature (2505)..(2505): n is a, c, g, or t
  misc_feature (2507)..(2507): n is a, c, g, or t
  misc_feature (2513)..(2513): n is a, c, g, or t
  misc_feature (2522)..(2522): n is a, c, g, or t
  misc_feature (2531)..(2531): n is a, c, g, or t
  misc_feature (2537)..(2537): n is a, c, g, or t
  misc_feature (2550)..(2550): n is a, c, g, or t
  misc_feature (2556)..(2556): n is a, c, g, or t
  misc_feature (2593)..(2593): n is a, c, g, or t
  misc_feature (2609)..(2609): n is a, c, g, or t
  misc_feature (2612)..(2612): n is a, c, g, or t
  misc_feature (2620)..(2620): n is a, c, g, or t
  misc_feature (2626)..(2626): n is a, c, g, or t
  misc_feature (2630)..(2630): n is a, c, g, or t
  misc_feature (2659)..(2659): n is a, c, g, or t
  misc_feature (2673)..(2673): n is a, c, g, or t
  misc_feature (2730)..(2730): n is a, c, g, or t
  misc_feature (2756)..(2756): n is a, c, g, or t
  misc_feature (2785)..(2785): n is a, c, g, or t
  misc_feature (2787)..(2787): n is a, c, g, or t
  misc_feature (2804)..(2804): n is a, c, g, or t
  misc_feature (2813)..(2813): n is a, c, g, or t
  misc_feature (2830)..(2830): n is a, c, g, or t
  misc_feature (2834)..(2834): n is a, c, g, or t
  misc_feature (2838)..(2838): n is a, c, g, or t
  misc_feature (2847)..(2847): n is a, c, g, or t
  misc_feature (2851)..(2851): n is a, c, g, or t
  misc_feature (2858)..(2858): n is a, c, g, or t
  misc_feature (2865)..(2865): n is a, c, g, or t
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccaggtaacctgatggctgagacagaaagggcaggggcgtcctgggatgtggccctccctcgaggccctctgctccctctttgctgcccgtagcactgggagtcaggcccagtctgctccaaccccggcctgggatgaggacactgcacaaattggccccaagagaattttggaaatgcttgccaaaatgatgatgcttgattgcctttgttgtatctttcctcttgtgtcttgttgtgntgngaatcnttcctcncaatcacgggcaaggtatttttgaangtnanccancaanaaaatgtacccagcaacaagcncancntnangnngntttttttntccttgccccnngangcgcangcccttgttggggaangttctttttcaanctttttaangaaancanccnttgnangggaggcacanttgaangtttgcaacangntgacanccccggggnacatacaantcttgntgaggttcttgcngccccngggtccttttcccgcaacttagcaagcaaaccctttngtcaattccaacaagnacngtattccnacaacntggnaggaaaaaaaccccccttgcaaggttgtngaggattattagcnggggttttacacttgtccggccaaggaaagggctttccccttgaaacttgggcaacncaggcgcaaagcaatagcaagaagancaggtagagcatgcactatagcagcttcncnatgtgaaattcatgcangcaaagcancatttgaaaaaccaaanagtnttgnagcccaccntagnaaaaatnacaccanccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653932 - DNA, 531 bp, Homo sapiens
ttctagagtagttttgaatgggttgatttcccccactcccacaaactctgaagccagtgtctagcttactaaagctgctgtaaagtgctctttaagtcttttttttttttaatccccttctaatgaatgaaactaggggaatttcaggggacagagatgggatttgttgtatgataaactgcatgcagtttttagactttctgctttgagaagcacaggtttgcgcatttttaagacgggtggctactcttggtttccctcatcgcaattaccttcgtcataacttcagaaccattgtccttcgcccctacccgccccgctccccattacttcgtgcaatctatacggccttctgctaagctttactgttagatccaacaccccgtcctccctagcccatctaggcggggtccgtactgtggtttttattaggaaccaccctctgtcatctacagtaatccctccaatctccatctgcggcatacccgtctcatcattgttgtattagtgtggagaaatagcatagcaaat

SEQ ID NO: 653933 - DNA, 1824 bp, Homo sapiens
  misc_feature (246)..(246): n is a, c, g, or t
  misc_feature (260)..(260): n is a, c, g, or t
  misc_feature (285)..(285): n is a, c, g, or t
  misc_feature (290)..(290): n is a, c, g, or t
  misc_feature (293)..(293): n is a, c, g, or t
  misc_feature (437)..(437): n is a, c, g, or t
  misc_feature (770)..(770): n is a, c, g, or t
atcgcctctgaagaatacacccccagaaagaagtgactgcatggggttgggtgggaattccagggccctctgagcccggcttccccttgctgccagcaaggcagaccctctcccacagaagatgacagagaggaatcaagtgaaaagggaaaatgacccgggatgacagggaagctctaggctgagaagagcattcggcagggcatgtcagacattctggagtctgctgtggagaagatcaaagcngcccctggaagttnaactgtggaaaaatgggattctaangaagnggncagcccatgcaatttagtgagccaggatgccaacttaggtcagtgaaaagagaaatactttgatatttaggagttaaggttgaagagcctgttcccttaatagtgttctaggttgagagtgtgtgtgtgtgtgtttccaaagcngatttagaagaaaatcatatatatacccatggtgaactattaaaaagcaagcagttggggagatactgttgtacgtgaatactgacatcaagtaggatgatcatacttacccaaactgtttcccctctgcagcagatagtgcattcatgattaggtgaaccagggtgtcaccagagtgatactttgtacagggaacattgcaggacattgcagggtgagagtgtgaaaggaggtgagataatggaagtaaagcacagaattgggtgacaggagagttgagtggtcaggatgggatgggtgtggtactcatggtgtaggtgaggactgagcctnaaggaaacgagcaggccatgacagggagaactgctggggcacacgggccaggaagcggacagaggagcatgcctgccgggtcagctcagttcatctctccgtggaaggtggctatccttttgctcttctctccctaccacccacttccttctctagcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggcaaaaaaaacacaaaactgacagcacaaacaccagcacagaccaccacccggcaccacacaccaccacgacccaccaagacactcaagacagaccgaaacacgcaacgacacagacaacagttacagtcgagaaacaaacacagagagcacaacaacaaacgagagcataga

SEQ ID NO: 653934 - DNA, 731 bp, Homo sapiens
taacaaacccgggttctggggggggtgtgggtataatactaagttgagatgatatcatttacgggggaaggccgcttggtgaagtaggccttatttctctgtgtcctttcgtacagggaggaattggaagtagatagaacccgaccgtggattacctccggctctgaacttcagatcacgtaggactttaactcgttgaacaaacgaacctttaatagcggctgcaccatggggatgtcctgatccaacatcgaggctcgtaaaccctatggtgtgatatggacctctaaaataggattggcgctgtatatccctagggtaactggtcccgtagggtcaagttatgggatcaatggagtaatagtagtccgctttgactggggtgaagtcttagcatgtactggctcggaggttggggttctgccccgaggtcgccccaaccgaaattttaaatgcagtgttgggtagtttaggacctgtgggtttgtaaggtacgtgttggcattaataatttaaagctcccatagggtctaaccacgatactggctgtgtacatgcccgcctactatcacgggcaggtcaaattccactgtgttaacacgtacacgagacagcttgaaccctcgtgggaggccattcatacagggtcctaattagggaccaggtcgatatcgcaccttggcacggtcacggaccgggcgtaacatgtttctggaggcgggcctaaaatg

SEQ ID NO: 653935 - DNA, 1629 bp, Homo sapiens
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggttaggggccgggagaagggcttgggggagggtacccaggcagcagcccctagcctcctctccagggcctgtcctgctgctcttttccaccctcaggtttctcactttaccaggacggcctgtgtgacttgtggcctccgagggtcctgctcccctcctcatggtctcagcgaatagcggcccttagggctggccccttacatgtgtgagtgcccagggctgagggtggctggccacctgagtcctgacctgcctcttctcctgctggcaggtacacttcttcaggctgtgtcctctgtgcaggtaggtaggggatggcagggggtgagagccagagggaagagggaccacagggtgacccagaaacaccctcctttcaaagggagccctgagtaagtttgggaagggtggggtgagttggggagcacagggtagtttgatggaggcaacctctgggtggggaagggagcaatgtctcaggatctagtgtgtctaggttctgaagaatgataaattggactggggctgaggttgccctggggtttgagggaacagggctccctgggtatggctctccagggtaagaggaggagacttcccagttcagcctgactgcttcccccacccctccaggtcattgtgtgttcctgccctctgggcatggagctggggcccgagaaacacacctgccagatccagagctactgtgccaagcatctcaaatgcagccaaaaagtgcgaccagaacaagttcagcgtgaagtgctcctgctacgagggctgggtcctggaacctgacggcgagagcttgcgcagcctggagcccttcaagccgttcatcattttctccaaccggatcacccgtt

SEQ ID NO: 653936 - DNA, 487 bp, Homo sapiens
tgctggggctgccccaaagggcaaacaggtttattgggcacagctgggaaaatcacggtatgccgccaaacgcttccgcaaagctcggtcccattgtggacgcctcataactccgtgatgatgccggcgccaaaaggcagaagctcatgactgtgcgctctcgtcgacagcatgccttcgagatcatacaccctgctcacaggcgaaaaccctctgcaggtcctggtgaacgccatcatacacacagtggtccccgggaggacatccaccacgcattgggcgcgccgggactgtgagacgacaggctgtggatgttgtcccccctgggccgtgtgaaccaggccatctggctgcatgtgcacaggcggctacgtagaggctgccttccggaagcattaagacacattgctgagatgccttggcagatgaacatcaatcgattagctggcaagtggatccatcaaactcatagtgaccttaagagcaa

SEQ ID NO: 653937 - DNA, 849 bp, Homo sapiens
  misc_feature (15)..(15): n is a, c, g, or t
  misc_feature (20)..(21): n is a, c, g, or t
  misc_feature (23)..(23): n is a, c, g, or t
tggctaagtgaggcngtggnntnaagttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtaggtaggggatggcagggggtgagagccagagggaagagggaccacagggtgacccagaaacaccctcctttcaaagggagccccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggca

SEQ ID NO: 653938 - DNA, 314 bp, Homo sapiens
caggtgttgcaggccagtgataatgccatagagtccttggaggggggtcaccaaactaccccggttgcaggagttgttattgtgcaacaaccgcctccagcagcctgaagtgttccagctttttgcttcttgccccagggtggtcctcctcaacctgcagggtaacccgttgtgccaagcggtgggcattttggagcaactggttgaactgttgccttcagttagaagggtcttcacttaaaaggccctgccccctacccttgccctttaatttattgggattgaataaagaatggaaaggccctttcaggtta

SEQ ID NO: 653939 - DNA, 1399 bp, Homo sapiens
agcgggggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatggtagcgctgagcttcaacaccctgtatcatagaaggacggggtttggctccacacctgccactgctattgaaatagtttagtcttgccccagttcactgatgaggaaactgaggccctaacggcaggtggagccgggtccccgacccccgagatcggcagggcgctgaagacgtcccttccaccctccagcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtaggtaggggatggcagggggtgagagccagagggaagagggaccacagggtgacccagaaacaccctcctttcaaagggagccccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgcaggcaaaaaaaacacaaaactgacagcacaaacaccagcacagaccaccacccggcaccacacaccaccacgacccaccaagacactcaagacagaccgaaacacgcaacgacacagacaacagttacagtcgagaaacaaacacagagagcacaacaacaaacgagagcataga

SEQ ID NO: 653940 - DNA, 355 bp, Homo sapiens
  misc_feature (52)..(52): n is a, c, g, or t
  misc_feature (311)..(311): n is a, c, g, or t
  misc_feature (335)..(335): n is a, c, g, or t
cagtggctacgcctgtaatcccagcactttgggaggctaaggcaggcggatnacgaggtcagcagatcgagaccatcctgctcaacatagtgaaaccccatctctactaaagatgcaaaaattggctggacatggtggcgcacacccgtaatcccagctactcgggaggctgaggcacgagagtcgcttgaacccgggaggcagaggtttcagtgagccgagattacgcagctgcactccagcctaggcaacagagccagattctttttttttttttttttaaaaagtcttttaaaaaattcttttattgngctgattttattgtgtcatgaagngtaatatgcatgtaggtatg

SEQ ID NO: 653941 - DNA, 940 bp, Homo sapiens
  misc_feature (682)..(682): n is a, c, g, or t
ttattgtgtcataattgcggctgtataagtacctagaactataattgttgatggtctgaatttgctgttttgtgtgcaataactgcttagaatctgtctttcgggggaacaaaagtggtccacacaacaagatcaaccggttttgtacccgcgccccctcgatcttctgagttgattatacatccctcccccttttcttatagccatgtctcctctccacaagatagcccctctctgtgggcaacttcttgtttgagacacacacaacacaccaccgaggtgggtgcatattgtgcccccactacatacattgctaccctccccatcatgtcatcaccccaaggttgttttcaccctcatgaccctatcatctttctattgtttgtcttctagcgagacctgctagacataaaagataatagttttaacagacagccctccccacatatgtgctcctcctactacagaaaaatatccctctcttgtttaaagatctattcttcacacagatagaagagattctctgctaataccccaccgttgttgtgccagatttcttcaagacaccacccgcgtctccacatcttcttttatatagtgattaatacaccccccctcagtcacaccagcacgatttgacaacacgagataagtcctttttcattctaggagagcctcgcanctcccggatgatgagtctcgtaccacccacaaccaccgtgatggtgtctcttgtgactggtatatatatgcccccacgccgaccactccacccacggccggtggacacgaaccacgaacctccttttctcctcataccaaaaccagaaaaaatccatgcccacttgttgtgtataataccctgtatattcccccatcgtttctagcccgagccagtggggccagaataatccctgatgaaatcttcccccacataaca

SEQ ID NO: 653942 - DNA, 1679 bp, Homo sapiens
ttgccttttcgtcttgatatttcgtcgtctttgctcgtcgtctcgctttggttcgccacgcgtcttgcgtcatccgcagttcgtgtatttttctactctcctttcgtccgggtttgttcgcccgcttcatgttctcttcgcttttcttctcgctgattctgctcctgtgcttcaaccgcttgcgatgttagtgtgactgtgctatatgctggttccgtggggcgtgttgttccatctctgtttgtcctttttctctgctggtgtcatgtcccttttctatgctcctccattgttttggcgttccttgtgtctttcccgtccatttcctatccctgtgcttttacagctccgtgttctgtcgggctgccaggtcttgctcctttcctgttcctgttgtgatgtttggtccttgttcttggttatctgccatgacgtgtgctcgtcaggttcatgtgtcctcgtgtgtcgcaccagttattcgtggtgtggttcccacttattattggtttgctccacttctcttagcagtgtctatcgtgtgtggttgttcggtgtcgttgttcctcgcttgccttggtctggtgttgtgttttccgtgtattcctcgtgcttgctttccctggtgcttctgtcctgtcagtttttctgcggagggtctcctctgctttccttcatgtcccctccgggccataatgtctctgggtcgtgtcttaaatctctctcgtttttctgcctctcatcctgtgccactgctcgtcctcgttccccttgttggtcccctggtgatttgtatgttgtgatctgatgtctctggtttcccccctgctgtgctagttcttggtttttttctagccgcgtgtggtcagtccctgtggatgctttcccttggtatgctctgcatttgtctttggtttttttgtgtttctattgtttgtctcgcctcttgtgctctctcatgtgtgcatccttgtctgttgtactgcgttcttgtgtcccttgtcccttgtccctttgcgtcctctgttgcgtcccaggttatccaatgcatgtccgagtgtctctggtcatgggggcctgttccggtggcttactttccgccaccctgtgtgtgtccccttctgaccctcgtgtcgttgtgcagtttgccgggcccgtcgagttctagctagattggtccccctcgtgccgtttggtgtctgaatgattctgggtactgtatgtgattgagtattccgtatgctgtctggttgcttgtgctatgtgtacccatatctatggaatatccgtatgtatcatgtaatgaatgtattatatatcatatatgttgcacatgagtactctcgcccttccaatgtatctatagtagtgtgtatgtgtagtacctcaggtgtattgtgactaccaatcgtccctatacctccatgtggtacttctgtgtgcatatgggtgctcgtatagtattagtactattagtagtgctacactagtagacagtacctatactgtgctagtccaggcagccaccagtagtgagagtagactattcagacagtaggaaagtctccctgcccctcattccttccatagatgagtataacttgcctgccaccccccgacactgatgccagggaggtgggaggaagaagtgggaaatttcaatactcccagttaacccccaa

SEQ ID NO: 653943 - DNA, 143 bp, Homo sapiens
ttgaactcgtgacttgtgatctgccccctcgtgccccaaagtgctaggattacaggcgtgagccactgtgcctggccaaaagatagtgcttttaaaaagctaacatttattcagtgtcttgttttgagttgagacctgaattt

SEQ ID NO: 653944 - DNA, 192 bp, Homo sapiens
cgttccaggttgtaggtaagccatgagttgtgccagcgataaatcgagcctggtgacaaacacaaatagaaaaaaattaaaaaaggccggggtatggtggctcatgcctgtaaccccggcagttgggaagcactgcaggggggtggctcaccctacggtcgggagtacacgaccagccgggggaacctggga

SEQ ID NO: 653945 - DNA, 165 bp, Homo sapiens
cggaccatacttactgcaaatactaactccggttgatcaatccccaaacagttacattttttttacaaatccttgccctcccattagatatgaacaaactccggtttctcatgaacgtttgttcggttagctcttacaggaaacattggccatggaaggactaaa

SEQ ID NO: 653946 - DNA, 686 bp, Homo sapiens
  misc_feature (191)..(191): n is a, c, g, or t
  misc_feature (434)..(434): n is a, c, g, or t
atgtttgaagtgaggtggccagcgcgatgaatcgccgcaagtggatccagtgcttcaacgatgtgattgccatcatcttcgtggtggtcagcaagcagctaacaagatggtcatccgggaggacaatccagagccaatccgcgctgcaggagcgctctgaatgcctacttcaagagtcatctggaatgaancaaggatgggctgcgcagccaatctctggtgagtcctgtatcctcaatcaagcaatgatctgcgtcgctgagaaagtccttgctgggaaattcgaagattgatggactacctttcccatgaagtttgctcgtcgtacactactcgctgcaggatgcatacatcccgtaggcccggtagtaggacccagcgcgtgacccggtgccagagtacttcattcgagatgagtgatcgtgaggatcagntacctggccatgtggtaggatgggcgtcacgtactgctactgctcattttcacctctgcgtctgtgtgacactgagaactatccgccggtgttgttcaatcgactgccgtgacatcattcagggcatgcgccttcgtcagttacgagctgctctaagaagggaatcccgcaaatttaattaacagccttaacgcacgaatctacttaaaagtgcaccgtaacttgtacaagccagttgaatcacccatcata

SEQ ID NO: 653947 - DNA, 331 bp, Homo sapiens
agagtggtatccaggactttcaccattttttaactgggttatttgttgttgttgaccaataaaggttctttaaatattctgattcttaatcccttatcagatgtgtaatttacaaatattttctcccattctgtgggttgtccttttgcaagatagtgtcttttttcttttttcttttttttttttttccgactttatgggtgtttaatggacatacaataaacggcgcctatggaatgtgtaataagtaagtcctgactattgtttacacccatgcagctgtcacaaccatcagccactagacaaggggaaacacggggtcaccgagctc

SEQ ID NO: 653948 - DNA, 324 bp, Homo sapiens
  misc_feature (165)..(165): n is a, c, g, or t
acagtgcctggggtttcaaaggcactcgcattcgtgttggagctgtcagccccagcacaggacgacatcttgttgatgcggatgacgtgaaggggtggagccgcacccggatatggaagccatctttgccacaactttttaccatgtacttatttggcacaaatncggggcagccttccggggctttcagaaggacaagctggctcaaaatttcaatcttgacaaccaatgtgggccattaaagggggaaaactcaatccaatttttacctttctttccggccccagggtcaaaaaaatgggggggttaccgaggctcgaaatt

SEQ ID NO: 653949 - DNA, 113 bp, Homo sapiens
tggagaccaaataggcactactatttgggaaaaggatttcgaacttttttgtactggaaaaagtgctattttcccataggggtgggggagtgagcagaaggcagaaataataa

SEQ ID NO: 653950 - DNA, 827 bp, Homo sapiens
tatgtggaactagaagtgcacctgttgttaatgatgtggaatctgaaggggtgttctctttcccagctctcctgcctgtctgccatgttttcatgtgcctgggtctgggtgtgtgtcttcccccgtaatggaaatggcctgtgggatgctccagtgtgacccagtgctgcctgtctgcttctgtgtgtgagccgtggtgcttgaccatgccatgtgacatgctgtgtggtaaagccctgaagcaagttcttgctgctgagtgtagtggatgtgccatggctgtcctgggcagtaacttggctctccgtgtggtgaatgtcgtgcttggtgattggcctactgtggagcctggtgttttgtacttgctatttatttttttgttgaagagtgcaaatcattgcgcttttgcaattgaaaatctcgaagggtgacctcatgtccctgtgggacacaattgcccccaaaggacttgaaagagggagattgatattcgagctctccagggttcagtgatatcaaggtatgatgccccagctccttggatgatgattgattgctagactacgtacaacttggaaacccagggggaaatcagcgatggatcccatttcatttacttgaaggtggcctggacattcccctgttccctataagtgcggccgaggaattttccaggcttcactaaccttggcttggggttcttgccgagaaacacttaggttacggccactttccagaggtgggttgttacgggcacaaagcagcttcatctttgattagccccgttttgtgggattggcctaattgaagcatccaggcgcgcccgt

SEQ ID NO: 653951 - DNA, 89 bp, Homo sapiens
  misc_feature (28)..(28): n is a, c, g, or t
  misc_feature (38)..(38): n is a, c, g, or t
acttctagaaagggatccccaaaggctntgacggtacnggcggtgccatggcggacgctcgataggctcgttgtagtgagtgtgcaccc

SEQ ID NO: 653952 - DNA, 194 bp, Homo sapiens
ggatccggttgcagtgagccgagatcgagccattgcactccagcctgggcgacgagaaaaaaacttcgtctcaaataaataaataataatcaccaattagattccctcaaatctgcttgggtatttccagtcctagttaaggcttagggcacatatctcctctctgtactcggggggggggggggggggaattc

SEQ ID NO: 653953 - DNA, 290 bp, Homo sapiens
  misc_feature (30)..(30): n is a, c, g, or t
gtctgaggagaatctggtccaacagcttcnactttagcatactgcttgtgatagggaagcaatggaggagatgctccaccagttgttggctgcaatttagcaagggccacttggcacaaatttaatggctccatacaccctccagaggcgcctttttgtcccagattctattccaaggttcagtctgaagccctaaaagaaaatcagatctgagggatccagaggcagtcaacagtagaaggctagggcacagcccaggtgagcatgactatcccttctgtcgtcttctc

SEQ ID NO: 653954 - DNA, 444 bp, Homo sapiens
tgaaaacagattggccagtggaaactttaatgtgttcttgaacagtcaggaaaaacatgagggaggaaaattaatatcacagcagtaacggcaccctttacattatgtgcagtgattattttttaaagtcttctttcatgtaagtagcaaacagggctttactatcttttcatctcattaattcaattaaaaccattaccttaaaatgggtttctttcgaagtgtggtgtcttttatatttgaattagtaactgtatgaagtcatagataatagtacatgtcaccttaggtagtaggaagaattacaatttctttaaatcatttatctggatttttatgttttattagcattttcaagaagacggattatctagagaataatcatatatatgcatacgtaaaaatggaccacagtgacttatttgtagttgttagttgccctac

SEQ ID NO: 653955 - DNA, 125 bp, Homo sapiens
aaacctgaggtttacctagtgacaccaaattatcggtattttaactgaatttacccatagactaagggtgaaccggatttggtggtggattagggtctatcaaaactgacacaagtacacagtaa

SEQ ID NO: 653956 - DNA, 155 bp, Homo sapiens
gttatttcagtataattcctaacataaaatattttaaaatcaaaggttaaaatcaaggtctgatggtttacttgagggttgcattttagaggatatgttatataaacacacacagagaggttcacattaaaattagagctagagaggcacgatac

SEQ ID NO: 653957 - DNA, 780 bp, Homo sapiens
ctaagcttctaaagcaggtaaattgtcgggggagagagttagcatgtatgaatgtaaggatgagggaagcgaagcaacgaggaacctctcgccatgatcagacatacagctgcctacctaagtgaggacttcaagccccaccacatagcatgcttcctttctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattgtgagtattccatgagctgctcattacaagttctttcctctttctgctctgccatcttcaggatattggttcttcccctcatagtaataagatggctgtggcatttccaaacatccaaaaaaagggaaggattcaaggaggtgaagtcgggtcaaaaactacacctactatatacatctattacattgcttcagaaacgttaaacatattagagtcatatcccattccaacagagggactgttgggaaacaaactctgaacgcagaggagcgaataagaatgggaatgacactaaccgtcacaag

SEQ ID NO: 653958 - DNA, 320 bp, Homo sapiens
ttagagattgtacttggatccagcccaggagcctctgcttgggggtctgctatctatggctcctacatcctcctcctacgatccacatggacatggagatggatgtagtgcaggatcagggtccagatgaggcccaggatcagcttcaggttcccgtccacgatggccttgctgtcgatgagacaccagtttgatgctctcgcggtccaggaactcgagcgccaccgacacgttctcaagctgcattaggcggaaagtgggccgctggtagtgcttgcggagcatcttcttctggctgagcacctccaacaagcgcctgg

SEQ ID NO: 653959 - DNA, 101 bp, Homo sapiens
gtgtgcgttactcggagaagttcttagcctgatgaaataacttgcgggcgttgaagagctgtttaattttaaatgtgtctcagccgtgggtctccatgggt

SEQ ID NO: 653960 - DNA, 920 bp, Homo sapiens
gtctacccatgcgccagtggagcacactagtggcattcgaaataccagtgtgtgaagctgaaatgatggtcacttcattgcctgtcctgggatttggcacctatgcgcctggtaaggtcctaaaagtaaagctctagaggccgtctaattggcaccttagaagccgggtccaccatattgattctgctacatgtttacaatagtgaggagcaggtggtaactgtgcatcctatgcccagattgcgatggcagtgtgaagagagaagacatactctacacttcaaagctttggagcaattcccatcgaccagagttggtccgaccagccttggaaggtcactgaaaaatcttcaattgggactatgttgacctctatcttattcattttccagtgtctgtaaagggccatggagaagtgtaaagatgcaggattggccaagtccatcggggtgtccaacttcaaccacaggctgctggagaatgatcctcaacaagccaggctcaagtaccaagcctgttctgcaacccaggtggaatgtcatccttacttcaaccagagaaaaactgctggatttctgccaagtcaaaagacatgttctggttgcctatagtggcctggaatccccatcgaagaaagaaccatggttggacccgaactcccccggtgctctttgggagggccagtcctttgtgcctgtgaaaaagcacatggaacccaggccttattgccttgctacagctgcacgtggggttttggtccgtggccaagctcaaatgtgcagcgacaagacacagggcggtttggatcccacggtctcaggagaaaaccaatgtcacaaatgagttggccgttttgggccccacattgaaaaagagggcactcgccccccgttaaagctcttaccctcgagaaacaaaaa

SEQ ID NO: 653961 - DNA, 946 bp, Homo sapiens
ctgcgacgccgtccggatgatttggaccacgcacttgggtaatttcctggccaacgggtccagtcaggagttgctgcggggtgttctctgcgcaaatgttggggccacgcgaacgccgccgctgggccagctgggttctctcgtccccggtggttttcctttccctcttccccgcctttatgctcctcgtctctcccgttttggggggcccccccccggtccccttgccaagccgagctttctgtggcgtgtaggagaaaggctttgtcgcccggtgttgggtgtacaacctggtcgacgggggcccccatatttttttggagatcatgtggcggatgcgccccgctgttgttgagaagtggtggctcctgcgcccgccccccatgtgttgttttgatgagccgttttccagagctgcccccccccttgttgggtcggacctttcttcttgtgtgtctgtggataatggtgagcgccgccaccaccttctccgggtggggggtgttcctccacacacccagtggcgcccgaagacgggtcgtgtgggacgctgtgcgccagaggtctctcccaattcttcccccaaagatctcgacaagagcttaacggaatgattatctccctatactccttcgccccccccccactttaactcaccatggtcggagaaaccggtttccacgaacacgtttgttttctcattgcgccgcccttatccagaattttgatgatgaaaacctgtgggttttcatacaccaagccgatctgtgacaccccttctctgagagaagagaagaagttttttgcaacacaccttggtgttttttttttggcgggtggccctttttaattttttattttttaaacacccgggcttttttttgggaccccctggcccccaatttttccccggaatttgggacccccctcaaaaaatttaaagaga

SEQ ID NO: 653962 - DNA, 176 bp, Homo sapiens
  misc_feature (16)..(16): n is a, c, g, or t
  misc_feature (40)..(40): n is a, c, g, or t
  misc_feature (42)..(42): n is a, c, g, or t
  misc_feature (159)..(160): n is a, c, g, or t
actctacttagagttnggggtcgagtctcaaaaaagttanangaatgccttcgtcaaaacccactaacccaaatgcacagaatcaaactgcacgtgtcgatcccagttctggttgactccggtatagtataacgggagccagtgatcgacatggcgttnngaagctagggtaccga

SEQ ID NO: 653963 - DNA, 384 bp, Homo sapiens
  misc_feature (8)..(8): n is a, c, g, or t
  misc_feature (53)..(53): n is a, c, g, or t
  misc_feature (65)..(65): n is a, c, g, or t
  misc_feature (95)..(95): n is a, c, g, or t
  misc_feature (108)..(109): n is a, c, g, or t
  misc_feature (123)..(123): n is a, c, g, or t
  misc_feature (143)..(143): n is a, c, g, or t
  misc_feature (169)..(169): n is a, c, g, or t
  misc_feature (186)..(186): n is a, c, g, or t
  misc_feature (188)..(188): n is a, c, g, or t
  misc_feature (205)..(205): n is a, c, g, or t
  misc_feature (217)..(217): n is a, c, g, or t
  misc_feature (253)..(253): n is a, c, g, or t
  misc_feature (266)..(266): n is a, c, g, or t
  misc_feature (285)..(285): n is a, c, g, or t
  misc_feature (289)..(289): n is a, c, g, or t
  misc_feature (321)..(321): n is a, c, g, or t
tattggcnctttgcaccagagacatatcaatatttattgatgtgatacttatntgttatccaccntgtactagtaagttttagcactgaattccntcttcactgttgnntgtatttatgaaantctgaaaatatggggatcancgtaatgattaaggtattcatcaccnggctgtaagcaatatcntnagtttgtagcctagaantgggaggatacntaacatctggaagacaagttcatttcatcttgagancatggtgaaatantttggatatataaaatccntaanctattgtaaccatgttttattgcaaagatgtnaaatatgccagatgtgtgtgagttggaaatcaaaaaaaggaaaatcaaatatgcaaagaattc

SEQ ID NO: 653964 - DNA, 1359 bp, Homo sapiens
cggcgaatgcgtacgcgccgttcagtgaaatcctccttgtgctcggtggcgcgacagctcgtgtggacccaaggcaagtcagtgatggtagtgagactcattggcattgccttgagacaaggctgatccagagggaccccgacatctatcgctgatcctgcgtaccacgaatcggagcccatcgaatgccaccaacctgttagctgcaggtggtgctcggagatggcgcaccgaacgatcaaccatcaacgactacgaaccgcatatccgggtcatagggaaaaagcgtctgacgataagcagcgggagtgatgctccgacgattcatgccgcctggtctcgatgcgaagatgcagaagcgtctctcgtgtgaacataccgggtgcgcaccgagacagaggccacatggtggtgcgccggtgcgacaggtgggggcaagttgcatacgccacatcgtggtggttgcacacatgcggcgactcctgcaggcagcacaggtgcatggatggttggcgtcggggcgaggcgcgctcctctcgagagggccgatgtgcgcgattgcagatgggcgctcgcgatcacgtggcggcgggcagggttcaggacggagggaaggccacaaagctgtgggtcccccgcgagcacctcacttcgggaaggtaaaagtattcaattgtgaccgcaagaatgatcggagactgggttctttgcggaacggacttgacaccgtggacgccgccggttaatcggacacgttaacagaggggcagccaatttggaacagctgttcaaacacgccttggctttacggggggaacctggttcgggtgagagatagataggtatttgtggcatcacgtgtgaagaaagagctgagggaggcgaaaagatatttggccgtgcgcttgtggacgtgaaccgttacatttggatttgcagcgacttaggagccattatgggatccaacacgaaagaaatagcccagataacaggtggccaaagatatgaagcgacgaggaatagaggggtaaagggtggcacatacttagtggaggatcgccagggccccttggggggccccttggtgggtagggcccgaagttgggaatggggcgaagaaaagcaccgtagccatagagaggcacaccacccaagacaattcggcttagctatggcgacataggaagggtcgaaccagagggtggcagaagcgttcgcgcggacccgcaagtagggagaaagcaaagattcgataggacatccagaaccagacgaggataatctacaccagaagtataaaaccgactcgctgagcaaagccagcctcaagaaccacaacgagccgagaagcgagggaac

SEQ ID NO: 653965 - DNA, 285 bp, Homo sapiens
aaaaagtgagctgactgacggtatggctgtgctactgaaatacctgtcggcactggagttgtccccacaggtcgttctgatagtgaaggtccttatgatttcggaggtgtacttactaatagtaaccgggatattattaaatggagatgccatccacaaacgaagtccgtcgcacaaggacatgtgcggcctccatccctggggatctctatcctttcaccaggaagccactgtacctgattgtggattcgactaatagtgttgcgtataagaatttcacaaact

SEQ ID NO: 653966 - DNA, 124 bp, Homo sapiens
ggattgctgaggtactctacaggatcttatggagaccaggctgagccactgccgactcgctgcacgcaatagccactggagacggtggactgcactacagagatgtttgacttgtccaaacgcc

SEQ ID NO: 653967 - DNA, 132 bp, Homo sapiens
ctttcactttcagttgggcttccagctcttcacatcttctctttaattcactgcttttagaagtcccgtctcctgtctgttccgaacttttgactgtcagctcatatgttggggagaccggatatattgggg

SEQ ID NO: 653968 - DNA, 716 bp, Homo sapiens
taaataagactagacagagcctgctggttgaatcagcctgaggtcacgctggtagtaacaagcttggcatccagtgaggggaagtatatccctctgcctcaaagagtcctgggaaggtccccggaggaggagtctgatgcagcagctctcggggctggtcgtgcctgtgccttagctctttgccacctcgtgtgccctcaccatctggacaacagcagccctggaccaggtatctgaggcccgtggtatcaactggatggcccattccctgcatgtccccaaatggcacagctggcctctgagaggtgccaagactctgtcattcgcccagataataggccttcatggagaaacttcttgttccacctcctcctgcagatgggccggatagtatcccccgagttctcccaagtctgactgcccctgccccaatctcagctatcctgtcacagagcctcccatcggctacggcagtgccaacctacttcagcctccatccctgtgacctcatcagtctcagatcctggagtgggctccattaactccagctatctccaaagatctccctggcccccacatgatgtcaaagaactctctaccacggaacctgggagaactctggagccacagtgagctggctcggataggctgggacagtccctggtcttcagaactgaacatgaacggataccactggcaagaactgcgacaggttg

SEQ ID NO: 653969 - DNA, 165 bp, Homo sapiens
taggccaatctggagcagagctgctaacttcagcgctgttgacatttggggccagaaagttctttgttgtggggtctgtgctgtgcacggtgggatgtgtagcagcatccttgcctctgccattcattccagcccagcctgggtgacagagcgagactatgtctc

SEQ ID NO: 653970 - DNA, 235 bp, Homo sapiens
gatggcagtgtcgtggacttcgtactctaggatccgtagtcaccgacgagaccagagtggcatgataacagtataggacgctcatttgggcacagcctaaaggccaccctttggaggtgctttcatgcaaaggaatcgtctggaaaagtaggagttgaagccacagccattctccataggagtgtttagggtccagtgtcaggatggcagaaatcacagccttgacccatgacgg

SEQ ID NO: 653971 - DNA, 655 bp, Homo sapiens
cagacactgaccttcatcgcctcggctccagcgccatgtcgccctccaggaaggtcttcgctgatggaaactggaagatgaacgaccggcagcagaggctggaagagctcatcggcactctgaacgcgctcaagaagccggccagcaccgagatgaacagctttccccccaatgagctccatcgactaggacaggcggaagctagatcccacgattgctgaggatgcgcaaccctggtacaatgtgagacccgaggcttgaactggggaaagaaccactggcatgatcaacacctgccacaagatgcactggaaaccggggcactcagcgcgaatgcaaccgtctcgtgcgtcactgaaggcaccccgcccccaatgtgcccgccaatttctccggtttgccccgtatcaccatcgaacttagttcggctgatatcacgaaaggtacccccacctcacgggcacggtcccccccccccctccattgcgtaccctctctccggccccctctctcctataccctatccactctcgcccccccccccacccctactcctctcctcctcctccccccgccacccgcgcccgatccgctccatcgtgctcaccccctaccatcgcctctcgcccccctctccccgcgccccccccctcct

SEQ ID NO: 653972 - DNA, 555 bp, Homo sapiens
aaatgtcccttcaagccaagtcaaaggccactatcaccccatcagggagcgtgatttacaagtttaattctacgacttcctgtgccactcctcaggctttggactcctcctctgccgaggtcttcatatttgtgagcacagcagtagtagtgttggagatcttgaccatgacagtactggggcttgtcaagctctgctttcacgaaagcccctcttcccagccaaggaaggagtctatgggcccgccgggcctggagagtgatcctgagcccgctgatttgggctccagttctgcacattgcacataacaatggggtgatagtcggtgactgtgatctgggggacagagcaaaaggtgcccttgctggcggattccccttttggcttttatgatgccatggggaaaccggggaacaaggggcccctcctgtgaaacaggttttttcactttttgattgaaatcgggggaacccaaccagggaacctttactttttgttacatggaaaaattttcttgctagaaaattcccccccttgcctggttaaattcccctt

SEQ ID NO: 653973 - DNA, 108 bp, Homo sapiens
attgaaggctgaggccgcaggtctaagaccaaggaagcacgcaagcgcgtgaagagcgctccaggccagaaggaggagatcactcaagactttattccaagagaggaa

SEQ ID NO: 653974 - DNA, 626 bp, Homo sapiens
aatggcgatcattcaaaaaaataaaaataaacgacaagagtcggtgggtcacaattgctgtaatggttcctaggaaggccatataagagtttatgcaacatataatacacactcgataaaactgcctaacccacttactgaaaggcagcttatgacatgtaaaggttccaacatgcaagggttcaatgcatatatcgtgaaatattccagctctattgctcgattataaagaaagatgtgtgtagcagtcccatttcaaatagaaaggcgagcaatatcaaatagtcaatataaacttgcaagtgcatagtatcaatttcagcaagctaaaaagatgacggattgaggtacgcctcgagcgtaacttagaaggtacagaccatctggcaaattctttggacagcaataataatcttatccctcagaaacaccttgtaaacactggatactcaatgataggcgtcaaaagcacgcattattgagccggattttaatatgaacagaattcactacaactctttaacatatggagaacaaattaattcagatggtgtcatattcccatagaagcaactcaatctgaaagtcatagagtagtacatgaggatcttacatagtcagtgata

SEQ ID NO: 653975 - DNA, 87 bp, Homo sapiens
tggagcattcagccgggaggagcattcagcggggaggagcattcagccgggaggagcatccagccgggaggagcattcagccgggag

SEQ ID NO: 653976 - DNA, 286 bp, Homo sapiens
agaatttacatgttaaaacataattaccactgtaggaggcaggtcttttgagaagtgattagatcatgatggcagagacctcatgaatgaggttaatgcccttaccagagaggtcacagagagctgccttaccccttccaccatgtgaaaacaccgtcagaaggtcccacctacaaaccagagatctggtcttcatcagacactgactctgctggaggtttcatcttaggcttcctagcctccagaactgtgagaaataaatttgttttgtttataagccaaaaaa

SEQ ID NO: 653977 - DNA, 1181 bp, Homo sapiens
acgtgatctaactcttatcatacgtttgacttgaccacactcatcacagctgactcatgacttcgccacctagtaatattttttcatcactaggatttacatgaccttacaaataagatacatagtcttatgcttgtgtagttccacgataccttaacctaggcattaaaagtaagccccatactggtgtacttcagcatgcatagacgtgccccatacaattgtaggtaaccatctatcgacgatgcacatgccagaattccatacactcctttttcttaagataaaaactgtctcatctgtatcaaaacagattaatacatccatcgcggaacgaaaattgaaactcataaacctaaaatactataccaatgtctaataacaacatatcatttacataagtccattcattgtgcctactatcatttaaataataactattgaaatatccctcccatatgccatatttctgagtctctcccaaaagtgctgatccacacagtcaacaccacatctttaacaaatcctggcccgttgcatttctttcctcacgaatgaccaaaaatcaactaacactaccacctctctcatagtcatcatatccatagatatcatctcctcctcaacataacactgtagatagctctattatccatccaactctacgtcaactcatataatctaattctataagcataggaacagaatgagcgctgccaataaaatacaaaatctgccattcgtacctcccacaagatctctaacctcctatctccctcaactttaccccgcactattacgatttgaccatccctaaccctaacacaaccagtacatagcccttaatcaatacaactccattcttatatatcacctcattcatacttagatcctaatctacatacccgggatactctagctatctccgaccttaaacactctccccgcaccgctacccctaactactaatcttccagctgcaaaaaaggcttcctgactaaacaacccttaagtttccattccccctcctctcccctaaaaaggcctttacactcgccataaacccgcgttgtctaccccaacttgggcctctctccccacatttccacataacaagaacccttcataccccccactatatccatcacccccttaacctaaacaccacctaaaaaacccta

SEQ ID NO: 653978 - DNA, 353 bp, Homo sapiens
atctgacaaaggataaatcacaggacaattagatttactggagaagaataaaaacaacattgcaatgtatcaaaactatatgggctgcacgtaaaaacagtgctcagaggaaaattaatagcactaaactgttcatattaaacaagatgtgagagttgggcatgctggctcacgcctgtaatcccaggactttgggaggttgagacaagcagatcacttgaggtcaggagtttgagaccagcctggccaacatgatgaaaccttggctctactaaaaatacaaaaattagctcggtgtggtggtatgcgtgtgcctgtaatcccggctatttgggaggctgaggcaggagaat

SEQ ID NO: 653979 - DNA, 340 bp, Homo sapiens
  misc_feature (340)..(340): n is a, c, g, or t
tctctagctatatgtattgcagtctctttttctttaggtctaatgatatttgttttatatatctgggtgctccagtgttgggtgcacatatatttataattgctataaactcttgctgaattgacccctttatcattatacagtgaccttctttgtcttttgtagtttttgtcttaaaatctattttgtctgaggtaagtgttgctactcttcctctttattggtttccattggcatgaaatgtccttttctttattaatttatttttagtatatgagtgtttttataggtgaagtgtatttcttgtaggcaacatatttatgctgcttagattgatttn

SEQ ID NO: 653980 - DNA, 810 bp, Homo sapiens
  misc_feature (22)..(22): n is a, c, g, or t
  misc_feature (67)..(67): n is a, c, g, or t
  misc_feature (78)..(78): n is a, c, g, or t
  misc_feature (80)..(80): n is a, c, g, or t
  misc_feature (84)..(84): n is a, c, g, or t
  misc_feature (105)..(105): n is a, c, g, or t
  misc_feature (112)..(112): n is a, c, g, or t
  misc_feature (138)..(138): n is a, c, g, or t
  misc_feature (146)..(146): n is a, c, g, or t
  misc_feature (155)..(155): n is a, c, g, or t
  misc_feature (505)..(505): n is a, c, g, or t
tccatgtttaaaaaaagtgacntggcttaattactatgggcagggggggcctgcatgagggggtagngtgcccagggnangggngggctgtggaaatgatgacanaagaggntggaaggaaagggggggggttggaanggccaggnccaaggggntcctcaggtccgcttcggggaggggacagcctcgaggaaggagtcagggcaagccatagctaggccaccaatcagataaagaaattctggagaaatctagctgaccatcacggtgggtcgtccagttcttcatcatgcggtcaaggacaccagggtccttcgggtcctctggggaagggcagcaagtccggtatccaggaagctaaggaactcggtctgggagagacgggtagttataaccatcctttccagcatactctcgggaagacagccaactcagggactcgatgcaccgctcagcactcggaaggggcgggagatcatcggccaggtgggacctgaccagaggngcgaggaggctggggctgggaccggcgctaagagctcttgtgacgcgcggagaaggggtctggagcctcatcataaaccctacatgccagaatatcggacgacggaaaaccccaaatggggatgacgccggtgcagcggggggccccgaaggcctaggtggcctgggatgggaaccgcggggacacccggaggttacgcaagacatcgggccaggatcaaacggacagcgcggacaagcaaaaccgaggaagccagaagaagggtgccgcaccatggcgggcaagaacaaaacccgggaacacct

SEQ ID NO: 653981 - DNA, 264 bp, Homo sapiens
  misc_feature (42)..(42): n is a, c, g, or t
gcgtaagcttctcgtcatcaactccacccaggcccctttccnatgtggcctcttggtcacacaacgcctgcatgcccccctcagctctgccctccactctgccccacaggctgctggtaagtctcccctgcagcttctcacagctgggagccgcagtttttcatctctccaaactcctagcctggagccagacacagtcaccatcacaagggaaacggaggcagggccaggtgtagtggtgcacctctgtgatcccagcacttt

SEQ ID NO: 653982 - DNA, 512 bp, Homo sapiens
  misc_feature (1)..(1): n is a, c, g, or t
  misc_feature (15)..(15): n is a, c, g, or t
nttcggcacggccanctagctctagcccagcctggattccagggatcccacccctagccctgtccctattcagttggcacaggctgccctgaccctggggccttgatttgatctcaaataagccatagaggagagaggtcttgaggggtgggagcaggtgtgtactgacaattcccctcccacatgtcttgagctgggacctcgtcatctgagacttccccatgccccaacaaatgcaaatgcacacaaacccatgcatacacaagcacacacacacaggcatctccccgtctggttgggggagcatgggagggggcacttcacagggagaagataaatagttccacacctgaagaccctccaacagcttctgcctccctcctcatcacttcctctctccaccccctctccaacactggccccttcccctaattaattccctggtgaggacagccagaggagctgcgacttggtattttttggaataaatagacattttcctgaaaattatt

SEQ ID NO: 653983 - DNA, 502 bp, Homo sapiens
cttgtactacactgaattcacccccactgaagaagatgagtatgcctgccgtgtgaaccatgtgactgtggcacagcccaagatagttaatcgggatcgagacatgtacgcagcatcatggaggcttgaagatgccgcattaagatagcatgaattgcaaactcagctggctagcttcataatattgatatgcttatacgcttacacttaatgcaccaactgtacggatatagtaatgttaacatggacatgaacttatttgtaattgtactctgcgagctgacttcatgtgggatgtatctgagcaggttgctccacaggtagctctatcacggctggcaacttagaggtggggagcatagaattctcttatccaacatcaacatctgggtcagatctgaactcttcaatctcttgcactcggagctcgttaagatagcttagcctgcataagctaactaccaattcacatactctgcttagaatttgggggaaaatttag

SEQ ID NO: 653984 - DNA, 137 bp, Homo sapiens
cggatataagtcactcgggagcgtgactgcttggccctctcaatggctcccaagacctgctgctggtgctcttgggagaggtaggggtcctgaggcaagctatggggggcaggagaggctatgcctgcttcattatc

SEQ ID NO: 653985 - DNA, 144 bp, Homo sapiens
aatgctgcacggggactgccaggacctgcagaagcagcacagcgatccctgcgccctcaaccctgcgcatgaccatggttctccgaggagtgcgtgcgctgtgtcctgacgtccctgaaacttgagacatgggtacctgagctc

SEQ ID NO: 653986 - DNA, 1335 bp, Homo sapiens
  misc_feature (369)..(369): n is a, c, g, or t
ccggggatatgtgaggaagaactggaccctacttgattcatctttgtgagatgtatgcgggtctgtccctcttcacggcaggggagagaggtgggagatgcctttctgtaccccgtccgaggtcactccctgtactagggcacttacatatatttgctgcttgtcggaaaataatccactacactttaagaataattacctcccaatgttactcttttgtgacgaaaatgcaaaggagcccgaaaatgcacttgacaagctcttctcttcagaacagcaggcttccatcttgcatgtgttgaatacagcatctactaaagaacttgaagctttccgattgcttcgtgaagaaggtccatcaatatcgtngagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgaga

SEQ ID NO: 653987 - DNA, 1010 bp, Homo sapiens
  misc_feature (369)..(369): n is a, c, g, or t
ccggggatatgtgaggaagaactggaccctacttgattcatctttgtgagatgtatgcgggtctgtccctcttcacggcaggggagagaggtgggagatgcctttctgtaccccgtccgaggtcactccctgtactagggcacttacatatatttgctgcttgtcggaaaataatccactacactttaagaataattacctcccaatgttactcttttgtgacgaaaatgcaaaggagcccgaaaatgcacttgacaagctcttctcttcagaacagcaggcttccatcttgcatgtgttgaatacagcatctactaaagaacttgaagctttccgattgcttcgtgaagaaggtccatcaatatcgtngagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagaggtaaggcagttgcacctccagattcctacctgctagagctccttgtgtagtttaatcttctggtcccaaaaggaatgtaataaaatagtaaagatgggttttcttctggtacttgttactcacttattcctattatgttttccatcacctttgatttttaaaaattcaacctttagttagttcaagaaatgccttatgcatcgaaggcagatactgagaaaatcaatggtatttcattctaaatgttatagaacattatcactcttttatttataaagcttatttttcaaaatgcc

SEQ ID NO: 653988 - DNA, 699 bp, Homo sapiens
cagctccgtccagaaattgtgatttgtgacgaattaaattttcctgtaaaacctttccctttatcgccagctgaaatttcctcatcaaggtacaaagtgaattcccccgttgcgaccttctagagtattgatcctcaggctaagtattcggcacaggccattggctagctgcagtacaggtctggacagtttccctgtcgtgagtccaattgttcaatcaaagaatggctcgtcaaaaacagtttcgctcctctggctgcagaccggtccaccgacctctatgccatggtggtggttctctcgagggcctcatgattcttgagtgagggccccccctcggtccagcattactcaatggtctgtgaaacctggcgatttctgtcttcagctcggttcccaaagggcatggcctccttacagtatcacccctgtcagcaagagttcttccgcaacttctcaagcatctccaaggccttggtggaacgaggtggtgtggtcaccaccaacccccttggcgtctaaaaactcgcggccagggcctgtcccagttatgtgccttcccgcaagccaaagccaaatcccctttccttaaggccctggtttgtcccttaggggccttgtgttcccaacactgtgcccgctctctaaagcactaatgtcctcgcaaaaaattaaaagttctagccccgccaaaaaaaa

SEQ ID NO: 653989 - DNA, 1642 bp, Homo sapiens
  misc_feature (369)..(369): n is a, c, g, or t
  misc_feature (1573)..(1573): n is a, c, g, or t
  misc_feature (1604)..(1604): n is a, c, g, or t
  misc_feature (1629)..(1629): n is a, c, g, or t
  misc_feature (1634)..(1634): n is a, c, g, or t
ccggggatatgtgaggaagaactggaccctacttgattcatctttgtgagatgtatgcgggtctgtccctcttcacggcaggggagagaggtgggagatgcctttctgtaccccgtccgaggtcactccctgtactagggcacttacatatatttgctgcttgtcggaaaataatccactacactttaagaataattacctcccaatgttactcttttgtgacgaaaatgcaaaggagcccgaaaatgcacttgacaagctcttctcttcagaacagcaggcttccatcttgcatgtgttgaatacagcatctactaaagaacttgaagctttccgattgcttcgtgaagaaggtccatcaatatcgtngagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattctgtgcctctcaggttaacgtgttaaacagtaacatggggcttggtgcagtggcttatgccgataatcccaagtagctgggactacagacaggcatgcaccaccatgcccggctaatttttgtatttttagtagagacgggatttcattatattggccagggctagtctcgaactcctggaccttgtggatcctcctgcctcggcctcccaaagtgttggggtttacagggcatgngccaccgtggcccagcagggttcattttttnaactttggcaatatttttaacttgnacagnccatcgtt

SEQ ID NO: 653990 - DNA, 1509 bp, Homo sapiens
  misc_feature (369)..(369): n is a, c, g, or t
ccggggatatgtgaggaagaactggaccctacttgattcatctttgtgagatgtatgcgggtctgtccctcttcacggcaggggagagaggtgggagatgcctttctgtaccccgtccgaggtcactccctgtactagggcacttacatatatttgctgcttgtcggaaaataatccactacactttaagaataattacctcccaatgttactcttttgtgacgaaaatgcaaaggagcccgaaaatgcacttgacaagctcttctcttcagaacagcaggcttccatcttgcatgtgttgaatacagcatctactaaagaacttgaagctttccgattgcttcgtgaagaaggtccatcaatatcgtngagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattctgtgcctctcaggttaacgtgttaaacagtaacatggggcttggtgcagtggcttatgccgataatcccagcactgtgggaggctgaggcaggaggactgcttgtgcccaggagctcaagagcagcctgggcaacatagcaagaccacataatttttaaacatttttcatt

SEQ ID NO: 653991 - DNA, 1524 bp, Homo sapiens
  misc_feature (369)..(369): n is a, c, g, or t
ccggggatatgtgaggaagaactggaccctacttgattcatctttgtgagatgtatgcgggtctgtccctcttcacggcaggggagagaggtgggagatgcctttctgtaccccgtccgaggtcactccctgtactagggcacttacatatatttgctgcttgtcggaaaataatccactacactttaagaataattacctcccaatgttactcttttgtgacgaaaatgcaaaggagcccgaaaatgcacttgacaagctcttctcttcagaacagcaggcttccatcttgcatgtgttgaatacagcatctactaaagaacttgaagctttccgattgcttcgtgaagaaggtccatcaatatcgtngagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattctgtgcctctcaggttaacgtgttaaacagtaacatggggcttggtgcagtggcttatgccgataatcccagcactgtgggaggctgaggcaggagaatcgcttgaacctgggaggcgaaggttgtggtaggccgagagcacatcattacactccagcctggacaaccagagcgaaactctgtctca

SEQ ID NO: 653992 - DNA, 265 bp, Homo sapiens
atttctagatttgttggtatgttgaatgcataggtctaatgatattcaaaggggggcaagaagtagcagggtctgtaaaagagcctgagtctataatagctatggaatcaattcaatatggactggtgtgctctctttaaatcaagatcctttaattaagcactgaaaatatagtcagcgtcagatcatttaaatgggcaatatctcatacaactgagccggtctcatttcagattgccaagactgaaacaggcaagcaaggggt

SEQ ID NO: 653993 - DNA, 1328 bp, Homo sapiens
gggagaacaggagcatggagggcgggctggggcgatgctgtgtgcttgctgaccggggcctcccgcggcttcggcacggacgactggaccacgctcctggcactcgactgaatgtctgcccggacatccgttgcttgtcacattagcagccctgagcgagctccacacacggtcctaaggggcatgcagagagatgcatgattagtcacgcaacgcgggcttctgtggctactgaggtgaatcacagatcaagttgaacaactacatgggcacatgacacttgaccatgcatgcatcttgacatgacttcacagcagatactgaccagggccatatacacaggaccagatccattggccttcaaccagaacaccggcggggttaaaccatccatctgatacacatcatgatgcaccatgacaaccccatcttcacacacgaggctcgggacagcatgcgtacctacgatcgccagaggcacaaggaatgcatacgatgcactacatgcatgactagccaacgggatccacactgggacgacactagtggaagagcaacaacgaaacataggcaacgagcgatgccacgagcaaacccaatggaccaccccgacaggtaccactacatggagacaccacaggaagcacactagtgccacccacagaaccacaggctaacacacgagcgacgaaacaacacaccgaagcgagacaccacaaagacaaccagtcgagcagacacaaacacgggagagcatgaccacacgactgacgtgacaacagcgggcacaaccaacccgggagccaacgcccacaagagaacggagacatcaggccaacaaagaacgaaaacagacaccaaacgacaacacccttgcccatgcaacacacaaaaccataggcacaccaaccaggcacaggaaaacacaccaccagaatcactgaacaccaccaacaaaacgaacgaacactcacaaaacctgcacgcacaagaccaaaagacgcacaagcagcaacacacacgagacagaaacccacgcacaacgacgctaacaagagcacagcccaaagacacaaacagcaactaaaccgacgaaataaaaacccaacaaagaagacaacaccacaacaccaacacctgagccaaacagaaggaccaacgacgaagaaaaccataaacaaaacaaaacaaaaacagccagaacaacaaagagaagcacacagacacaaaaacaacacaaaacaagacaaaaggaagaacacacaaaaggcaacaacgagagcagacacccaaacggaaagagaaacacaccaagaaaacaaacaaga

SEQ ID NO: 653994 - DNA, 390 bp, Homo sapiens
taacaacacagcctggctttaaaaagcatctaattctcaaaagcaatctaattggagacctacgtaatggacaaatccagcagctcttctggaaggtttattacccaagaacatctgaaaacacttcagagacagatcttgccaacaaaacacgaatgagcagcagatcacggccctgatctcatgcaaataaagcaatcatttttaggcaaaacaaacgttggcatatcctttcttagatatactgaaaagtcttggggtcttagaaaatcctggattcccatggacattgtttaaaaattttttttcttctaaaaactaaatgtacaatcataattccaaatcagaggacccctgagatatcgagcagctgagctctaaggaagttca

SEQ ID NO: 653995 - DNA, 1343 bp, Homo sapiens
  misc_feature (911)..(911): n is a, c, g, or t
ttgttcttattctctctgtggttcggttccttcttgcgttcgcctctgcggtttttgctcgctccgtccgttctcgtttgtttctgcctgccttgcctgctctgcgcttgttttctggtcccggcgcgtccccggggtttgctcggtgtgttgtgtgttgtgtggtggtgtgcgttccgcctatgttgctcttctgcttgttgctctctctcttcgcttctctctcttcgttcctctttgctggcctctcctcctcccgtttcaccgtctctctcgtggtgcttcgcctctcttctcctcctgtgtgttttgttgccccttttgcaccaatgttccttccctgcggttttcccccgtagttctcggtggatttctccggttttttccccccctgtatcggcggtgttttatatctgttctcgggcccacgtttgattcctgggttatatccgtccgtctacctatttagggggcgctctatggcttctgcccgtcatgtctctgttacggttcccgatgtcgtctgcggaagtcaagttgtattcgtttgtatatcggtcgccgcattaactttccgtagtaagcgataacatgtactttcgatatgttattcatgtgctgatcgggtaccggggacattaatgtcccccgggggaaattcgggccattatcggtccgggggtatctcggttggtgggccatctgccgctagaccagaccttcgctcgttatctcggtgcgccctctgcttcgctttttcctccgcacacgcactgtcttgtagctaatcccgatttatggctgagattcgtagaaagttcggaataatgtcgagatatctgtatggatgatctagatgacgccacattatgaatttattccatctggcctttcccaataggtaatcgatnttgaaccctggatgtatggcaagtcaggcgaatcgtaatgaggcgctgcgccggccaattatgcacctgtaacatgtccacacaggcatttgccttcttattgttacttgcttttagctgtttaactctgtgtaagatggcaaagatggttggatcaagtttaaatgtactgtgtctgcccctttcacatctaagtgactatctgacaatcgaatggccgcgccttgcctttcccatctgtctatctatctggctggcacgggaatggaaagacttgcatgttggtgaaggaagaagtggggtggaagaagtggggtgggacgacagtgaaatctagagttataaccaagctggcccaaggttgttcctgcagggctgttaatatgcatgttttattcgtgtgtgccattttttttaaatgtcgcagatgaa

SEQ ID NO: 653996 - DNA, 326 bp, Homo sapiens
agaggtctgagtccaatcagagctacagctgctggcctacaccacagccacagcaacgcaggatccgagcctcatctgcgacccacactcactgctcatggcaatggcagatccttaacccactgagtgaggccagggatcgaacctgcaacctcatggttcctagttgaatttgtttccactgcgcctgcctctctcttatagggactctggtaatggcatttagggcccacttgggttgcccaggatgatccctgcatctcaagacccttaacttaatcacacacaccaagacccttttcccaaataaggtcacactcacaggc

SEQ ID NO: 653997 - DNA, 746 bp, Homo sapiens
gctgcccgagcatccccgacgagcaccaccccctgctccacggcgcccagtcccatcgaccacccaagggctgaggagtacgagcgcacggcgccggactggcaggcagctccacctgcagccccggtgcgggatccactaggtgaagccagttgggctcctgagtctggtggggacatagagagtctttatgtctagctcagggattgtaaatacaccaatcagcactctgtatctggctcaaggtttgtaaacacaccaatcagcaccctgtgtttagctcaaggtttatgagtgcaccaatcgacactctgtatctagctgctctggtggggccttggagaacctttatgtctagctcagggattgtaaaaacaccaatcggcactctgtatctagctcaaggtttgtaaacccaccaatcagcaccctgtgtttagctcaaggtttgtgagtgcaccaatagacattctatctagctgctctggtgaggccttggagaacctgtgtgtggaaactctgtatctaactaatctgatggggatgtggagaacttttgtatctagctcagggattgtaaacgcaccaatcacggccctgtcaaaacaggccgctgggctctaccaatcagcaggatgtgggtggggccagataagagaataacagcaggctgccccagccagcagcggcaacccgctccggtccccttccacagcgtgcgcagctcagtactatcgctctatagc

SEQ ID NO: 653998 - DNA, 1204 bp, Homo sapiens
gcggaggtcaaggatacgggggcggggccagcgcggagctgcgagcgggagccgggcactccaggtgccatggatgggctcggcgcgcctgaccttctgagccagcctgagactgaatgcgctggccatgagggagaccaccccatggacaatgcatggggaaagcttctaaatgtgacactcagaatagggcccagtgatgcagctcgtttgcaccaagctttagctggaggtggcagcacattctttgagataccttatccttgtgagttatctcgtcaagataccgcacaggcgttcacgagggagtgaatgagctgacgcctactaatccaccgctacccaatgttcccacatgtcgggaggagaccgtgccttccggtggctcatgcacgcgagcagacggcaggcagcgcgccctgtcctcaagagcttattcgcccgttgcttctcctgtcgtttcaccagcaactgagagacatgcagctggagccatcgaacatcacccgaagctagtcctcatggggcagacaccctgtcctccgtttcgcctccctgacaccaaatgctcggacctggcgacgcccccaaccgtactctggcgcgtacgtcgcacgtggccgccctttcactctgccccctgccccgagagcccctttgcgccccccttcggcccatttcgccccacaccgcctgctcctccttgccacctcaacttcccctggcctcgccgcactctccgcccgtgccgcttcgggggcgctagtggcatgtccggtcccaaactcgcaatcctcttggcggcattggaaccacgccttgtcgagtcggaacacggacgcacccccttgcgtggcagtgtgcttcccacatcttggggccgtttggatcccagttcgcttacaccccccaggaataattccgatcttggcgcacacaggaggttcgttccccacgaactcggatagagcggatcttcagctcacccccttcgttctggtcactatcgcaccactctccgtttggtcgcgcacaccacgcaccctcttggctacccacccatcttcttgttgtcactacgggcaacgcgctggtgtctaccatcatcgcacgcgtcagcaacgaccatccctcgccgcgcccactccttgtgagtcgcatctccccgctgcttctcccccacaccgtcggccaatccagccag

SEQ ID NO: 653999 - DNA, 370 bp, Homo sapiens
tagcgaattccagctcggttcccaggtaccatttgaactggctctttcttcataggagcgattttaggggctgctaagtcactcttctcccctagaaactcagtatctaggaggctgagttttttagcgccagaacgttttttacctttagcaattatgatcacttatgggtatgtgagccactcagcgcgtcaggttatgagtcagtaagaacgtaacagattcatgtacgtacatgcaggggatgcgctaacattttgggctttataaccgaacgctcggttccttcactaaggaagcgagcgcctgcttggaatctgatcatccatagctggcgctatgcagtccattccctgcaggtgaatgggaa

SEQ ID NO: 654000 - DNA, 573 bp, Homo sapiens
gctaccaatgtactttcttccccaagagtggacatagatgtccagagtgtggactgtcaaggcccagacgggcacctaaaagatgctcaacagtgaaaatgcccaagtgcagtcatgcctggcttcaagaggaggagggcccagatgtggatgtgagcctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaatctgaaaggacccaaagtgaagggcgatgtggatgttacccttcctaaagtggaaggtgacctcaagggcccagaagctgacatcaagggcccaaaagtggacatcaacagccctgatgtggatgttcatggcccagactggcacctgaagatgcccaaggtgaaaatgaccaaattcagcatgcctggcttcagaggagaaggtccagatgtggatgtgagcctgtccaaggacgatgtcgatgtctcgggac

SEQ ID NO: 654001 - DNA, 296 bp, Homo sapiens
  misc_feature (236)..(236): n is a, c, g, or t
  misc_feature (275)..(275): n is a, c, g, or t
  misc_feature (296)..(296): n is a, c, g, or t
cctgaccaacatggggaagctccgtctctattaaaaatacaaaaattagttggacatggtggcgggtgcctgtaattccagctactcgggaggctgaggcaggagaatcacttgaacacaggaggcagaggtttcagttagccgagatcacgccattgcacttcagccttggcaacacagagcccagactttctcaaacacacacacaacaacacagagtatgttacatataaccngagacgggagtgcacatcttagagtgtgaataatttagnggtccagcagagcagcatctn

SEQ ID NO: 654002 - DNA, 409 bp, Homo sapiens
ctgggatggagcggttggcccaggccgggtgtctgtaacaccttgtatgcgtctctgtgtcgtagggtaaccttccctgtgatccttacgccctacctgtgtagacctccactgctagagccagactcacggacctgggattctacatggaggatcgcatacacgcactgtgccatggtgacacaggccactgcagacattggacgtcccttctctgagggcccagagccctggtcttgagtttgtcagcatgggccgatgtcgatgaccgtagaagcctactatggctgcgaatgcgtctgagagcgccagtccctcagtgggccattcgttttctggcgctcgatctgtagaccaggattgcttccacagatgcctactgctcgcattctgagtgcgcacaggctct

SEQ ID NO: 654003 - DNA, 273 bp, Homo sapiens
agtactcactgagagcatatacctaagatatttaggtcttagcatatctcatgactgtttaggatggctgtttgcttcttgacacttcttctgggccggggggtataatcttttttcctacaagacagcttcctagggtagtgtttcagtcagcacatcctcagtaccatcttagttcctccctcccataaaaataatgcccccttgttttctgaaaactcaggcagtcagggccagtcagaaaccatacagaaatgatatcttggagatttc

SEQ ID NO: 654004 - DNA, 167 bp, Homo sapiens
  misc_feature (86)..(86): n is a, c, g, or t
  misc_feature (100)..(100): n is a, c, g, or t
  misc_feature (139)..(139): n is a, c, g, or t
ttttctccgtttcatgtaatttttctaaggtttttggcagcactctgtaccctgtaacagtactcagtaccttttgtttgatgttnctgacaaggcctgnaaaaaaatcccttaaaggggaaacccattaaagtgtagnaaaaccaaaagggggaaatcactagtgc

SEQ ID NO: 654005 - DNA, 719 bp, Homo sapiens
acaattgtcaattagccaggttatccctggtacccccaatttaacagggtctgcatggttcccacctattgacctggaccagatctgtcgccgggaatgaccagtgctccattgtcattagttaagggtgccacgtttaccgtagaagctcgcattaaggtggtctgagcagtatcctttaagcaatgacttcttcatcgcgaacatttcataagggctctagcattcataacgtactctctcacaatatgcatatttactcatctgtctcgacagtatattagcattttgtactgtgaccggattcgcgcaggaagtgtcagtggtcctgcatttgggaggggtggaccagcatcggtctacgcgtgagtcggcgttctcattgatttgaagtctgtatcctgtgttgcaaatagtttgcacagtatcaccttccatatgtgtttgtcctgaagattcggcatggtcgttttccacctaaggatagtcactcagtctgagtctctttggtgatggtgcccatccttcttctgtgcgtgttatccgagtccgcaatgattatgaaggacacacaaaatcatatgcacagcagtgatagaaaactgcccctgtagtaacctggagaagtggctgatattctttcttcctcatatacgctagcatggttatgcttggactctccccgcatgttacgtctcagacaacaccggatatcagag

SEQ ID NO: 654006 - DNA, 1044 bp, Homo sapiens
gctagtgccctgaccacaccagagatgcagaaagaaatccaggagttaaacgaaggaatgcgctgcgctacagagagagattgagagaacattaaagcagctaccaatcatgtgactccagcaagagaaagagcaggtgtacacgaggagaggcatcaagtactgtaaaggcagtggtaggagagaggaagaggatggctacagaactgtctgatgcaattacttgaaggataccccaagagcaagaagcagttcgtttgaggaagttgggatatgagacggatgaacgattacgacgtcacactcccagtacccctgaggggtgcacggtccaggactgtgtggggactgcagcgatgtcagaagagtgagatgtcttgcactggctagctggaatgggttggcctttgttgttgttcctgctactttcacctttaatgcaagagcaagtcagggacgacaatgacagtaaatacacgatgcagctgggtaggagatggatgagggctgggtggataggggagtagacacacaggccgtcttcatggtccgaaacttgcggtaggcttgaggttaactattcatgagttggaaggcaatgtctaaagggagcaggcgttcgggaatatatacttgtaatttcagttttgatataaaactatctaattgccccctggatagtaaaagcatgacagagtatcgaacctgcaagaaggctgccgtgacgtctggagaaactacgggtatagaagaagtcgctactaaagagatgacatgggaggggccacggttaactcgcgactggtggggtagtgttacccagagcgctttaagcttatcggtacgggttgggtcctaccacaagtctgggtgaaatgcgggaccctggaaatgcaatgcccattcgtgacgcaaggcgttgacgggcggtcattcacctgacctcccacgtcgtttgcaattccatgccgtgacaaacaactcgtattgggcgaaagtaagagaagtacctaaggagccatggtatacactacacaagcgtca

SEQ ID NO: 654007 - DNA, 116 bp, Homo sapiens
acttaactagcaacctaagcatgattttacagcttttgcccttagggtttaaattacaattccaaatgttagacatactgtattttttcgttcagttttgcttaattttccccctt

SEQ ID NO: 654008 - DNA, 612 bp, Homo sapiens
cagtatcaggagcccattccctgtgagcagctggtgacggctctgtgtgacattaaccaggcctacacacagtttggaggtaagaggcctttcggtgtgtctctgctgtatatgggatgggacaaacactacggtttccagctctatcagagcgaccctagcggaaactacggaggctggaaagccacgtgcatcggcaacaacagcgcagctgctgtgtcaatgctgaagcaggactataaagagggagagatgactctgtctgcggccctcgctctcgccgtcaaagtgctgaacaagactatggacgtcagcaagctctcggcagagaaagttgagatcgctacactgacacgagagaacggcaaggccaaaaatcaaagtccctcaagccaaaaagaaagtggaagagctcatcaagaaccccgaagcggaagaagccaaagctgagaaggccaagaaagagaaagaccagaaggagaaagacaaataaaacgcctgcacttgttttctactgaaatgcaaacgcccgctgggattcgtaaaaaagttcatattgctctgtctgtccatctgtcgatttttttattaaacccaaaacgaaaagggcca

SEQ ID NO: 654009 - DNA, 269 bp, Homo sapiens
cagtaagtgacaattgttgtactgaaccactagttacgatgactcgctgatcataaacactgtgtgtaatatgtttttcctaaaaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggcttcaccacctgcaaaactgaccctagg

SEQ ID NO: 654010 - DNA, 198 bp, Homo sapiens
acatttgtttcttgtgctggacggaggcttgtttacaggggctgttggcgccagtgcagggagttgttcaagctgtcctcgtccgtcaatgccgttgtctgcgtcaaactgggtgttctccacgccgtgtgatgagcctctcgtactctgtcccgaactcccgggccatcacggtgggttcccccaccagtgcctcgg

SEQ ID NO: 654011 - DNA, 272 bp, Homo sapiens
gcgtgtcttgtcaaatgcttcgggtagaacctggaggaggaggccatcatcatgaaggtcgtgaccgactggaccggtgggggagtctgtgttccacacaacccgctgggtgccccccttgatcggggagctgtacgggctgcgcaccacagaggaggctctccatgccagccacggcttcatgtggtacacgtaggccctgtgccctccggccacctggatccctgcccctccccactgggacggaataaatgctctgcaaggaacccacg

SEQ ID NO: 654012 - DNA, 265 bp, Homo sapiens
agttggtgacgaccacttcctcgacgtggggcgggcggacgggaagcctggggtcgtggccaccgcctcgggagcttccctccctgccggcctcagggagcgaacgtggtatgaaaaccacagggattccggatgccagacccctttttatacttcacttttctgcccagtgttgttttgttgttgttggtttttattttttatactttggccatccctcagaggtatattgcccaggtgtgggctgaataaaacaaggtttttc

SEQ ID NO: 654013 - DNA, 798 bp, Homo sapiens
  misc_feature (7)..(7): n is a, c, g, or t
  misc_feature (159)..(159): n is a, c, g, or t
  misc_feature (190)..(190): n is a, c, g, or t
  misc_feature (198)..(198): n is a, c, g, or t
  misc_feature (264)..(264): n is a, c, g, or t
  misc_feature (267)..(267): n is a, c, g, or t
  misc_feature (386)..(386): n is a, c, g, or t
  misc_feature (389)..(389): n is a, c, g, or t
  misc_feature (412)..(412): n is a, c, g, or t
  misc_feature (415)..(415): n is a, c, g, or t
  misc_feature (451)..(451): n is a, c, g, or t
  misc_feature (489)..(489): n is a, c, g, or t
  misc_feature (510)..(510): n is a, c, g, or t
  misc_feature (521)..(521): n is a, c, g, or t
  misc_feature (538)..(538): n is a, c, g, or t
  misc_feature (549)..(549): n is a, c, g, or t
  misc_feature (554)..(554): n is a, c, g, or t
  misc_feature (668)..(668): n is a, c, g, or t
  misc_feature (686)..(686): n is a, c, g, or t
actttcnggggggccacatatcttcaatgtcttcacattgtatctgagaaatgtttctggggcactcaaacaccaagtctactcaaatacgcttcccaagcggcttttctgttcatctctgctgcttccaggcgatcagctgctgggattatgccacgncctacaatggtggtatcggcgcgctcgttgngcggattngcttcttgtgggcttttgtgctgttgggcagggttgtctcctcctgcttccaactgaactcctggngtnaagtgaagaaattctggtttcatgcttactcgggagccagaaataaaaccaacaacaaattcagagtgctcctcagccattctaaccgctgctctagtgtagtccccagtggccagggngcnggtggggctcatttccgcaatanggnggcacccccgatgcaaaggcaggcccacttcttgcnggcctttcacaactcctgagcctggcaccacgtgagcntttactagatctgcccaggangctattttaangatacctccttcatacngctttttcacngtgtntcctatatctgcaaacttccggtcttcaaatatcaagaactcatggcattttgccagagttatcaactccttcatcacatccagagtaaaacattcaaaatatctacatgagtnttcagcatgcagatactnggtcctaaagcatctgctagctgcaacagctctctggccagtgaaacatcagcagatagacacagataggtctccttctttagcataagcctgagaagcttcgatgcaactg

SEQ ID NO: 654014 - DNA, 313 bp, Homo sapiens
  misc_feature (69)..(69): n is a, c, g, or t
  misc_feature (183)..(183): n is a, c, g, or t
  misc_feature (201)..(201): n is a, c, g, or t
gattactgattcatagcagaatcctgactaatacactataccatacatacaagatcaaacacgtgtgtntcctatatctgcaaacttccggtcttcaaatatcaagaactcatggcattttgccagagttatcaactccttcatcacatccagagtaaaacattcaaaatatctacatgagtnttcagcatgcagatactnggtcctaaagcatctgctagctgcaacagctctctggccagtgaaacatcagcagatagacacagataggtctccttctttagcataagcctgagaagcttcgatgcaactg

SEQ ID NO: 654015 - DNA, 125 bp, Homo sapiens
aagtctaacaaatcaaagatagggcatgactatgaagtaattaaccaatcataccaaacttttatatactaatgttgcccattgtccttttggaatgctaaagagcaatgacatttgacattgtt

SEQ ID NO: 654016 - DNA, 167 bp, Homo sapiens
aatggctcccactgttggtggtggggcctggtgggaggtgtttggatcgtgggggtggattcctcacgtgtggcttagcacctttccctcagtgatgagtgagttcacgtaagatttggttgttggaaagagcgtggcacctctccctgccttgttcccacttttgc

SEQ ID NO: 654017 - DNA, 964 bp, Homo sapiens
ccataatggtatacatctgcatttgaactagactgggtgagattcttcgggtcgtatattcaaagtctgtggtccttagtctcaaggaacgtgtgcgtatgttgtatcaggatacgcgggtcctatgccccatgccctaatgggttctccaattttttccgagtaatccagccttatgacaggatcgactaaaagatgcactatttagcccacactttcagagggatgaaatgtatctgtgcacatgtcaccatatcttcatgagcatggtcacgtacagattatttggttaacatgaatttctgctctgcagttgtgtcctacagcccctgttttcacgaggtggctcagtgctccctttccctttttggtgcttacacatctcagacacctttagcgctaacccttgtcaggcgacagtatttgtaggttcatgagatctcacctgttacctctgctcctggagcctttgaataaaaatgcacgtagctgaggccggatgcggtggctacacgcctgataaatcccggcactattgggaggcctaggcgggcggtcaggggttcgagaccagtctggccaacagtagtgaaaccgagtctcgtactaacaaatgcaaaaaattagccgggcgtaggtggccgggcgcctgtaaatcccagactaccttgggaaactgaggcgggagaatcatgatgaacccgggacgcaggggttgcagtgagcggagatcgcatcattgcactccagcctgggccacagggcgagactccgtttcaaaaaaaaaaaaatgcacatagctatcgagtgtgctttagcttgaaaaggtgaccttgcaacttcatgtcaacttctggctcctcaaacagtaggttggcagtaaggcagggtcccatttctcactgagaagattgtgaacatttccagtatggattttcatgtattactcctgcttatataaccg

SEQ ID NO: 654018 - DNA, 795 bp, Homo sapiens
cgaggagagagagtcacaacacgaatgaatagtggaacgaagagtttgaaacacagatacaattactgagcatgccaagcccctctccagcctcactccactgattgctgcagctaaggaggcaacaaagaacaatcactaaaaccacactcaccccagactaattgagccaagccttctgtgagataaatgcacattacagaaagtccaactcctgatgccctcttcttattgccttgcttgtgcgatttcctgatctagcactcaacaatacactgaaccaagggaaccgtgcgggcagaattgaagagaactgaatttttttttttaaagagatgagggccatttctaaattagagtttggggggcccctcgatggataaggcggagactcacagataaaaaaaaatattaacgcgacatcgtaagccgcctgtgggattaaatctgttatttaactaaaaactccaaaagaatgatattatgtgaactgttatttagggaagagatataatcggtatggagcgagatagtgaagtgaagctgacaacatacatgaagcataaagacaaaaacgtcaagaattttagaatgggacgaaccgtaaatctcgcgtatgtgagaaacgacaaaagaaatgctgcagccctaaacttaaatcgtccattaccaaagtgggaggaaatgacgacaaaatgattggggtgtgagggttctcaaatcttactatggtcctcgataagtgatagtaggaacgtattataactgaactattcaaaatcaaagtgaatttgg

SEQ ID NO: 654019 - DNA, 1373 bp, Homo sapiens
ctcagtgtatggtgtgtgtgtctgtagtgtgttatatatttagctttttggtcgtgtgggggcgccggcgcacgctatcaatcatacgatgtgtgtgacggtgtaacataatgcagtcatagaggtatgagatcactattcaatgtagtgttgtggttttttgtgttgtatttttttggtctgtgtcttcgctgctgcagtctgtcttcttatcttggctcccctgcttcgacaccagctattgtgagttatatgcagtactctgctgatgtttatgtttatatgaataatcaacgaattaataattatccaactaatacttacatctaccaacaatctatatctaccatcctattcctatcttattatctctaacttctatcgcctccctgacaaaacttcagttcgtcattacttatcttctttctactctatctacttactacctccaatcaacaacttccaacctcctacttacttactcctccttcttccattctgttgttgttagtttacttcctatctatctatcctcctatctacctctgccttgctgcattgcgatttcgtctggtggtgggtatctgtgtgcgtacatcatcatgtcattacttaatgcatttgtttcttgcgtcatactccataccttcacccgacctaccactcaggtagtccggtcggtatgttagttgttggtgttggtttgtttttggtggggcgggcgacaatcagtgacaagtaaacatcattctgctccttctttccttccgttagtgtgtggtggtacgtgctacgacgtactgtagctgtcgttcagcttcaatcaccatcatcaccatctctttccgggacatcatatctatcttcaacctaactaatattaatatatatatttttttcctttgttgtcatagaacattatatctacaattacttatattgtgtaatattactacatcacaccaataccaccgcaatcgctgtcgtgtgttcttttctcattatgattcagatgtcactactatttattcttacatcccggccgcggcggtgttggagtatgttgtggttgttggttggttgttgtatggttccttcctcccatcagtccatcatcccgccatcccaccccgctgtggcgttgtcgttattactcatatgatgatgattatatgttcatcatactacaaaacaaccacatctatgtagatgttacaaccacctcctcccgccgtgccgttcggtcggtcggttcgaatgaagggggtggtggagagatagtatgtgtgtgtgtgacacacacacatacacacacacacatagtataatatatatcacacacactactctctcacacacacgcgctgtggtgt

SEQ ID NO: 654020 - DNA, 789 bp, Homo sapiens
  misc_feature (298)..(298): n is a, c, g, or t
tagctgaaaattaactctgacctctgtgctcggctcatggacgctagaatattattcggtatgtacctgaaattgaagttggtggtggtctgaaagctatcattagattctgttggtaccgctggtccctgcaatcggagaaagatcttgtgcactagaacatactctcaaagatcacggtctaggtgaccggcgatatcggacgtacataagagtgcacttgcgtgaagcaatgtacagtcattataatcggcatcagaggcgaatatctggactatctctaacccgtggaatgccngttacaaaaagatagtgcaaccgagcgtcccaaagagaccgaattcagtatcgagcctgtgtcaactgagtagcagagtcccattcgaagagaacgtgtgtattgtgcaccctatgtcgtaaaatggctgatctcatgaagtaattcgcgctgttcgataatattccaatgagtgagaccgggtcatcacttacctcgggtactatcttttgatactgatcaacattaagtctatattaccattagttggtaatccacttcggtatgactatcgtttgccctagggatgatctgatgaacgcaaggctgcaccgtgcgccaaggggccctgtttacattcattgtaattttcctccagcaaggtttccattttggtatgcatttgattgtaaactcaggggttataaacaacttgacattcttctaaattaaagatttagtgagaaacagagccaaattggccctcttaccttaagcttttaattccaata

SEQ ID NO: 654021 - DNA, 113 bp, Homo sapiens
tgcctgtcttggcctttcaaagtgttgggattacagatgtgagccgccgtgcctggcctgcctggccacttaaaaaaaaaaatttagtagagatagttgcctaggctggtctt

SEQ ID NO: 654022 - DNA, 520 bp, Homo sapiens
agagtataaggtcggctcggttattcgtagtgcggtttcattttactgcggtgttcactcggattctccatctcagatgagcagactttgaggttgttccaggatgaagaactctggactggggagggctcgcgggaatggtttgagctaatctgcaaagcactatttgataccaccaatcagctcttcacccggttcagtgacaacaacctgctttattgctcgcagcctatcgccccgtcatctggcctgaatgttgagtttgcgggacggctcgtgggcaagtgtctctatgagtcctctctaggaggagcctacaagcagttggtccgagactcgcttcaaccgctctttcctggccaaatcataggactgcgtatgcattacaagtactttgaaacagatgaccagaattctacaaatctacagttgtttatcctcaacaatgactgagtgagatgggctggtctttgcagaagagaatatataaatcaggtcattggataaggttgtagactca

SEQ ID NO: 654023 - DNA, 581 bp, Homo sapiens
  misc_feature (179)..(179): n is a, c, g, or t
  misc_feature (255)..(255): n is a, c, g, or t
  misc_feature (364)..(364): n is a, c, g, or t
  misc_feature (435)..(435): n is a, c, g, or t
  misc_feature (457)..(457): n is a, c, g, or t
  misc_feature (475)..(476): n is a, c, g, or t
  misc_feature (483)..(483): n is a, c, g, or t
  misc_feature (487)..(487): n is a, c, g, or t
  misc_feature (509)..(509): n is a, c, g, or t
  misc_feature (556)..(556): n is a, c, g, or t
  misc_feature (575)..(575): n is a, c, g, or t
aagagaggtcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgncgggagacattattgggaggtagaggtgggagataaagccaagtggaccataggtgtctgtgaagactcagtgtgnagaaaaggtggagtaacctcagccccccagaatggattctgggcagtgtctttgtggtatgggaaagaatattgggctcttacctccccaatgactgccctacccctgnggacccggtccaggggggtggggattttcttgggactatgatgctggtgaggtcttcttctacaacggganagagaggggtcacaacctcaanttcttttcaaggtacctnnggggggnctgnccggccctacttcaagctttanttaatccgggaggggaaaaaggggaaggtccccctgttcaacttggncccaatgagtgggattggntgggtt

SEQ ID NO: 654024 - DNA, 451 bp, Homo sapiens
  misc_feature (426)..(426): n is a, c, g, or t
tgctccatagcccacctctgggccctagtcttttccattggaactaactctagaggtgacctcttccagcccaataactttaaagcccacctatttgcccataggtgtctccagccctggccttcctgtggaaggaccataatcacttggcagccacaggatatatcaaaaatgagtcacaactcttgattccatccacctccaaaatccaggtattttccttaattctcattctttcacaactccacatatatccatatcctcattatctcaggacaacgtgaccatttcttgccacttcccaccacttccatgcctaccaaagaagcctatcttctctcaccaggaccactgaaaaagtcttgcaactgatttcccttgtcctcttcttgcctctctacagtcaattctctatacaacagtcancagtaagatttgtttaaaaaaaaaa

SEQ ID NO: 654025 - DNA, 628 bp, Homo sapiens
  misc_feature (426)..(426): n is a, c, g, or t
aggcaatcaggggaaagatgcagagtccaggttcacgccactctcctaaactaccccggcataaagtgacgaccagcgaggatatgctctcaatcatggagaaatgggattcttgcatttttattatgaccttaccctgtgtgggctgccagaggacccagatcttcaggtttctgcgatgcagcaccagacagtgctggaactgacagagactggggtggaggcggtggcagcctccgccatctctgtggcccgcaccctggtggtctttgaagtgcagcagcccttcctattcgtgctctgggaccagcagcacaagttccctgtcttcatggggcgagtatatgaccccagggcctgagacctgcaggatcaggttagggcgagcgctacctctccagcctcagttctcagtggcagccatgntggtgcctgcatggacattggcgcgtgccacctcatgcttgaggtgtccggtatccaccaaaaggggtccctgagggtatgggcaagggacatgcttttattagcccttggccatgggcgggccatggttttccaaccactttttgggggtttgtgtaggtgagggtgaccggactctataaattagacctgtcagaccatg

SEQ ID NO: 654026 - DNA, 330 bp, Homo sapiens
acagctcggttgatatatcaccgtagtgtcatcttatagtgtctgtcgttaatcatcaggtcgtagttacgtcgcactgtcgtggttatattgtcagaaaacatgattagactaattcattaatggagacttcaagcttatcctgatcggctccagaaaaagttcacccaccttatgtcccttcttaaaacactggactgttggcatgcattagacttcagcactctgaagcaacatcctgacagtcatccacatctacttcaaggaatatcacgtcggaatacttttcagagagggaatgaaagataggcttgaatctaaatgcaatca

SEQ ID NO: 654027 - DNA, 929 bp, Homo sapiens
cgttcgggtggtggtggctgtagcgcttcggagacactgcctccgcccttccccggcctgtcagccggagtccgagggggcggccgtgggatcagatcccgtggctggggacagcgacaccgagggggaggacattttcaccggtgccgcggtggtcagtaaacatcagtctccgaagataactacttcccttcttcccatcaacaatggctccaacagaagaatgggatccatgaagaacaagaccaaaagccacaggagtctctttgcagatgccacagtggagctatccttgcaacgagcacacaaaactaaatcagaagaaggtgctatccaggaaacactcatttctcttcctcctcaggaagaccacaacacttcttcgtacattccccatgtcaacctatgcaggatgctaggatggatagtaacgaagcacgggaggactcagatttctgacttggagcacgtcgagtcataatctgactccgtgcagaagcatagggtgatgagtatgcaatgccatatggtagcgctacagaaggttaacagacactagacatagcttaccaattgttcacgacagcaaaagcagtttgcaagtaaatagagaacgcattatcagtgcacgtttgcttgggttcttctactgagacagcatttcgcgagcaagcgactcctcagaatggacttcagtagtcgcctcgcagcccgcgggagcaatgagcctacataggcgatgaacagaagtgaatcgtggcggaacggacagatccttctatctgcagaatctcttgagacgtcggagggcccgctttagaacaggtacccttcagcaggattgtaaatcatcctaccatgtacgaggaccctgacgtcagagaggtcttggacacaacgaacgagctgcgcacgtgccggggtaccag

SEQ ID NO: 654028 - DNA, 283 bp, Homo sapiens
tgtggcatctccacatgtctcctttcctgactgactctcagggcccagaggctcaggccaacaggtccagcagtggtcattctcacactttgtcctgggcctttaggtcctctgttccctgagtcatcagcacagggagtcctgatcagagttggggtcctcaagaaccaaaattctcaggctcttctgggtccctgccagctggggcctctctcttgagcaccgaggtagaggtcagcccccattcttcctgcctgcgcagaacccggggcacatacaaagg

SEQ ID NO: 654029 - DNA, 245 bp, Homo sapiens
accccccgggccctttaaaaaaaaccccccttatggaatttaaaagggttaataaatttggcctagttgataaaaaggctgtgggacaactgaaggagaactttccgaccctaaaacaggtatattacttagatgttaaaattttttagtggggtgggcaaatgctggggtgtcccccccaacatattttaatatggttttttaaatggttttcccccagcctaaggattaaaggatatgggcca

SEQ ID NO: 654030 - DNA, 137 bp, Homo sapiens
gtcctctagccaatctacctaattacctagtctacctaaatacctagtcataacgtagagttacctaaatatttaacttacctaaccctagaatatttttacttgtgggactataaatgtcccagtttcttttcttt

SEQ ID NO: 654031 - DNA, 385 bp, Homo sapiens
  misc_feature (125)..(125): n is a, c, g, or t
  misc_feature (279)..(279): n is a, c, g, or t
  misc_feature (308)..(308): n is a, c, g, or t
  misc_feature (315)..(315): n is a, c, g, or t
  misc_feature (341)..(341): n is a, c, g, or t
  misc_feature (357)..(357): n is a, c, g, or t
cagtgaaaaatagttaaattatcaccaacctcactgataaaaattcatctgaggtataactgacatctattgctaatggaatgaagatgaatgaagtagcttctaaatacaatgccttatctttncactatctggactagctgtaacctacccattccagggttttgtttttgtttttaaatttggggacttgactggaattgacttggaaaaaacaacgcagcacttgccatacttattatctgcctaatattgttaagatctaaaggcaattagganattctcaaggtatctaaatctgatagcanatactcntcttttaatgctttctaccttcccantgaggaaaagcagctnctcgtgggaaatgttcaaatctaccagg

SEQ ID NO: 654032 - DNA, 2979 bp, Homo sapiens
cacgtacgaaagttagaggttgagtgagcaagtgggacagatgaaaggtcagaagatgtggccagaggagagaatttcagagctgaagattttagaagcaaagcaaacacattctggatacacgtgagatccaagtggtgactgtgctactgagaagctgaacgaaatggaaagcaaagcctgttggagctgaggtcaaagaatgtgaagccagagtggatactgaatgggaaagttaataacaaggatgtggaagctattgaggagacggagtgcgcctaaagagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 654033 - DNA, 254 bp, Homo sapiens
  misc_feature (246)..(246): n is a, c, g, or t
aggatccccaaagcagttaatacagactcattttcatggtttatgtagagcttcaattttgtctaagcctttacattcttcaatcattatactaagtttctcagtttcacctagtttctcagcagcctgaaaggatatttgaaacgggcatccagggataaccatgaataatctatggtatcgttttgcagttacagaggttcatcaagcggttctattatagcccacagtgaacacgggtacacnaatctgtt

SEQ ID NO: 654034 - DNA, 1736 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 654035 - DNA, 1235 bp, Homo sapiens
agctgcttactatggaagatgaaggaaattctgacatgttagtggtgaccacaaaagcaggccttcttgcagttgacaacattgcagcaaacaccaatgcacacagacacacaagacagcacactgttcaaagttcaattgccggttctgcgaacacaagcacaacagcacaacttcgagacacaagttgggagaatggacaagagcaacttaaccgatgcagcaaagcaacagcatgtgaccaactgcaagcgagaactaaacagggtcttactgaagtcaacacaaagcttcaacacatggcaccacatgaagcagtttcaagaagaggttctagtgcatgctacatccaaagcccatcagcttgcaggcaagatattgtgtcaagtaacaccataaagccaattgccaacaagcaaaccggcaattcagcacagtattcaacaggacacaactcgaagcaaggcaccaaccatgcaacagagaacgaacttgacatgtcagttctgcaagaccagcagcacaggatgcaccacaggaactatcataacggtacattcgcacagcaatacagaaactagaaaaataccaagcttatgtccagaggtccagcacttcaaaacaaatctagatcgggacgacaaaggacaagcggtgcatcacctcactttcacaagaccgcagattgggccagcgctgcagccaatggtcggctggaccacggcacatctgcaaacgcacactcacctgccttaccaacctcaactcacagaacgcatccggtctacaaaacgaagccaaacttcggaacacgacaacagggaaacaggatacaagagcaaagcccgcgcgcacgacagtgcaatatccgggactacagaaaccccagtcaagtccggccaacggaccgcacacaagacaggcgtgccacaccggctcaggcaccctcggccaaccccgcacaggcgaaccagcaccagacagaacaaaggaacacatcagaccacgcacgcaccaaccacgaacaacaagcaccggtaacaaaccagaagaacagacacgcaaacaaaaaaaagaggaagtgacaaaacaaagaaggccagacgcacgaacaccaccgacgagaacagccgcacacagggcagaagatcgcacaaagacaccgagaaccgaccaaacaggaaagcagaaagagaaaacaaataaccccgcaagcgccacctgaacgaaagaaa

SEQ ID NO: 654036 - DNA, 863 bp, Homo sapiens
  misc_feature (800)..(800): n is a, c, g, or t
aaacttacggctaggtacgaggcctgggtgttagacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggctcacagttanacatgacaccagcaagccgcaggattgtttcttgaataaaaaatttattggaattccagcggg

SEQ ID NO: 654037 - DNA, 625 bp, Homo sapiens
tctctctcctcccgccgcccaaaatgccgaagggaaaaaaggccaggggaaaaaaggtggttccggccccagctgtcgtgaaaaaccaggaggctaaaaaagtggtgaatcccctgtttgaaaaagggcctaagaattttgggctttggacaggacattccagcccaaaagagacctcacccgttttgtgaaattggccccgctatatcaggttgcagcggcagagagccatcctcatataagcgcgctgaaagtgcctccgtgcgatttaaccagttcacccaggccctgtggaccgccaaacagcttacttcagctgtgctttaagctgtggcccacaatgtttacagaccagagacaaagcaagagaagacgcagacgacttgttgcgcccgggccgagaaagaaggcttgcgtggcaaagggggacgttcccaacgaagagacccacctgtgttccttcgagcaggagttaaacaccggtcacccaccttttggtgtggaagaacaagagaaggcttcagctgtgggttggtgaattgccacacagaggggtggattcccattcgaggcgtggtgtgtctctcttgccttgcccgtggtgtcgttaaaagggggggggtcc

SEQ ID NO: 654038 - DNA, 678 bp, Homo sapiens
  misc_feature (1)..(1): n is a, c, g, or t
  misc_feature (78)..(78): n is a, c, g, or t
nacaggattttggtacctgcttctgggaatttgccacgacctgttaactttacctatgtgagggaaagggacaaaganacatcttctttttcttcccagacctcaaccttgtaggttttaaagagccttaaagcatggtgccaaggggtcttaggtactgcaaaccaaagcctttaggtatgctctaatacggtgaaaacaaaggacagaaggtttttaggttagaaacctttagccaatagaggcatatggtatgttgtaaagctggaaccaagtttgcatttttgagggctttagatgaaggatagtctcttatcagatagtaagacagtgcagttttcgtcagttttcttgtctgaacactaatggacaattctagcactttgtttgaaggatttcagagttaacctcatgaaattcagtattttttagcaagtttgcttttggttttatcttggcttttagtaatcatgttggctggtctggtcacaggtgactgtgaaacatatgccctggtcttgctttcatcactctaggatcatgaagtgctatggtatttcctggtctatgaatattaaggttggaatgtacatttttattcattgtttggatcagatgctcagttcctgtagaaaacgtgctgtaaaagcccatgcaacaggctaaataaaacttgaa

SEQ ID NO: 654039 - DNA, 931 bp, Homo sapiens
agcggagggttacttaccggggctgactccacagaggaccatggtgggacctattaagcctaacttcctcactctccttctccctctgacagagtaacctttctccttcagaagttgtacagtggtccaaccacagggtgatggagtggttacgatctgtggacctggcagagtatgcacccaatcttcgagggagtggagtccatggaggcctcattgtgagtggctctctggcctagcccacctgccttggtgcaaatgggatattcagaaacttatttattaaggacaagacacaaaagctaacgaaaaaaaataggtacttcatctggaggtcttgcataatttgatgtctcaaagtattttgataatttgtccttgagaattaatatacctcatggaagcaagatgccttctggcagcacctccttggcatgagacttgaggattctaggtcgatgggttgcatggagaccaacgcttacaaggcgagggaacagcagggctgaggaagggacggggaagccgtaaaaatgcagcttcccacttgctgcaataggatccctatcactactcagatctgtcagtggcaaagccagaggggaaatgaggaagtgtggtggcttggatgtcatccagagaagatcctgagagacagcctcaccaaagaggtcccagttctctgctggcctgtgaaaacaaggtggtcagtcagcacatgtgctagtatgtgctcagagccaggccctgtgccagccagtgagtggagtgggactcagaacaagtgactgagctcctgtccctcctctggaggcacccccagccccaacaggccagtctctcagcatcctccccctcgagccatttgtatttgctcctggccaggcttgtctctggttccttcttagatcctggagccacgcttccctgg

SEQ ID NO: 654040 - DNA, 98 bp, Homo sapiens
  misc_feature (80)..(80): n is a, c, g, or t
tgcatccccaccatcaccatcattaccagcactaccatctctaccactaatatcatcatcattgccaccaattcttttcncgcgcatgctttttcacg

SEQ ID NO: 654041 - DNA, 442 bp, Homo sapiens
tccccgtcccacgcacagttgaggattctacgtggatctctcggctcccctggtgtgtgtgtgtgtgcggaggaggccgcggcccttagatcacattcattgccttcttccaatctcaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaagtaagttggtgccgttgatcctaattatattgcttagaatttttctttttgattgggcaaagagtctatgtaagcccctggtccaatagacactgaaacggcagtcaaaacagagtgttcatgttcaaagagaagattctgagatattttccagggccaagagaaggagaagtatgaaaga

SEQ ID NO: 654042 - DNA, 3573 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 654043 - DNA, 2974 bp, Homo sapiens
gaggagtaacacctcagggggcctcagctcctttttcagccattccctcaagtacttggaattccagccagtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 654044 - DNA, 317 bp, Homo sapiens
acccccccttttttttcaaaaccaaggggtttcccaaggaaatggcccccctgggccgggtttttttgggcccccccccggaaaagggaatctgggtttcccgggggggggtgttttttgggggatttccccccaagggggccccaaaaggtttttcccctttgaaggttttttaaaaatttttcccgggggtttttttttttttaaaaggggggccgggtccccagggggggggggggttttttccccccaaaggcttttttggtttccagggggggggggcttttttttttttttaaaaggggttttccccctta

SEQ ID NO: 654045 - DNA, 309 bp, Homo sapiens
tacagcttggtgctttccgctctcacagaagccttcagacattcccgctgccggtcttggcatcttcgaagtaaggagagttttagatgcttctggatgttcgatgctagctcctttacagactgcagcagctcgatttgtcttcgtattttctttcctgagcactataagtgctgggctcccatctttttttctccctttggtgttccggagttctgctccatctccaccataaagctggcggccctcggctttggcgcatccgtagcggctatggtgtccttccctccccagtggtatcactacttt

SEQ ID NO: 654046 - DNA, 3729 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggaaaaactggcggagagcctcagaaccacctgtttcctctgctgcaccatgcttgagtgtggaagccgtgcccctgttctccacagcgtgtatggccattcggcacatgtgtagatttgctgaatgagcaaacagcaactcctccagtttacagactaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 654047 - DNA, 2906 bp, Homo sapiens
acagtgttgggggagggaccaattctgaagaccggggactgtattattccatcccatcattagcccatggtctttccccctgtaatgttcttcccttcttgcctttaaccagttctcatttctcaaaattcagctcagcttttctcctctctaaagctttctcagccttccctctggtgagagggagcccctctctcccactgttcccatattgtgttacaggtgttggagccataagagcattgcacattattctgttaccctagtgtacttgtctgtctcccagatgtggggagtgcttgctccagacctggcacagggcctggcagggagtagatgttgctgatgtttgtcgggtgaccatatcaaatgggattttctcattgaaagcaacaaaatttggctctggctaacctaagccaaaaagaatgtttttaaaagagtctgcagtggctcgctgaatgaaaggaaaagctgaagaaccaagatcagaaagggaaggagcagaaaaagcccaagaacccaggtctcaggactgtactactgggatatgaacatgatctaagctctagggtccaggaaggagaggcaagctggcccagatggactgataagcctatcacacccccttgcatcttgaaagagcaaggcatctataatgatgtatccaccatggctgcacccagggaggaaatgtctccctaaaaggaatcatgtgaagcagggggaaagatggtggtgggtcccccaaacagactgtcctctaccgtgactcttctgtctctggtgcagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 654048 - DNA, 259 bp, Homo sapiens
  misc_feature (41)..(41): n is a, c, g, or t
ggccagatcttgtggctcactgcaacctccgcctcccgggntcaagtaattctcctgcttcagcctcccaagtagctgggattacaggctaatttttgtatttttagtagagacggggtttcaccgtgtcggccaggctggtctcgaactcctgacctcaggtgatccacctgcatgggcctcccaaagtgctgggattacaagcccgagccaccgctctggaccctttaagtcatttctaaaagaagttatgttcact

SEQ ID NO: 654049 - DNA, 505 bp, Homo sapiens
ctcctatctgaatccagattgcgggtaagtcattcatcatcatttctcctcaaccgaacagcaagtctcatcccactccaatatgatgtttgtccccacaaattgatacacataattcttgctggccgtggtattgacttaataaatgaaaatcatgagatggcatcagactttactttatttgctagctcagcagaatttgattcctagtctgataaggaaaccctattttccctcagacacttttcactttatgtcacaggtttggttcccagaggaaactggatgtagatgaagcttcgtgtgcatgatgttcattaggaagtgatgtggggatccacatctgtggaaaggataggcagggaagccttatgtgcaaagggacaagtctactggcagtgcagcctgacattgtcacctggccacacggacagagctgtagagctaagaaatcctcccctatttgtcccaactgaatcaaatggcaaagcctatgtacccctcc

SEQ ID NO: 654050 - DNA, 3551 bp, Homo sapiens
  misc_feature (17)..(17): n is a, c, g, or t
gagcgggctggccagcnggtccccgggaacaggaaccctggtggacgggtccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacggacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggaaaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcaaaaaaa

SEQ ID NO: 654051 - DNA, 258 bp, Homo sapiens
ttcgcggcgctcgaccaaatagcacatagagaggtactgcccgctgaagaggctatcccaccagccaacttaaaaatggtgtagagagaacatgcaggggaagagcttggcctctgaggttctgcagtttcatcctattttctttccctgaaagccagactctacctcgtatgagtatgtgtgtcctttcggatactctcctgcgcatcatattcacaatagctctgtgagatactgatcaagagcatctccacgttt

SEQ ID NO: 654052 - DNA, 102 bp, Homo sapiens
ctctagacgatccccagtagttggtgaagggccatgcctactctgtgaccggggccaagcaggtgaactaccgaggccaggtggtgatgcctgatccggatt

SEQ ID NO: 654053 - DNA, 170 bp, Homo sapiens
gttctagagatccctacagctgatgtaaggatgggcacacctgacgacatcgacgagtgtagctcaaggcgccggaatcctctgcacctttccgctgtcgtcaacgtgccagtgagctaccagtgtgcatgccctgagctgggaaccaccatgacggccaaggggaaggt

SEQ ID NO: 654054 - DNA, 82 bp, Homo sapiens
tggaaatccctctccccctgaaccattttcaaattggaaatgaaggacctggactgttgattaaaaagttacttcttcttta

SEQ ID NO: 654055 - DNA, 455 bp, Homo sapiens
cacgaggaggtgggggccatcggcgtgatcctgtggatcggcggccacgacgtgctggcgggacggctcaccgcgggggagctgtcggccttcgtcttctatgccgccgtggtggcgggctccgccggggccatcagcgaggtggtcggcgacctgcagcggggcgccggggccttggagcggctgatggaaatcctccgcacggaaccggagatccagcggccggcgcggcccgtgcccctgcccgagccgccggtggggcgggtggagatggagcgggtcaccttcttctatccgtcgcggccggagcacccggccctgtacgacttcaccctgcgggtggagccgggtagccgcctggcgctggtgggcccgtccggcgcgggcaaaaccaccgtgttcctgctgctcctgcgcttctatgattccgccgccggcttcatccgcgtggacgg

SEQ ID NO: 654056 - DNA, 445 bp, Homo sapiens
gatttaaaagtctcattattgttattatttttccaaaaccatatgatactttgggaataagtttggtcttgaagtcagaagacctggaacaaagactttctgttgacacatattagctgcatgaccttgcataagtcatgtaatttaccgggcctcaatcacaccatttgtaaaagaaagatgctgtccactatcttgagaaccccccagggttgtggtgaggacaaatgagacaatgcagaaaaacagggctgtgaaaactgtcaaatgctgtgcaaatgggtggagttgtcatttgccacactcctctttagactaattttttagataacagggatttttattagtgcctcttctatgctcactttgttacatgagtccttgttggagaaatgtaagaaataaaagcttggaagagttcatggttcaaatgagagactaggag

SEQ ID NO: 654057 - DNA, 121 bp, Homo sapiens
acctcctaccccagggaattagacagaggagtgaggggagatttcctttttccctgcctaccctttggtagcttttgtattttatagtatgcattatctggtcgaaaagagcattaaattt

SEQ ID NO: 654058 - DNA, 658 bp, Homo sapiens
  misc_feature (45)..(45): n is a, c, g, or t
  misc_feature (182)..(182): n is a, c, g, or t
  misc_feature (203)..(203): n is a, c, g, or t
  misc_feature (205)..(205): n is a, c, g, or t
  misc_feature (209)..(210): n is a, c, g, or t
  misc_feature (214)..(214): n is a, c, g, or t
  misc_feature (226)..(226): n is a, c, g, or t
  misc_feature (229)..(229): n is a, c, g, or t
  misc_feature (232)..(232): n is a, c, g, or t
  misc_feature (247)..(247): n is a, c, g, or t
  misc_feature (249)..(249): n is a, c, g, or t
  misc_feature (255)..(257): n is a, c, g, or t
  misc_feature (259)..(259): n is a, c, g, or t
  misc_feature (265)..(267): n is a, c, g, or t
  misc_feature (269)..(269): n is a, c, g, or t
  misc_feature (273)..(273): n is a, c, g, or t
  misc_feature (277)..(277): n is a, c, g, or t
  misc_feature (286)..(286): n is a, c, g, or t
  misc_feature (288)..(289): n is a, c, g, or t
  misc_feature (296)..(296): n is a, c, g, or t
  misc_feature (438)..(438): n is a, c, g, or t
  misc_feature (463)..(463): n is a, c, g, or t
  misc_feature (469)..(469): n is a, c, g, or t
  misc_feature (501)..(501): n is a, c, g, or t
acacacacactcttggagagagagcgcaaggtgtaaagaggaganagagtgaacagggagcggggcttttgtctgttggtctccctggactgaagagagggagaatagaagcccaagactaagattctcaaaatggtttattacccagaactctttgtctgggtcagtcaagaaccgatttncaaacaaggacatggagggangncttnntaanggaagacttccngtnccnaaggaagtgaaccgnangaagannnangagacnnncnctgnctcnctgactccncnnggcagcngtgaattcacctctccagctaccagttacctccaccctttttaatcgtcccacctccatttgtattgcatatggtgtatggggttttgatgaggtcttggtatcatatatgggatttttttttttctgtgtaaatcatcaantataagaagaaactatgggactctnagcctngctttagagaatttacagtggacaaataggtntcatcaaaccagtttttaatcattctgactcaagtgaaaacgctcagaatttcacactgtgaatccacggttaccacccctaacagttggcctcaagccgggtcggtcaacaacatggtctcccacaactaaatctcccacggtgttacacacaacg

SEQ ID NO: 654059 - DNA, 320 bp, Homo sapiens
  misc_feature (18)..(18): n is a, c, g, or t
  misc_feature (95)..(95): n is a, c, g, or t
  misc_feature (281)..(281): n is a, c, g, or t
atttcggcacagggactntttttctctgaagaatcacactggggctgagtgcagtggctcacatctgtaatcccaacactttggaggacaaggtnggcagatcgcctgagctcaggacttcaagaagagcctgcgcaaaatggcaaaaccccacctctattaaaatatccaaaaattagctaggaatggtggcatgcctctggtcgcagcttctcaggaggctgagataggagaatcacttgagcccaggaggtggaggttgagccaagattgcgccactncactccagcctgggcaacagaaccagatcctgtcttcaa

SEQ ID NO: 654060 - DNA, 237 bp, Homo sapiens
gaactatagaagacttaagtcattgaatgttgaaaagaaaactgactgttgcatattgtctgcgtcactctttcaggtaacactctatgtatgtatgtttttcccttgtagcacaaccattccttggatccgtacaaaaaacgttattctatttctgacaaaactctcggagtaagcaaaacaccatgactctggataaaaaatagacaagcccgtctttctctgggagggaagctt

SEQ ID NO: 654061 - DNA, 102 bp, Homo sapiens
tgatgacgaaaggattagagggaggcaagactgggacaggaagagcagcttgcaatgtgtctgcagtccaggctgaacacatacagaggctctccactagga

SEQ ID NO: 654062 - DNA, 739 bp, Homo sapiens
ccacggcagcaacggcgcgcggcgccgcagcacgaagacagcacatcctcagggcagcggtcgtggccaggatagtagagcgacagtacgcatcttgtgccctcatagccgaggcaatgcgactctcacggaaggcagtgaagcgtcctcctaactggcccacgccatacagcaagactacaaaggatacagcacaatgcaaacagggcatcgccaacgcacaacaacccgcagacgaagcacgcctgggtgccagccgctccgtccggaacgggaccagagcattgagcgaggaagaaacggacgtggatgccaatagtgcctaccgctccccctccccagaaccgtgcaagcaactaagaggatttgggggcacttacaggattctgcaaactcatcgttggtatgagtgagatagtggtaccccctatatcacctcatgaataaaaactaaggccaggcacggtggctcacacctgtaatcccagcactttgggaggcccgaggtgggcggatcatgaagtcaagagatcaagaccatcactggctcaacatggtgaaaccccgtctctactaataaatacaaaaattagctgggcatgcgtggcacacgcactgtattcccaagctaacctcaaggaggctgagaacaggagatatcgctatgaacccggtaagtggaggttgcagtgagctagagatcacactaagccggcagcctggtacatccaagttcttt

SEQ ID NO: 654063 - DNA, 127 bp, Homo sapiens
actagaggatccggtcgtatcaaagtagtctgcttggtcatttgtcctgttccctcagaagcatgtgatcttggttctgcttttgcccttggaagcatgtgatcttggtacctactctggaaaggtg

SEQ ID NO: 654064 - DNA, 266 bp, Homo sapiens
ctgaccccgtacgccaaaaggcggaaggagtaggactggaagtaagaatagaaagtttcttagtcactgtgatgtaacaactctgaactttagaacaaaaggtacatcttttatacttgtgttaaagtgaaaaaaataattctttaattgtgtaatgtttcatatgctttttaaaatacccatatggaactgttaaaaaggcagttgtatatatgagcctagagctccaggtctggattaaagatacacacttgggcgtacgggga

SEQ ID NO: 654065 - DNA, 603 bp, Homo sapiens
  misc_feature (428)..(428): n is a, c, g, or t
  misc_feature (579)..(579): n is a, c, g, or t
gtgggcgcctgtagtcccagctactcgggaggctgaggcaggagaatggcgtgaacccaggaggcggagcttgcagtgagccgagattgcaccactgcactccagcctgggcgacagagcaagactctgtctcaaaaaaaaagccaggcatggtgtatttggactgtggtcctgggagatggaggctgcagtgacctgacatcacactgctgcattctagtctgggcaacagagtgagaccctatctcaaaaaattaaaaagttaggtgaggctgggtgctgtttacacctgtaatcccagcactttgtggggctgaggcaggcagattgcttgaggtcaggggttccagaccagcctggccaacatggcaaaaccctgtctctactgaaaatacaaaaattagctggtcgtggtggctcacgcttgnaatctcagctacctgggaggctgaggcaggagaatcacttgaacccaggaggcagaggttgcagtgagccaagatcacaacactgcactccagcctgggcgacagagtgagaccccatcttaaaaaaaactcacggatatcctctgttggnggagaagccattttgtgattttcc

SEQ ID NO: 654066 - DNA, 208 bp, Homo sapiens
atatgagtgtggttcatggcacgccagatcaattacaatggtaacatcaaagatcaagaattaccaaaatgtgacgcagacacaaagtgagcacgtgctgttaaaaaaatggcactgatagatttgctcaacacagggttgccacaaaccttcaatttgtaaaaaatgtaatgtctacaaagtgcaataaaacaaggtatgcctgtaa

SEQ ID NO: 654067 - DNA, 344 bp, Homo sapiens
  misc_feature (44)..(44): n is a, c, g, or t
  misc_feature (89)..(89): n is a, c, g, or t
tttaaatcccattatttaaaaattatccctggtagaaaatcctnctaaggtttattaatccaatggccatcaatgaaataagatttgtnctgaatgtatgaccctatattagtccctttgggaggatataaacatttgtgggagcgtgcttgcccctagtttgtatgttaggagaagagaaaagtccctaagaaattaaaatatggcccagaatgaaagaatccaaatgctcaggaccttttgcaggagaatggaattaatctaaaagaaagaatggatcccttggttttttaatgaaaaaaccttgggaggaccttttaaaattaaagattttttttctttga

SEQ ID NO: 654068 - DNA, 648 bp, Homo sapiens
tctcatgcctgtaatcccaccaccacacccagctaatttttgtatttttagtagagacagggtttaccatgttgacgaggctgatctcgaactccttacttcaggtgatccgcctgcctcagcctcccaaagtgctgggattacaggcatgagccactgcccccggccagaaatttacagatgcatgaaagtaggggcttggtttaaacattgatattgcttcttcttacactaagtaactccaccattgataatccatatgttaatgctggtatgcttatatgtatatgtctaactaacataatcttttgattcatttgtatctttgttccccttgccagcccatagaatctctccttactgctgctatatcataacggtgttaatttacctcctgtgagttatattgtgatatgttccgttctcattgttaattcactaattcggaatacccctataagttctctctttacttatactctttttcctcagtgtattcgtcatcttttgcacctattgctcattactcttcatcgcttttcctacttcgcatttagccaaatttcactttccctaatccctcaccacttgtatctcatccgtttccgttatcctttcttactacctggctcactcacattcttcctc

SEQ ID NO: 654069 - DNA, 311 bp, Homo sapiens
cgccgctctagagatccccctcataatgtgtgcccacatatgggaatgcttaaacagcagaaattgttcttacagttctagaagctagaggtctgagatcaaggtgtcagcagggatggtgcctcctgaggcccctctcctgggcttgtagatggtgtcttctccctgcatcctcacagggtcatctctctgtgtgtgtctgtgtcctcatctcctcttcttataaggacaccagtcctattggattagggcccacccatgtgacctcattttactttaatttcctccttactgacccatctccaaataca

SEQ ID NO: 654070 - DNA, 141 bp, Homo sapiens
cgggaacgtgtatcctctctcagtggggagccatatgaccaggcgagaggatctggaggcggaacttaaggggtgagaagagtaacagctcgtgaagtgtgacggccctgacttggatagtgtcgccgagaacagacaaac

SEQ ID NO: 654071 - DNA, 156 bp, Homo sapiens
tcgtatcatagccgtgcccatgcccgtacccgtgcacgttcccgagccggtgcccgccaacatcaggaagctttggtgtgccagatggtcaccacggaggaagaaggtgacaaggaggatacatgtgaagtagcatttctgggtgcaagcgaatca

SEQ ID NO: 654072 - DNA, 162 bp, Homo sapiens
cacagcttcatagtccccgcaatgcaatgagataacatctgcaaagctgcacaaaactgcaccatgtagtcaggcagcctcatcaaactttcagctttgctattgtctccattttcaactatacgcaaaaactcaacaggtggcaaagcatttcaaacaagt

SEQ ID NO: 654073 - DNA, 502 bp, Homo sapiens
  misc_feature (267)..(267): n is a, c, g, or t
cagtgtgtgtagaattatgcagctattattgtataggggctgatttttcttgttagcttctaataatgttagcttttatatatatgggtatgcttttgtttggtgcatatatatttataattgttatatcctcttactgaaatgactcctttatcattatataatgagctttcttgtctcttatagtttttgtcttcaaatctattttgtctggtataagtatacctacccttgctctcttttggcttccattggcatgacatatcntgtctttttctatccctttattttcaggctatgtgtgtctttataggtgaagtgtgttttctgtagcagtaacagatcatatgggtcttgtttatttatgcattctgccactctttgtcttgattagagtgtatagtgcatttacatttattgttattattaataagtaagtactttgtcatgctattttgttatttgttttctggttgttttgcgattttctcttccttccttc

SEQ ID NO: 654074 - DNA, 190 bp, Homo sapiens
  misc_feature (18)..(18): n is a, c, g, or t
tctagaggtatccccttnattgcaatcttggcggttgattggcgagcctctgagtcctggtggtagttctggcgcaccctgcgcaggtggacgcggctcgtcatggcggcgactaaggagaggcggcggcgcgcggcggatggctgcgcggcgcctggtcgcggcgtgcgggggccttgcgggcagtccg

SEQ ID NO: 654075 - DNA, 489 bp, Homo sapiens
ggacggagctgagcgtgctgggggtgcagatgtcgctctcgggtctagggacggcggacggagtcggtggtccctggcgcgatgggccagctcggatgttgtgctgcctgcggtgctgcagagacaggaggggactggccagagttccctctagaaggagatgcccggccgtgcagctggacacgcagcaccatgggaaccagatgttgttatctgtaacacgaatggaagaagaatatgtggaacaggaggttagtttagccagccgcaccctttacatcaaaaacaaaagctatttatgaattcaaaaatccagtccacaggaatctggggtatggtgttgcaactcagaaggtcacttgaatcagattcctcttggccgagatatgcaacagttcttgggtgattgagaaaattggattggggaaggcgcacttttaacccagcgaaacacaatttgacagggaaggaaaaaaattaggggacttg

SEQ ID NO: 654076 - DNA, 280 bp, Homo sapiens
gccggtttcccggcccaagtcccgtcctgcagcagtctgcctcctctttcaacatgacagaatgccgctgtgtccttcgacaaggaccttcctggcaggtggaatggccgcagccaatctccaagacggcggtaggccccatcgcgcgggtcaaacttgctgctgcaggtgcagcatgccagcaagcagatcacttccagataagcaatacaaaggcattatagactgcgtggtgcgtatttcccaggagcagggagttctgtacttctcgcgcggtaac

SEQ ID NO: 654077 - DNA, 1775 bp, Homo sapiens
  misc_feature (1330)..(1330): n is a, c, g, or t
  misc_feature (1769)..(1769): n is a, c, g, or t
  misc_feature (1772)..(1772): n is a, c, g, or t
tagtgggctcctatcgttgagctccatgtctataagccttgcagtctcggtgatgagcgcgactcgttgctagagcaccggctgaacggggcacgtacactctcttgaaacgataactcacacatgagcctggagagactaccggcaatcgtggcatattctctgtcagatatgatgaggatgacagagagggctgatcagaatttcagttcatgtatagtggggtcagtagtcagatgaatagacgtttgcgaatcaactgagagcaaagaatccgatcagggagcactacctgatcactgaattgctgcgtcgtgagaagttgagacgtcgtgctcatcggaccgaatcgcgtgtcgtcactttatagagcgcggagagggactagattgggagcttgcttcggcttagtagatgccactttcttgcgtttgcgatgaacatgcaagctcttaggcaggccctctcgagcgaactgtgagagtagcgctatgtactatgcgtatataccggtacgttggaacggacgcgtgcactgggcgaaatctctggcagtataggtgcttgacgcgcatgaaagccggggatgtctgcaagagcacgctggggacactgcatgggccttgacgtggtgggacgggcgaagcctagttcccgaggggtgtgcctccgtagagcagagatcggttgttgccctttgacaaggcctgttacttgtaacgcgaagtggcatcgagggggctttaaccggaaccccatggcttgcgaagtccgggcttgaagcgcaccaaggccagggggcagaacccgagaccgtgtgcagaagcacaacctgtttgacttaacaaagggcctgagactaaaagaattccatatcgcgtggtggctgtgttgtctggaccgtggcccttcattgtttacgcaaggggagctaactacaggccgttacctgtggtgaacgacaagcgccgttgagtgcgggttagaaagactaccaccgaggaccccactggaattggcgcgtctgcgtggccgagcacaaggcccttggggtgggggaacattatagctttgcgcccggccttaagggtctttgacgctcgcctgtgagctcgctcgagcttacgagagtttctcccccttttaagattaccccgcgttgggcggtcctaaggggtcaggaggagattgcccagcggtgcaaacagcttaacaatgggcgcagagaagacgtacctgtttacccggcgacacaatgtcccatgggtaggccccccatatggtgctggtggacaccatcacatttcgctatcctgggaattagtctccngtcttagattggcggcagaacccgcgtttgtttgactaaaagcgtttcagcacacggtaccaggagctcgtaggcacctcgtgcacaaggataatatctcttcggacacaagaggagtaataggcgggcacaaaaagagaatcggtagagtgagtataggtccgggtttgttgtaaatatgtgtgggccacaaaagcggggtagtgttacaacataaaggcactgttactaggtgggtataataaccacactggaattgttgtgatgataggaagatactatgacaacgatgtgttgtttcagttattgaatcgaagtgtgcgcctgcagagtaatagatgatattgaggtagatcatgagtagtgctatattgtagtgaagtacgaactagtagatgattgtgtgtatattgtaattatatatgtagagagggggggnggnagc

SEQ ID NO: 654078 - DNA, 670 bp, Homo sapiens
ccgcggtctctccttgaatccacgtcgccagcccggcgcctctgccgcgctacccctgcacacccgcccctctcctgtgccatgaacttgctactaccagcatcatgccctaccaatatccgagcactgaccccggagcagaagaaggagctgtctgacatctgctcaccgctatcgtgaccacctggcaagggccatcctggctgcggatgacgtccactgggagcatttgccaagcggctgaagtccattggacaccgacgaacactcgaggagaaccggtgcttctaccgtcgagctgctgctgacagatgacgaccgctgtgaaccccttgccattgcagggtgtcatccttccttccatgaagacacgtcttcccagaccggcggatgaatgggctgtactcttccccctgatgttatctaaattccacatggtgcgagtgctggtgggcattcaaggctccacaagagtgcgttggtcactcccttggtcagcgaacacatgtggcgaagactagcaagctcaagggggttaggcactgtcgctgtctgtagctgcatggtgaccctagttacaagcaaggatcggaggcatgaccttcgccaaagatgggcagtagtgtgtctgagagacttggcagaacggactccccatcatacctcgccc

SEQ ID NO: 654079 - DNA, 94 bp, Homo sapiens
gaagagactcctcctcgccccctccctccccccctggcccctctcccctcctctcccgcctctcccttcccccctccccctcccccgtcctccg

SEQ ID NO: 654080 - DNA, 1078 bp, Homo sapiens
gctagtaacaatagctcgctatgacagattgaaaccgcagaacatcgccatgaacatcatgcaactcatcacgtaccattctccgttggcccattccaggaacactcgtctgaagctgctcaggcaatcaatgcgtatcgcatataccatgaagccacgacttatcctattacctgatgtaatctgatcgacaacagtgtatgaccatctcacggaccgtaactacactgtgtggcaatcttgagccaggtgctgcgctaggaccaaaagctgaatgaggttcgcatcgtcaccaaaaggctctggaggccgcgagaaacgagtgcctaataatagcttgctgaagcatcccttaaacccatgttccagcagagtatgtgcctgtaacctaaacaccggctttagtatagttcagaattcgtcttgccctcaatttgagcccctatatccccagatggagaccccaatccactaatgcatgccgccgtcatgacctactgagctcagtagctctgatttatacccaatacactcgagactctttctcgatgcccttagaggagttatccttacgtggaagggaacctactcgtgtccatacctcagaccaccactgaggtagccccgaggaaaccagatatcctcgaaaagactttgaaaactggattgactcatggggcctccgagttaagattctgcgcttgagcactccattgtaagttaaaaggcactgacgctccaccgaaaggagtcactggaactggaggacccgtcttctgggctgggtgtgaccaaggcatggatcttggggcccagtcccatgtgagagcagcagacgcggtcttccacatccttggccaggcctctccacaggttccgctttgttggtccttaggccccaggcctcccgcatctccactgtctactcacatgacccgtggctggggtctttcgtcccctttgcagcccatgcgggcgggttatggggcttttgccctccttttacgggtgggtccgaatgccaacccctctgaactccaggtcccctgtctgaggagagggagccccccccgggtgc

SEQ ID NO: 654081 - DNA, 545 bp, Homo sapiens
caaactttcagcatttgttatccaaaaacgggcttgctgggtgcacactttgtttgtgaccgaatgaaaatcgatgacatgatgtttgtcctgcaagggcagtggatgggcctgtgtaccagtgccccggaaagttaggtggcccggggcaaaaacatcctcaaaaatgccctggtattttatttaaatggcactactcctgtgtgtgaggacatcggaagcagcctcctgacctatggcccccgcatccccctgggtgaatgggaaagccggattgcggaggtggatgccagtgtggtacgtgaaatttgttccaagtacatttatgaccagtgcccaccagtggttggatatggccccttttaacagttcccagattacaaccggatccgtaggggcatgttttggttgggtttttaggggggaagcctatgtaagcaaaagggcagggccggggtttgtggtccccccccccccccaaacacagcatttgggttcttttaacctgtgccccaggtgccccccaataaaatcttttgttgaga

SEQ ID NO: 654082 - DNA, 166 bp, Homo sapiens
tagccgacagcatctgggtgtatgtctcgtgttcaagtatcgcagtctactgatatggctttcactattggtaaacggaccagagaagacacatgtctgtctctgaaataaaagcagaacccactaacaatggaaaacctgcagcaatgcaaactggtggccaatg

SEQ ID NO: 654083 - DNA, 509 bp, Homo sapiens
agccacaagcgggcgacttcggggaatccggcggaccaagagcgcgtcccaggatcgatcaggcgcgaacgtgctttcgcccttggctaggctggcgagcacgcttttcattttgcttgaagcttcgcgtgcccatcctgcggcaatacagtctttgactgggcatgcgtctgaagtgtgcagcggcagaaccataggcttttaggccaaactttgtgggcattggcgccctaagtcggccagggcgccccttgccccatcatgccgtgccgtgaaccaaatcaacgcagtgtgaccataagacaagatgtcagtccttttcgacttctcagcgccctttgacaagaatttgtataaaattctccctgcttttcgcgggagattggatatggcaagcatacccttcgagatgggcctcccatcttaatcagcggcacattagcagtgatctgagcgctgggcgcgtagactttgacgggcggagaaagtgacgtccctgaacatgacgg

SEQ ID NO: 654084 - DNA, 339 bp, Homo sapiens
tacagagtgaatgtatcaagcagacacctcgcgatatggtcttataggttgctgaacaccttagcaaaaaggcaaggcgcagacctagttgcaagtgtcatatatatagagattaaacgtgctgcggctgttcgccggctggcaaacagccctgtttcctgggctaaaggtcaggattccggggggggcgacttggcttttccgttcaccacagatgaatgctcagccaaggtactggtcaagcgacggattgcgtcctggtcttcctttgacatcgctcggtaattgcccaacactttttcttcgatctttgctcagttatccagctggatcggcgtt

SEQ ID NO: 654085 - DNA, 439 bp, Homo sapiens
ttggggctcattcaggggctgtcttattatatatatatggcccagctgtaactggtaacaggtccatggttcatttcgtgcagcaagtgagtatgcggagacacggggttgcagcagagaaaagaggtttaattggtagggttgccaaaacagggaaacaggaggaaccctcaaatccgcctcccagggagttggtgggtagagtttcaatttaagagttggagagtgggctgaagtgtggagatcatgggtcaaagtatgcagggtaaagtcatggcacagagagatgaagaagctatattcttacacgggttgggtttctctgggggggggcctttaaacggtggggtgtcagctattctggtgtacttcaggatctggcttatagcaatttttttttttttttttaaggaaaggggtctggctctgcccccaatgg

SEQ ID NO: 654086 - DNA, 307 bp, Homo sapiens
  misc_feature (258)..(258): n is a, c, g, or t
gcctacagcttactgcagctacctccaaaaatattaactaggggggcaccaactgacctgtggagattccctctaccgaaggctgtgacgtgagccctctccggaccagaggcagttagttctgacaccaacaaatggggataagaggttgatagcctagcagggggaaagaggcctcctccaaaccaaacacaaaaaatgacactgcacagcaggctggggacatgtccttgaaggacacagccccaaagatcctgnccggtgaggtagtgcccctaagatcaacaggcatcatcatgaatcctat

SEQ ID NO: 654087 - DNA, 957 bp, Homo sapiens
atggcggctccctgggcgtccctgcgccttgtgtcgacccccatgtgcaatgggcgtatcaggggcatccatcgcctgaggtgcggacagttggcccagagggcgaagtcagcacagagcggaatacagtgcacgaatcccttccaatattcgcgtgaccaacacttaatttctaacgatgtggagggctctgaagggatatactatgctcccgaggacggggaggcatggtaaccaacggtgcgtttgcatgaaaaaatcggagtctttaacaccttaggggctggtgcatggaaatggcaacattggtcccatcacgggggctgcaaggggttcccctttatattactccatttccccattgaacagcccccaggggaacgcgacgcggccagctccacaggctttcctgaaccgcaacacacgcgcaggctttgcgcacttcaacgggaccaaatgcactcaagcgcttattgcgcccacctgttccgttaccttaccaaggagaaggttatccgtgggcggaagagttttccccgtcgttgccacaagggtgatgcccgttggtccggcacacgaccttgggttggcgaacatatggccccgggtgtgttggaccgcgtggtcttgtacaccatttccaagacttttaccgggaagtgtgagtcgcccttttggtgcaacttaatagccctttgcctcttgcaccggccgtcctttgcacgcaggtgaacagctcttttccctaaagtgatccccttttgtcactcgcgccattggccgactgccacgtcggtcagcattcccccgccaaacctgaattttggtcatagtccgagacacccctgggaggtatgcgcttccataccacagagccgacgatgcctcttatcgttaaagaacctcaaatgattggtcgcccgcgagaaagctttccggaatctgatggaccacgcg

SEQ ID NO: 654088 - DNA, 839 bp, Homo sapiens
gggaggtagacatgggagactttcatttgttctgtactaagaaaaattcttctgccttgggaattcctgttgatctatgaccttacccccaaccctgtgctctctaaaacatgtgctgtgtccactcagggttaaatggattaagggcggtgcaagatgtgcttgttaaacagatgcttgaaggcagcatgcttgttaagagtcatcaccactccctaatcgcaagtacccaggacacaaacactctgcctaggaaaaccagagacctttgttcacttgtttatctgctgaccttccttccactattgtcctatgaccctgccaaatccccctctgcgagaaacacccaagaatgatcaataaaaaataaaataaaattaaattaaaaaaaaaaaaagagaggaacccaaaaaaaaaaaaaagaaggttttttaaaaatcaaattatgtgagagtcttttccccttttaagaaaagaaaaaagaagaggaaataacaaacatgatgaaaggaaaaaaagaagacgaaaaaagatgataaggaaagagaagaaacataaaagagtaagaactaagaagagagagagacgaaaaaaaaacaaaaacaaagaggacgagggggcgggcccgaaaaaaaaatatagccaccgggcgggggggagcgcacaacagattgcgaggcgcgcacacgtgctgttgaacaagaggaaggccccccctagagaggggggagcaactataagaagcacacgagacgggcgcggcggatacagcacagggggaggagaaagaacaaagcgcgcggacggcggttctggggagaggaccccctctgtgcggg

SEQ ID NO: 654089 - DNA, 1141 bp, Homo sapiens
  misc_feature (259)..(259): n is a, c, g, or t
  misc_feature (314)..(314): n is a, c, g, or t
  misc_feature (466)..(466): n is a, c, g, or t
  misc_feature (515)..(515): n is a, c, g, or t
  misc_feature (531)..(531): n is a, c, g, or t
  misc_feature (535)..(535): n is a, c, g, or t
  misc_feature (537)..(537): n is a, c, g, or t
  misc_feature (610)..(610): n is a, c, g, or t
  misc_feature (630)..(630): n is a, c, g, or t
aggatccgaaatgagcgtcccatgaccgtccctcgcatggaacctgtagatagcaatatccactgaagatggcgaaaatagtctgtttagtatgaacatttggcttgtggagtcttgtcatgccttctacttattgtgtttaacgaagaatcaaaggactcattcagctctcgatcaatagtctatcgacctgagaatatcagtcgagtcttcatttgccactgctctctactatctcttgatggttctgatcgcgaanatccttctatcaacacttgctagttccttcactcgaattgtcgtcgtgagtgccnggtacccgcgcttgcttgccgctctccgcagcacagtcgtttcgtgacgtaccttttttcgatttaggtcggtcgtctgggccccgagtgtgggatcatggtgaatactagtggtctccataggctggtttctctctaaggatccaatccgntggccctcaagtgtagcatttatgtgtcggcctatgtcggatttgtcgntcaatccacaaataanaaancnaatgggcgccctgagagtagcgggattactacagagcgcagctctccctggaatacctagaagacctctccangaatctgagtccgtcttctntgtagagcgctcaagtataaccataagggaactccttagatcaacaagagagagatggtccctaggtagacgtacgcctacgagtgtcgatacatttaggcgcgcacggcccccttggaaggctcccgggagggttgccaggtgtgggggctccttggcaaacttttaaatttgaactgatttcaatcctttcaaaaaaaagcaccaatcctccaggcccaggccgtgggtgagctcattggccttgtgaattcccccaaggcaactttttggggaacggtttcagaaggcgccgggacggcttggcattcgacccttagcaagggtcccaaacgacaagtttcatgcgacggaatccagagggccctatgcgggcaaaaaaccggataggaggtccgcaggacgccacgtgattctgtcctgagacatgacagacagaatttcacagagaggaaatatattagaccgcagtcagtagttatacacggatgcacgacctcacagcaccgga

SEQ ID NO: 654090 - DNA, 173 bp, Homo sapiens
  misc_feature (66)..(66): n is a, c, g, or t
  misc_feature (111)..(112): n is a, c, g, or t
gtactactctgtccggtcaattgggtccttctctaggctgtctctcacaatgtccctgctcatcanaggatctgatgctctctcaatggcttcttcatcgtcgtcgtcttnngaatccactgctgattctggcaacccactcgggtccatatcaccagcctcgctttctgtgg

SEQ ID NO: 654091 - DNA, 941 bp, Homo sapiens
agcctgaaaacctttatggctcaagatcagattccctgactaacccctctcttagagctacagcgagctgcattaccagcttaaaacacttcttagggattaaatatagatgtaatttttcacaatcgttcgtaatttaaactgtgtttaaaggtaaacattgttaaccttgtaagatggataacgtgtatccgaatgtcaggccttgaactatttcgacatgagtcaagaacacaagcgagctttcacaacacaaatcaattggaagcacaagtgcatggccacggtgactgaatgctgttatatttctaaaagtttctacatgtcagattatatgcctgcattcatagtaaaatacctctaataaacactgtctatacgaaaacctgacttcagtgaatatcctcccgtatctacacacttgggccagtttatatactgctatttacactattatttcctatagctacccatgttctcgtgtacctttcgcagtccatccgcaattcactacgattcataccttgatggtaccgctctatctggttcgggcccgtaacaccgtccagcatcgcactacacgacacctggtccatgtgacatactttccatgcattacttcaaacgatccaaccccactagtggaagtacggccacttcacaatatcggccggccgatcgctcacactgctctaaaccaccaagcatcctcacacgcttacgccccaacaaacaacacaacacaaccaccgtgcgcgccccgccccgaaccacacaacagcggggcgagcacccagaaaggaacaggaaacacgcacacacccggcagacaggagggtccacaaaagccgacgagctacacacgcgcgggcagcccaacgacagccacaacgccacgcaacaaacacccaaccggacacccccacaagacgcgacgagca

SEQ ID NO: 654092 - DNA, 1025 bp, Homo sapiens
  misc_feature (62)..(62): n is a, c, g, or t
gggtctaggtacgaggctgggtggtggaaggggtgccgactcgcctacctacgcgtctcttnattgtcgatatttcgtcggcataggtttatcgtagagacgtatacatattatatagacacacggtctttaaatctaggcctgtatccggtgtccgaggcgaactcagataggatgatgtgtaagaggaaagcctgaagcaagtgcgcgattgagtaaaaacccggcccgccttcgcgcccgtggtagtccggcggcaggagcgagagcgagccggcagggcgcggaccgccatggcgctcgctcgttgccgggggagcctggcgcacgcgcgcgcgccgcgcgcgcgtcctggagggaccacccggacgagggagatggggttcactagtcggactgtcgggggagtttgctctcgccgggcgaggacaggacgtactgcgcagcgcctgccgcctcttcgtggggatgtctgcccacgcgacgtcgcggagggggacttcctgaggctcttcgaacgctatggcgagcccagtgaatgtcttcatcagaccgggaccgtggcgttcggcttcatccgcttggatatccagaaccctggctgaaattgcaaaagcagagctggacggcaccattctcaagagcagacctctacggattcgcttcgctacacatggagcagccttgactgtcaagaacctttctccagttgtttccaatgagctgctagagcaagcattttctcagttggttccagtagagaaaagctgtgtggtgtggatgatcgcggtagagctacgggagacgggtttgtagagttgcaggcaaaacttctgccgaaaggtctggaaagatgtgggggtggggcattctgctaacaaggacccctcgtccagtccttgtggggaccctggggcgttgaggattaaaatgggttgccaaaagttatggaaaaaccacattttttgggaaaggaacacccaccgttgtgtaccgggattgatttggatgcacccagagaaggg

SEQ ID NO: 654093 - DNA, 100 bp, Homo sapiens
ttccatggaggtcagcgccgagtcgacaggcttgttggagagctcaagctggataggctgctcctggaactgaagcactcgaatattggccccttcccat

SEQ ID NO: 654094 - DNA, 200 bp, Homo sapiens
atcccctttctccgaaaggcaacatatttattggggaaaacaggagagcaagcccagagcagggggcatcatggaagaggaatgatggcagataacatgtgcacctagcctctgtgcaccctatcttgtcagggctggataccccagtaagtaagccctagcacaactcttcctctaccttctgggcaacatggatcggg

SEQ ID NO: 654095 - DNA, 441 bp, Homo sapiens
  misc_feature (397)..(397): n is a, c, g, or t
  misc_feature (422)..(422): n is a, c, g, or t
tcacaagttagatttaaggaaaagtggagtcaacaggaaaagattattggaaacaacatttacagtctaagaaaggagaaatagaaacttctgggcccttttaaggactagtctgccctgctgtacccaggatagcaatctatattcccagagctcctaggtttccctgcactgagcaactatatccatttcatatgaacattgtaaacattatacaacttctgtccaaaaaagttatacaaaattgagatatcatcacaatagccaatgccagcacaaatgaaacaactagcaaactattgtaaagcagtttttagatagtacataatactaggatataaactgtataagtaatacttgccaagcagagggcaataactaataagtgtgtgatacngggtaagggaaggttgaagaagtcngtggccaaattaaagattc

SEQ ID NO: 654096 - DNA, 1087 bp, Homo sapiens
tcccataataagaagcggccaaataatctagtaataaggtcgtatgtcatgactcacccatgtgcctggcatcatgcattgcacattaggtcattgcagcaatttatgtcgtctctacacacagcaccattcaagcacacagtaacacatgtcctgcagggcaacaaacaccccatgctggatcatttgcgtcggcgcatgcatttcagcatggtcaaccagcaagcattcatagaagcaactaacaaagtctatcttcatagcattatcttcagcaggccccgacagtatcacaatatccgcgctggctaggatccagagtatgttcgtgcacttcagctgcactgcaatgggcacagatgtcactttcgaagctcatcaagttgctgtgtgaagaaatctggttgcagaacaccacggattgaattggaagagatgggaccctcattggatctggttctgaggaggacacacctggcatcggatgaccttgataaaattatctatgaaaagtgccaaaagctctcaagccaacagcaagacgaaacaatatagcccagtgatacctctgggatacaagttactggcacggatagcatatgccagaagcaagaccctaacgcacaacgtaccaccaccaggaaaacactgacacggggggtagacaagaccagccgcacacggccggcccagggaactaaacaggaaggaacacacggcagaacacaacagtccacgacaacagaccctcgcacgaacacacttcgactcggacgccacaacacgaaaccaaagcacaacacacacaaaacacaacaacaccacgtgacgacagccgcagcgagcgcacgaacggacgacaaagagcggcgcacgaaacgagacgaccaacaaacgagaacagagacagcgagcacagcccacacaagctgacaagaaggaggacacaagcggagaaaaaggcagagagggagcagcgacagagacaagacactcgcggagagaagcgaacagccgcagggaggcagagggcagcagcgaaaagcagaaaagagacccgacagcgagagagaccggacgaggtgca

SEQ ID NO: 654097 - DNA, 203 bp, Homo sapiens
  misc_feature (21)..(21): n is a, c, g, or t
  misc_feature (196)..(196): n is a, c, g, or t
tttcatcgcccgctcccgggncatccgctccctccctccctccctctctccctggcaggactccccgccagccatccccgccactctccgcggcgcattccgggagcagcggcgtagcggcatcgccatgtcccagcccggccagaagccgccgcctccccgcggcccggcgagcaggccgcccgccgcacccatnagcatgt

SEQ ID NO: 654098 - DNA, 569 bp, Homo sapiens
gaataataataaaagaaaaagatttttaataaaacatttttaaaaacaaacattatacacatataaaggaaagaaaggttattaacaatcccattcttaactgcgtaatttgggaatttgttatatttcagcttaatatatttatagttatattgttcatagttggaggtattgatgcatgtgttggtttgccaacattatctctatgatattgatctctatttgcttgacggctgcccttcttaagatcatgaattacaatatattcaaatttgttttttctgaaacaaggaagaacagatgaggcagtggagtgcactgaaggtagtgtaagtctttggtttgaaaccaaatctcctgcatgctagttactcttgggattggtggagtgcttttagcctactgagtgcagtgatggaaaaaatactagctgtaagaaatgattttgattgaagaatattgtattttaatctttgaagttttattaatggacagacattattaaattgacacaatttttacaataactaatctttcagtgactttttttttaattttacatataagga

SEQ ID NO: 654099 - DNA, 191 bp, Homo sapiens
aacgtcagcactcctgtgtgatggcaagggacatctttcttggagtgaccgtcgtgtgcaggcccggtagtccgccacagggctctgagcatgcactggtcccggatgctagaatctgggggagcggacccactcccctcacattccgcaggcccatggactcactttggtaacatactcctaccaacact

SEQ ID NO: 654100 - DNA, 853 bp, Homo sapiens
attctaatcgcaacaggcagttgcctaatgcggttacgaagcgataaatgctaggctatatacaaatatccacaaaggccccaacgtagtaagaccctacgggctagtacaacctttcgctagtacgccgataaaatctcttcagccaaatgagcccctaaaacccaggctcaacagtctacctatcaccctcttagatcgaccgccccgagcttcaggtcttcacacatcggcgtccttcatactatggaccccacacttccgcacgatcccacggagcacccatgaggtcggaactcaaaacgtagatcacttcgcatatattatttcttcctcacaatggtcatatgaccataatagcggcagatttccaacacaacatcatggatcaagggatgagcatcaaactcaaaacatcacagccactgatcgggcgcccgcgccagagccgcctcgcccacaccgcggttcctcctatgaatgcttccccctccagccatcatctcatacctatgcagacccattcactcatgcggctggcttccatcaatacctctgtcctcgccctccctcatccatctccacacacgaccagctctggctatactccagtggcccattcagtgacccctgggaccatacactcatgcataatactccacccaaacaggtaagcaagaagatcaaaaacgaaaactcacatagagattgacgaacggcgacagtccgctacactaacacacccacagcagcgaccaaccagaaacacacacaaaggtcatcttccgccctctcctaaacagtcgacaacaccaccacatccccaagaccccacaccacacacaacaaccaa

SEQ ID NO: 654101 - DNA, 99 bp, Homo sapiens
aactgtggctgtaaacagtgactctgcatagtcagccttatacttgatttctttttgaatgcaaataaaataaaatttgtaagtccaccaaaaaaaaaa

SEQ ID NO: 654102 - DNA, 491 bp, Homo sapiens
cccccccgggttttcccttttattttccgggtttttattttgtgggaatttgtaagggaaaaccattttcccccgggaaccagttttgcccttttttcccccaggttgaaatttaccccccataaaagggaaaaaaagtgggggcccccccgggggggggcccttttaaaaaaaaggggtcccccggggcgcaagaaattgggcaaaaaccctttttccccccgcctttgggtttttaggccttttgttttcccccttttttcttttaaacccctccccccaagtggaaccccttcccccgggtccccccaaattttttccggggcccttggccccggggtttaaaaaccattttcccaaagccaaaaccgttttttcccctagggggggggagaaaaaaaaaacctgggcccctttttggtaggggaaaaaaaatttaaaagttttttaatttttttaatgggggaaaaaaaccagggggaaacccccca

SEQ ID NO: 654103 - DNA, 462 bp, Homo sapiens
gagcaccatgcctccagcagtgggagggcaggcgtgacgctgccgattccacatggtatctggaatgttggtttgggagatggagtttcgctcttgtggcccaggctggagtgcagtggtgcgatctcagctcactgcaaccggtgcctcccaggttcaagcgattcttctgcctcagcctcccgagtagctggggttacaggcgctggccaccacgcctggctaattttggtatttttagtagacgcggtatttcaccatgtgggccaggctggtgttgaacccctgacctccggtgatccacctgtctcggccttccaaagtgctgggattacaggcatgagcctcggtgcctggccttttatctggaatttaaaaaaaacaaattcaattgtagcccagttgaagctattacggggctggtggccagttttaaccaggggaaatcggcatccgggtgta

SEQ ID NO: 654104 - DNA, 116 bp, Homo sapiens
taaccccgtttctgtggcaacaaagtcacagttacccgctgaaaagggtttcttagaatgaggcccttgcccagtctactaccaaagggttgatgtggggatactggaattgacag

SEQ ID NO: 654105 - DNA, 310 bp, Homo sapiens
ggatggtgtttctcaggagcacatcggtgtgcaataaggacaattatcacaagtgtggagcacttggcggaaagtctgtgccctgatgtgattggcagcccgttctgtctaatgagcaactcccataaaaaagataattgagcaattgtctgttgaacctttattgttggctattcttgagtttggtgacctttaagaagacatttaaccgaggcaacgggcttcatggtgacttatgaccatcctagtaacctttactgtatctctctttctctttcttttcttgtctattcttttctttcttgcgttc

SEQ ID NO: 654106 - DNA, 419 bp, Homo sapiens
gtagatcgttatcaccatgctggatccgcagactatgatgcgtgatacactctatcactgtgaacagacatcctcagagagcctattacacatagagcatcctatggattctgagccatgcattgccactgacctaggactatgaccagatactcgtggagctccttcataccaatgtgctgcccgtatgaagtgcacacattgcaggcagacctcagatttgagcacagagctgttctttacatagctcagatgaccgtccatgacgtttaactaatctggatgccactagacgactgtactttcttgcctgagttctgcgcggcttccctacgcacgctccatcatagcaggctgtgcgacctaggattctatggtaccggtgattacagctgggtgcagctatcacatgcctaggg

SEQ ID NO: 654107 - DNA, 429 bp, Homo sapiens
  misc_feature (43)..(43): n is a, c, g, or t
  misc_feature (49)..(49): n is a, c, g, or t
  misc_feature (57)..(58): n is a, c, g, or t
  misc_feature (70)..(70): n is a, c, g, or t
  misc_feature (121)..(121): n is a, c, g, or t
  misc_feature (149)..(149): n is a, c, g, or t
  misc_feature (171)..(171): n is a, c, g, or t
  misc_feature (194)..(195): n is a, c, g, or t
  misc_feature (213)..(213): n is a, c, g, or t
  misc_feature (221)..(221): n is a, c, g, or t
  misc_feature (232)..(232): n is a, c, g, or t
  misc_feature (250)..(250): n is a, c, g, or t
gagtcccctgtcgaaacggttggcacatcagggagtaggaaanagaggnggacgcanngggataagtagnatctgggatctcaaagagggttgttcgttctggtctctacagctacagggntgatgtcccagaggcagacctctggatnaagcagagagcagcaggccagnctttctagcagactagggcgaanngcccacaggctctcctanactctgtnaggacgtgtanatttgtatctgtctgagncacgaagaactgccttatggtattagaaagggagaagagcagagaaggggagaattgatgaaaaatacctctttccctctcctatccaggtaaaaagcttattttgggggtaagtgggagtaggggatattcagaaaccttgaaaacgagaatcctagaaacaggtgtagatctctcca

SEQ ID NO: 654108 - DNA, 474 bp, Homo sapiens
gtcatatactccattcagctcggtcaactttagcacgggtctcgtccccaggggctttcccagaactagggccttcaccatgaagctccatgagcttccccaattcaaactggggctccttcagcattttaactttcctaccgaagacttcagggagaggataactagatgggcagccttttctatgtctttcccaaggctgtcgggaatcaatttatggaccacttcttccaagtcattggtctggacctctggggtcatgattcccatcatcttctccgggatgggggggacctgtgggtgctgagcataagaggtctccggaacctgatggtggcgtttttaagtaaacccaacacagaacagccaacgcaagtacccatgggtagtctggacatcacggtgagctccaatcatggtctggccattttgggcccagggaccccttttggtcaagacttcccggaggggggg

SEQ ID NO: 654109 - DNA, 84 bp, Homo sapiens
agcatatatctgtgcagcgttgtgacaggaaaaagtcgcggctacgagcagtacttcgggccgggcaccaggctcacggtcaca

SEQ ID NO: 654110 - DNA, 355 bp, Homo sapiens
  misc_feature (194)..(194): n is a, c, g, or t
  misc_feature (205)..(205): n is a, c, g, or t
  misc_feature (247)..(247): n is a, c, g, or t
  misc_feature (265)..(265): n is a, c, g, or t
  misc_feature (270)..(270): n is a, c, g, or t
  misc_feature (281)..(281): n is a, c, g, or t
  misc_feature (290)..(290): n is a, c, g, or t
  misc_feature (343)..(343): n is a, c, g, or t
gaattcggcacgagggtcagtgatcacgtggctgagcaggcactgatatggtgactgagcatgaactgatcatgtgccgggagccggggaggcattccactctggacaaaggtcatgaggaaggaggctcggcatacgcaaattcgggatcgagcctcaggagtccacccagatgttctcgaacatctcccccncaaaaaaaaanccggagtctgcctactgtattgctttgtgctctcacctctgnatttcactgggggctgtncccancatcatctcgntctctctgncaagggttaacttacagctcaattcataaagttccttgtcattaatcctttanttccagtgagtt

SEQ ID NO: 654111 - DNA, 957 bp, Homo sapiens
  misc_feature (5)..(5): n is a, c, g, or t
  misc_feature (111)..(111): n is a, c, g, or t
  misc_feature (118)..(118): n is a, c, g, or t
  misc_feature (125)..(125): n is a, c, g, or t
  misc_feature (149)..(150): n is a, c, g, or t
  misc_feature (185)..(185): n is a, c, g, or t
  misc_feature (217)..(217): n is a, c, g, or t
  misc_feature (239)..(239): n is a, c, g, or t
  misc_feature (270)..(270): n is a, c, g, or t
  misc_feature (278)..(278): n is a, c, g, or t
  misc_feature (282)..(282): n is a, c, g, or t
  misc_feature (290)..(290): n is a, c, g, or t
  misc_feature (292)..(292): n is a, c, g, or t
  misc_feature (302)..(303): n is a, c, g, or t
  misc_feature (315)..(315): n is a, c, g, or t
  misc_feature (381)..(381): n is a, c, g, or t
  misc_feature (395)..(396): n is a, c, g, or t
  misc_feature (400)..(400): n is a, c, g, or t
  misc_feature (418)..(418): n is a, c, g, or t
  misc_feature (424)..(424): n is a, c, g, or t
  misc_feature (442)..(442): n is a, c, g, or t
  misc_feature (462)..(462): n is a, c, g, or t
  misc_feature (484)..(484): n is a, c, g, or t
  misc_feature (496)..(496): n is a, c, g, or t
  misc_feature (520)..(520): n is a, c, g, or t
  misc_feature (522)..(522): n is a, c, g, or t
  misc_feature (532)..(532): n is a, c, g, or t
  misc_feature (534)..(534): n is a, c, g, or t
  misc_feature (538)..(538): n is a, c, g, or t
  misc_feature (541)..(541): n is a, c, g, or t
  misc_feature (557)..(557): n is a, c, g, or t
  misc_feature (565)..(565): n is a, c, g, or t
  misc_feature (572)..(572): n is a, c, g, or t
  misc_feature (611)..(611): n is a, c, g, or t
  misc_feature (615)..(616): n is a, c, g, or t
  misc_feature (640)..(640): n is a, c, g, or t
  misc_feature (664)..(664): n is a, c, g, or t
  misc_feature (872)..(872): n is a, c, g, or t
  misc_feature (876)..(876): n is a, c, g, or t
  misc_feature (957)..(957): n is a, c, g, or t
gtgantttctttaatcaaagacaaccatgacaaatttattaactatcaaaatcaattttttaataaaaaaaatctgcctttaaaaatattgaatcatacaatatgtacaanaaatgcngctttcngttttgaacttcactatccatttnnctccttcagctagcatcaagcacttggcttctgcngcctctgacttggagtaatcacaggctctganatctcaaaggtcttcacaatcncctcccagtcacggtaactcaaagctataanaccttganttcnaacttgtntnttatgttcanntccctcattttnttcattaatactaacaggctctattactggcagttggtcttggtcaagttttattcttgcaaaatnatcccgtataatgnnggtnacatgaaagatgttttcnactgtnggggggaaagagtgaggntcaaccacaaagtgaaaganggacattggggtatcagggtcntgtcgaaaatgngtgtgggacagtcccaagagtgtntntacttctttntntgtngcntcttgatgagattgtnccattctngttaacngggcagggattgcgctctcctcttgtatcagagggactnttgnnggacgatcaactcgtgggtttggnacagggcactctccgtatattggncccaacagaaagtggaatgtatgggttttattaaaggtgttttctgctgttctgcctgttatcttccaggagtcatagactatgaattcaaaatcaggactatcttcatcacggatgagttcttcagcttctagcggatttacacccatatgtgtgagtagagtttcaacatatcttaacatgtcaaaggagctcaggtctgagcgcntgcntttgctttctctttgcccaaatctgaagccaaaacaagaaagtgggcatccaggactgcttctcttgctcgggacacttcn

SEQ ID NO: 654112 - DNA, 858 bp, Homo sapiens
ttgtgcagatggcagtgaccaaatttctgactattgctcctggaacatccaagaggtgacgggtagtgttgggtccttctacaagctgaatgagtgttcgtctctaccgcttgtgggtgtgaggtaatacagagctggatgtctcccatgatgaaacagaaatacaacatcaaagtgacttactgagtcttattggataaacgctattgtgtgacctgctggactcggcctcactctctgatcagacagtctctaagtacgtcttcttcgtcagtatatcaatgctacagctcctgaatgccagagccacaagagtgtatagactgggggacagtgggcactctgctgctggaaaacccacttgggcagaagtggcctcacccatccaaggtctttctgtatgaagcagccaaggtgtagggcgcttcggagcaggaagctacaagctgttgctgaatgagacccacaacgcaggaccacttacagacgcgagcatccccggtgaagactctgtgaactatgaagactgtgtactgtttcagtgtgaccacacaaacagcagactatctagcactgtacttctcaatgtggttcggtcagggcctttgccccttaatatacacactattgccccttaacatataccatggaccataggaacacacgacatgaaatcacgactgaaggaattccttcaggggggtgtcacaaactggcgcttggatggaccccacagggcttgagatttcaagtactagaactcaagaatcttcacattagcctaaaacccaggagcaagtggggcagcgtccagtactccgcggcaaattaaacgatctgcgcgcacaagagaaaagg

SEQ ID NO: 654113 - DNA, 869 bp, Homo sapiens
caagtggtgctcctgcctcggcttctgaatagctgggactacaggcatgtgccaccatgcccagccaattctatttattttttttgtacagatggggtctcactgtgttgcccagcctgttcttgaactcttggcctcaagcagttctcccacatcagcctccaagtgctgagattgcaggtatgaaccaccgcgcctggtcctcttgtgatgatttaaagaagttgtactaggccaggcgcggtggctcaggcctgtaatcccggcacgttgggaggccaaggcaggtggatcacctgagatcaggagttcaagaccagatggccaacatggtgaaaccccgtctctgctagaaatacaaaaattagccaggcatgttggcaggcaccggtaatcccagctacttaggaggcggaggcagaagaatcacttgaacccaggaggtggaggctgtagtgtgccaagatggcaccactgcactccagcctcggtgatagagcagtactctgtctcttaaaaaaaaaaaaaaaaaaaaaaaaaaaaaaaaaaaaaaaaaaggggggggggtaaaaaaaaatcaccggtggggggagccaagtatacacgcgtcacccccgcgtgttttgtcaacaaggggggccccatagaggagggcaattaatagagagaggaagggggggcgggcgtaaacacagggccggagcggggaaaaccgtgcagccggggccatggtggagaggaccccttatcgcggggggggcaatggggcaccactcctcagagaattaagcgccagggaaactaaaaattaggggttgggggtaacacaaccgcaaggtcgcgtggaaatggaccgaatcatggaaatc

SEQ ID NO: 654114 - DNA, 732 bp, Homo sapiens
  misc_feature (352)..(352): n is a, c, g, or t
  misc_feature (549)..(549): n is a, c, g, or t
  misc_feature (551)..(551): n is a, c, g, or t
  misc_feature (554)..(554): n is a, c, g, or t
  misc_feature (621)..(621): n is a, c, g, or t
  misc_feature (667)..(667): n is a, c, g, or t
  misc_feature (675)..(675): n is a, c, g, or t
  misc_feature (714)..(714): n is a, c, g, or t
attattggtggcatgtgacacgcaaatgttatctaaaaggaagtgcatccaggtgtggtggctcacacctgtaatctcacttacggaggccaaggtgggaggactgcttgagctccaggagtttgagactcgcctgagcaacacagggagatctcgtccctataaataatttaaaaattagccaggtgtggtggcgtgcacctgtggtcctagctactcgggaggctgaggtgggagaatagcttgagccctgaagtctgaggctgcagtgagccatgatcctgccactgcactccagcctgggtgacagagtgagaccttggctccaaaatgaaaataaatttttttttanaagaggaaatgttctttaaagcatttcagatttcagatttttagatgagggatgctcacccactaagtataatgcaaatattccaaaatctgaaaaacccgaaatctgaaacacttctagtaccaaacacttcaggtaagagatactcagcctgtattactaatagcactcataccgcctcactattgcctcacagngncantcacctctgtggcaaggaatgctttccttctgccaattttataggcaaattccctggatggacaagntaaggggccccatttcaaaccaggtttcctccaccttttcaggttntccagggnctgtcaatggccttcaggttttcaatggcaaggcggggntaccggtacatttttttc

SEQ ID NO: 654115 - DNA, 1468 bp, Homo sapiens
gccaatccataacacgacgcagcccatcctagacatcctccgtcaagaaccaggccaaactacatagagttcctccagccaagtattccagaacgcaccaggcacggcaggcatgcagccagtttcaacgcacgcagaagcacctcatttcagttcaaaccagcatccagggcatttgcaagcagcacccagctccagccacagcacagcttcaatctcccaataaaaccatctcatgttcaacatcccaaattccagccatttacgctgttagctcattccagccatccaggccactcttcattgcattccatgcaggcacaccattcacttgctaatcatagctgtatcaagtgcaacggtttattcattatatacccctttagttattatcagatcccaggttggcagatcggtagcatgcgtgcgtagcatatgcacacatcaggtgcaccatgatgggacatttcatcgtatggatctatatgatgtcaatattcaacattccaaagcacatagtgctcacgtgggcagattctggaaccatggcatagggctatcaatgcaaggccacacatgtcatggcatgcagcagtagtgcgtttcaggcaaacagcagtggccactgcaatcatccaagcattcagcacctcattgtgtataaggcaacaccgagtacaaaaggaaggacgattctagaggtgcaggaggtgagaacaagatgacacaacatgggcactcccatgacgatcaagaatacgacgacacccattcacagggtcagacgacgccaatacgacatgacaagggacaagcatggagcgacagaagactatacatcatgcaaacatcaggaagggtggaagactatatcaaagaactgtgtaacgatttgggtggagcacaactacaagtttgaccaatgcgaacataaaatggactatttgaaaacattatgcgaactttctttataacaattgtttcaagaacagaccatacataagaattattctatggaaacaatggtatatatatgataattacacagcatatgaacaaagaatactaatggcaccatcggcctctccccactgccgaccggcccgaccacggcgcaccagcggcagcggagccatggaacatccgccaccatacaaaaacaagcactattcagaccacgactgcacaagcatcaccgcacgaggaagacaaaacaaccagcacgccaagagggcaagagaacaaacaacgtaaccaaggcacatagaacagcagcaacatagaagcaaacgaaaagaaggaacaaaaacaaagaccaaacaagacgagacacaaaggaaccatccgaaacaaagagaaggaacagaaagaaagaaggaaccagaaaaagcaacaaaaggaggaacagcatcaatagaacacagactatccgacgaagacgaaacagataggaagagagcaaaagcaa

SEQ ID NO: 654116 - DNA, 165 bp, Homo sapiens
aggagagggtctgtctcctgagatagtcagatggctaccattgtctatatgtccattttagttaatattgtgtattaaaggataagcgttaatcgtaaagtatgttaaaaatagatgtagtaaacaagtccctttgtgaatgtcccttgtgagttttaggagccc

SEQ ID NO: 654117 - DNA, 142 bp, Homo sapiens
ccgcttcgggctcttagctactgaggaggctgcaggcaggaggattggttgagccagtgaagaaggaagctgcagtgaactgtgatctgtgccactgatagtgaagcctgggtaacaggagaccctgtctaaaaaaaaaaaa

SEQ ID NO: 654118 - DNA, 179 bp, Homo sapiens
gaagtgcacagctgggtacctcagacctagcggctgatccctcaagagtgatggaccagcacaccttaccaggaccagtgggaggaccggatccaggtgtggcatgcggaacagcgtgggatgctcaaagataatgctctgttggaatacctgaagattgctcaggacctggaaatgta

SEQ ID NO: 654119 - DNA, 194 bp, Homo sapiens
ccagcttgaatcaccttgccaataagcaacaggtaaattaaaacaaccggtacaagtcacaaatcatcctggtaataaagtgaaatcagaccaaaacgaatgaatgaacagcacgtcagcttaactgggggaagaggcaccagaaacttgatgcctagatgtaccgaccaattataaaacatgaaccaccaggt

SEQ ID NO: 654120 - DNA, 219 bp, Homo sapiens
  misc_feature (99)..(99): n is a, c, g, or t
  misc_feature (103)..(103): n is a, c, g, or t
  misc_feature (132)..(132): n is a, c, g, or t
  misc_feature (146)..(146): n is a, c, g, or t
  misc_feature (204)..(204): n is a, c, g, or t
gtgttccaataaaggaatacctgaggctgggtaatttgtttaagaaaaaagatttatttggcacacggttctccggttggacaagaagcatggtccctncgcntgcttttggggaagctcaggaaggttttnctcatggcagaagncgaaggggaagcaggcgtgtcccatggcgggagaggatgcaagagagagtggggaggnccaggctccttgaac

SEQ ID NO: 654121 - DNA, 273 bp, Homo sapiens
gcctattataaaccaacctcctgacattgccccgccctcattgtggtttcctcataatcaccaaccagtcttccttcctaataggagaccaccaaccacggaatggttctggacaatctacagatgatgcgcactgaagcttgtcatgtgctctgtcttcaccttaaagaggccagaggctcaataagctccacccttggatcatgcttatactgccttttctctgtactagcaacccagtaacgggtaactgggtagtccggatcctctata

SEQ ID NO: 654122 - DNA, 100 bp, Homo sapiens
tttgccttccgtccaaggggataaatatggcttctgtggacaacgttgtagtctgtaaacttaaatactatggacccatgacagtagagaaagggaaaca

SEQ ID NO: 654123 - DNA, 424 bp, Homo sapiens
tatcaattgggtaacctggctcatcagcgtcttccaccatcgaatcagagatcagcagctcgttcccactgccagatctcggcccaagcatctacgactacgcaaagagtatggctctgttcatggttggtgtcaacgtgtgcctcatcgtgtgtatcatctgtggtccagagtacttccacagggacttcagtgcacactgctgaagagaactactctgaccagaagaaggccaccatcgaacagttcgacacggccagcgacgaggagcgtgccatgggatcattgaagatgaacaccgaggttgaggagttcgacatggacaaggcatctgtccagcacagagaatctgctagagactagagcttttacagtacattatgaatttgatttgaagttgttgttgaaacaaaacaacaaaaag

SEQ ID NO: 654124 - DNA, 547 bp, Homo sapiens
cacgagggctaagatcatgccgctgcactccagcctgggtgatgaatgaaattcatctcaaaaaataaaaaaaataaaaaagtaaaaggaaagttaattgtagtattttatttaacccagtgtacccaagatgttatttcagcatgtaaccaatgttaaaaattgattgaggtatttgttgtaaactaatttttttcatactcatttgaaattcaatgtgtattttacacttacaatgtggattggcacatttcaggtgctcagtagccatatgtagctagtggctactataatggatgacaaaactatagtttcaatgcaaataaaattaaaatcctaacaactttttaatgtgaatcttgataaactgattctaatatgataatacaaaggacaaagagtagctaaaatactctcgaagaccaagataggaagacttgctttaccaggtattaagtcttattataacagtaactaagataatacagcattgaaacaagtgtggaaagtagatctatgcaaaagaataaagaacccagaaacagat

SEQ ID NO: 654125 - DNA, 119 bp, Homo sapiens
  misc_feature (46)..(46): n is a, c, g, or t
  misc_feature (64)..(64): n is a, c, g, or t
  misc_feature (80)..(80): n is a, c, g, or t
cattccgggagttgtcatcaagtctcttaggcagtctggtgatatntggtgttctgagctaagnagggaatggacttgtntgtcacgcaggggccaagagaagcaggtgcaggtcttag

SEQ ID NO: 654126 - DNA, 987 bp, Homo sapiens
tgggaaaaagtcatggaggccagggggtgggcttgaaaccagcttgggggggttcgattccttcctttttggtctaaattttagtgctattacgggttcttcgaagtggtggtggataggggtggggggcatccatatagtcactccaggttcatggagggttctctctcctactattacgacttttcgcttcgaaagcgaaggctttctcaaactcagtgaacaattatttaaactatttacgtgggcgtgtttagaagcaaactcgaagtgagcccatacagagtgactaggagtgtttcccacgtggtgggtgctagtgccatctcggggctaccccccgcaagatcacgcctcgggggccattccgcgagatagggccgcagacaacggggctggagtgggggcacagaacacgctccacgcattacaccgcccccgcgagacaaaacgactgccacagcgcgaaacagcgggccatctcgcggggccgcaccgagcccgcgccccccccaccgcgccgccccccccggcgagcaacattagcgcggacacacaccagcgcgcagcaggcaagagcaccccccaccccccaacgcaatcgcgccaccacactcacacggccgtccgttaatgaggcatacgcggaacactaacgtggacaaaacccggggccacaacaacacgcccaaagccccgcgcaagcaccgcagcctacacacacggacaccagctcctcacgcggcaacagaacgctcgctcgacccgaccaaaaccaaaaacggcgcgcaggccggaggagagccagcgcgttacagggaccgaacacaaacagaacagcgacattgctcactgccccggggggggccaccgaaacgcaacataacgcgaccccaaaaccaacaccccacttagaacatacgtaggaaaacgacccacgcccccaacgcgcgacggaccaaagacaccacagccacaacaacccaa

SEQ ID NO: 654127 - DNA, 275 bp, Homo sapiens
  misc_feature (149)..(149): n is a, c, g, or t
  misc_feature (205)..(205): n is a, c, g, or t
cgcctggcaatgtgatgttttaatatgtatatacattttggaataataaaatcaagctaattaacatatccatcacttcacatacttattgtgtgtggtgtaaacatttaaaatctatactcgggaggctgagacaggagaattgcttnaacccaggaggtggaggttgaagtgagccgagatcacgccattgcactccagactnggcaacagagccagactctgtctcaagagtaaattaaaaagcagccagacaaccctatcattcaaattca

SEQ ID NO: 654128 - DNA, 172 bp, Homo sapiens
agtcagcacagttgtattcagcttggaaggtgacaaataatactggtgacaactttcaaaaacatcaagtctgtgaccgaacccaactgctccgatcgtctggagactatttgctgttatctgtgaaccactgtgagcaccacctccttgttctccttcacccaccagctcg

SEQ ID NO: 654129 - DNA, 634 bp, Homo sapiens
atttttagaagagatggggtttcgccatcttggccaggctggtctcaaacacctgacctcaagtgatccgcctgccttggccccccaaagtgctgggattacaggagtgagccactgtgcccagcctccaacctaatttgagtttcatttgtatttttttcatcaccttacatgtgttaacagctgtttcaacataaactccattataatctatatacatttaaagaccgtgtttacataatctcttctgggtagaaaatggaaatacttaacctttgcattggtccctttcaggcttgaacaacagtggctgtatctgcatcgtggggttgctggtggtagaacactttggtgttaggaaagtttggaaaagaggatatccctgtattaggccattatgattagagataagcagcctgggagaaacatacaagacctgtggctactggtagagaattggaataagcttccaacaatggactgtagagattaatggagattgtttagtgggcccatggctaggtggggtattaatacagttgaagttatgttgcccttggcacagatctttgagaatctcatacatctgtgaaaaagataatgtgaaataaacagtaaaaaaaaaaatagtcga

SEQ ID NO: 654130 - DNA, 93 bp, Homo sapiens
tctgacgacacggccatatattactgtgcgagggattcggggaagatagcagtggttgggtacaatttcggtatggacgactggggccaaggg

SEQ ID NO: 654131 - DNA, 250 bp, Homo sapiens
cacgaggcttgccccacccatcccatctccaaccctaatcttccatttcctcccgccagtctccattgaatcaatggggcaggacagaaagacagtcagaacaatttccttctttcctcgcacttctccccaggcgtcatcttttatatagtgtttcaaaaggatactctgaaaccctctctgtgccccaagtaaagatgacattacatctgctttcgaatctccacaggcaaaagaggggggtgcctta

SEQ ID NO: 654132 - DNA, 193 bp, Homo sapiens
ccgagatcatgccactgcactccatcctgggcgacagagccagactccgtctcaaaaaaaaaaaaaattcggaagcttttctacaccccaataactttcaaggctggagagccaattcaaggatgtggcaatcccatttacaatatctggtaaaacaaaaaaaagatcctggggaatacttctacccaggggg

SEQ ID NO: 654133 - DNA, 794 bp, Homo sapiens
  misc_feature (587)..(587): n is a, c, g, or t
ttccttaagtcctaatgggaaaaaaaaaaaaaaaaattgaaatagttgaaaaactctggggtgtaaacaattgattgtaaccctacacattattcaataagtagtaaaaggagcttccacagattttcaggtctaattcttggccctttcttggtgggggccataattattaaaccattaattggtgtgtaactggactaacaagaggtcatttcttctttctaaaggaagacttatcagttacgctggcacatttgggtgtaagacgcagcttcatataatggtgaagactctggcggtcgaaatggttaatatttctaatttattggaagaaaaggctgattttacacaaatttattttatttctcaattccatagagaaatccgaggggttcggggagctgggtattggaatatgcgtcgatccatggaaatggtcccacatcttttctaatgtgggccaatttattcgtgcaatctaacagaaggaaattaaagatgcgtttcccttgggaaacttaagtccttccagggcgggaaagacttaacctgtgcgtccaatacacccttttgtgcgctggaaattntaaaggtaatctccagtggtgcggaggggaccttttaaagccccttttcgtggagtaaagaccagcgttttccaatattttttcttgtgaaccttcaaatattctctcaagaaatcctctttccctaagtgggaattacgttggaaattagacattacattaccttttggaccagttggtttccgacccatttccccctaaggaatg

SEQ ID NO: 654134 - DNA, 218 bp, Homo sapiens
  misc_feature (15)..(15): n is a, c, g, or t
  misc_feature (25)..(25): n is a, c, g, or t
  misc_feature (111)..(111): n is a, c, g, or t
  misc_feature (141)..(141): n is a, c, g, or t
  misc_feature (152)..(152): n is a, c, g, or t
  misc_feature (186)..(186): n is a, c, g, or t
caggcgggcgaaccncgggcgctcngtcaaggtgatcaaaataaaggcgctaatttataccgccgtggctccggctttccctggacatgggtgtgggatccggagaaaatncgcaaactgggccagctgtcctcagcgacncctgtagggcnaggcggattgcaaggaggaagcctgctgcctggngaaggaaggaggggtgcaaatttctccaaggt

SEQ ID NO: 654135 - DNA, 927 bp, Homo sapiens
ggcccgccaggttgacacataaaattaacgtgtcacagtatcatcgttagaagtgaaagaagccccgtttatcctgcaggtgcccctctaccaccaactacgtgacaaagaacatggtgctatctgggcatgggagaattgtccagttggctagggctggtatgtgtcccctcaaattcaagtgtggccaaggtgacagcatcaagaggtggggtcttgtacgagatcactaggccatgagggatctcttaggactggggatgaaggcccataatacaagaggttccagggagcatcctgctagctggcctccggtatgtgagacacagcaaggaaagccctagtcaacaagtgccagctcctggatcttagacttcccatcctccagaacctgtgagaaatacatttctggtccttacaaattacccagtctccggtatctggtcatagcagcacaaaatgaaggataccatacctgaacacctgaacattcttcacaagggaagtacatgcacgggttaatacggggtctcagtatggtggtgcttaataaagggaatgcgaaaggggggaatcagggcataggattgaccaagttacgggtagaacttttaaatgggcctaaatggtaagatggttttacaaaatgcaggggaaattgggaagctaaacccgggcaataaaagggccaaaaatgaatgtttaaaaaacctctagatttgtctacaactgcggcatcgtgtcaccaagacaccaagacaaaaagcacaacgagggcgcgaccagcagttacaaccaaaacaccgaaggggcgcacaccccacaaaaaaacgcgacaaagaccacccacacaggagaacagacaacagacagcgaaaaccaactcacacaccgccagcaaaacaacaaacaccacacaccacgaga

SEQ ID NO: 654136 - DNA, 110 bp, Homo sapiens
tcttgaggatcccgcgaatccaggtagacggcatgcacaccacccacggaatcgagacctggattcgcgaccgaacctggattcgcgaccgaacctggattcgcgaccga

SEQ ID NO: 654137 - DNA, 349 bp, Homo sapiens
  misc_feature (83)..(83): n is a, c, g, or t
  misc_feature (180)..(180): n is a, c, g, or t
  misc_feature (299)..(299): n is a, c, g, or t
  misc_feature (311)..(311): n is a, c, g, or t
gctacaggacccgtgaattgtgtggtgttatgaatctcgatatgagactgctacgtacctgtgggatcaggtcaaacgtagtncacatgcgatatgtgaaagtttcctataggctagcatgcacaggggcgtcaaacaaacctaaggctatcaagtgacacgtaatcaagcaagggctcncgtagattgctcgaatatgtattcgagacttggtttagggctggactaacatgaattcctacatgcgaagatgggtcaggaaaagcacaagtcataagcgtgaaaccgtattcacactnataaacgtcaancatgcatatatcactaagtagcataacaccacacaatt

SEQ ID NO: 654138 - DNA, 681 bp, Homo sapiens
cggtattaagcgaggtactataatttcaataattaattttacaatccatgtagcaaagggaaaatcatacagagaggccagtgtatataattaagagtttatacagaacacggccaattccacaaaacagcactggatggttcatatattggcaagcacaagacatgtggtcacatgtggtcccactgtgttacagggtagaaccaagcccacagacaattacattagagttaccacccgtgaaagcgaggcccttggagcgtgctcagctttcttagaaaattagagaacttctcaagggtcataattacattttggatctcaaaagtgtcttctaaaatggtttccatggggggagaaatttaagaaaggggcaaaaatccaatcttagtgggaacttctgaagtttcatttagggggtccttttcgcaatctattttgataacaatataaaatataaacatgtgagaaaaaaaatgtgtataaacactagagggtttagaaaggcccttcaatagtgttattttgaggtagagtataactcgtgagaggtggtacccaggaggttagagaaaaagagcgtggaatttagaattactacgattctttgccgtggtatttaagtgaagtaatttgaggccactttggcgtgcacagaaaacttttaaattattctcgtca

SEQ ID NO: 654139 - DNA, 283 bp, Homo sapiens
tagtcgatgaccagcttgctcaggaacaggtcgcggatctgctcgacggtgaacggggtggtctcggcttcgtggccgcgggtggccacgtgggcttgcaggaattccagcgtggcctgttcgtcgcgatggtcggccagcaccgcctcgccgatgcgcgcggtgatcggcaggatcacgatgttgtgctgttcgaagtagtcctgcggcaggtcgcagcaggaatcgacgacgataccgatacgcatgcggccctccagacgaccacgttggccaaacatgg

SEQ ID NO: 654140 - DNA, 1042 bp, Homo sapiens
ggccaaatacaagtctgtcaaagttattcggctgattggatcgagacatctgtgtgaagaaatagtctataggaaagcagacctcctaaactgcagctcaccaaccatgatcatagaatggaggccattttactctgggagcccagaaacccgactgccgatgactgaccatcgcagttgatgtgagatactcaaatttggattctggataaacatgctggcctctgagtgggagcaccatggtatgaaatagacctggaagtccatcctgggagaaacaaaagatggccagtgggtctctgatgccttgctctgccaggcctgaagggacggacggcgatatattcaaggaggcaaggaaagaaagtctgtatgcataccttatctgaaagggctcaaacgactgattgctaaagaagccccgggtgacggcacagactcgagaaaaattcacttagaaacaatggcgtgtaaaccactatacaggaagaagaaccgtttaggagtacaaacaggcgttagctctgaacgaagagtgatcccaatccatcgtcacggaaaataaccacggtgacaggatggtttcctcgaattcacgcaagcgtccccctggaatgggctaccggcggcattcttagcacctagaacagcgcaaagaccgttgtatccctagcatgctccctggaacacgaaattctgtggacgcggcaccttccgcatcagcaaagcacacaacggcacccaccaagcacaaagtcccgaaggcacggcccacaaacggcacacgacaagccggcaagcacccatgcgatttgcgcaacccgacacgcacacagcaacacacgcacgggcactcaagcaccgcgaagacaaaaagagaccctgtggcacacctagaacgacaagagagccgactggatgcgctgcgtgggggcaaattccccaaccaggtgaacccagaaccaatgactggcacgcctgacccacacgccagcgcagaaggcggcaccccaagaagcgaaccccctcgccaaacaactgc

SEQ ID NO: 654141 - DNA, 165 bp, Homo sapiens
agcagcgtttccctaatctcctagcacttccctcctccaggactgtattgtaattatactgtggccactttctggaaagaaaggaggatgaccacaaaacctggcatttaagacacttagagctagttgctaattgactggccaggatgggcccctgggatggag

SEQ ID NO: 654142 - DNA, 201 bp, Homo sapiens
  misc_feature (7)..(7): n is a, c, g, or t
ggatccncttctgaaaaaaaggtgtcaaattactaataccattaaagaaataatgatgttcaaattgtaataatcagttacccattgcaaacttctcttgacttctggttgggttgatagcaccaccagtatccttatcacccccgtcatcatgacataatctgtctcttcttcattccccaaacccactcttcatcaagt

SEQ ID NO: 654143 - DNA, 166 bp, Homo sapiens
cagacacacttccggtgcctttgcagaccgagatgccagaggctcttgaagtcaccaaggggaggcgttaagaaatcctgcatctccgtccctcacaagaccgctgtctcaggcttttcaagctgtgaagagacacatcagagccctgggacactgtcgcatgaca

SEQ ID NO: 654144 - DNA, 392 bp, Homo sapiens
aatcggaccacctggttacatatgaagtgtgagtgatctaagactgtactgcaacacatgtgctgttctggcgggaccaccgagtgtagcctggcattgactgcagcaggtatgcagaatggagatcatgtgcccggcagtcatcacacatgagatcatcgagatcattgctactcctgagcgcaagtactccgtgtggatcggcggctccatcctggcctcgctgtccaccttccagcagatgtggatcagcaagcaggagtatgacgagtccggcccctccatcgtccaccgcaaatgcttctaggcggactatgacttagttgcgttacaccctttcttgacaaaacctaacttgcgcagaaaacaagatgagattggcaatcaagctt

SEQ ID NO: 654145 - DNA, 240 bp, Homo sapiens
tcgactcttgagcatcccccgccatttacaactatctactgtgcccttaccttgctggtgcctcagctcttttcatcagtcatgtgtagattataagattatctacctcaatacaagttttatgaaaattcatcataatgatattctttatgcttttagtacagagcctgacatacagtttgtgcaataattagaaattgttttggccaggtgcggtggctcacacctctaatcccagca

SEQ ID NO: 654146 - DNA, 1559 bp, Homo sapiens
  misc_feature (1399)..(1399): n is a, c, g, or t
ggcttacagctgatggtctgtcaggtctggccacagcggaggtctgccgcggtatagcgaggtcgtgtcagtcgtcatgctgaggtcagggcgaacgtggacatgtaatggtcggtacgcggcagctaggtcggcattagggttcgcgcctgtgtctctacctgcgcgactctgaaactcagtggttgatagctagcatggagcactaactgtgccgtaggctctggtgtttgagtgcgatagatgcgtgagtgcatcatagagagcgaacaggaacactagacttaacacgtgtccattttcgattagctcagcgatggaggtggattgttcgagcctgccacggttgctgatatcccatcggagccgttgcttacgtgagggaatcgtgcttcgcagggaggctgatctaacagcgtttaactggccttttgaagagaacaccgaatccaggcattttccctagtgctaactgtatcctagattccataggcgaacattctaattcgtaaaaggggcgaaggaagtcactagttggcaattcggctacccatggtgcgtacgaaggctacccggggccttattgcactgtgcccagagaataccgaagttggcgatccgcttgtcacaaggcgtacgtttgcttcccagtattgccgcatttcccgaaggcttgttatcctgggagacaattatgttttccattgtgccttggcctgttgcaaaccattgtttccaatagccccttattttggaatctccctttggctggagttacacccaaaccaagaagttaatgcaaaggtctactgggggtcgttaggtcgggccaatggaattcccaaaggaataagcggggcgactttaggcgtttttgagctatcacttttcccgagaggtttagacacctgttatacacagattttgcaaaactttggtttacgcccaatggtttggtcccccattgtaaagtccgtttaggcctatttattggtgcacggtgtgcccacccccacacaagtttgggaatgtatggcgtccttgaatggggctacccaaattcgacagctgtcgataagtcctgtttgtgcacaggtttaaccggcgggaacgaaacggcgaatttgctttattgtgtccggccacggtgtgtccgaaactgtccccaatagagagggccggtgtgggttatcttttatcaggcagttaatttcgagaattttccgggcttcggcaggcagagagaaacaaggttgtccctatttacacggtgggcacaccaaccgggattttggccgtttatatttctcacgaacaaagaacgttggcttctcagggcgacatcgacggcgggaattttagcacgccgcgccgtgtggcacatcatggaaccaagacncttgcgtttgggggaacacttcacacacacgcgtgggtgttatttcccagaaaacacgcccagggcctacgatcatttttgtagacatgtaaaacgtgatatatagtatacccagaggggtgttcaacgcccttagaggcccagtctccacatagtgctc

SEQ ID NO: 654147 - DNA, 565 bp, Homo sapiens
ttgttgacttcttgtcagacacagtgcatgaagaacttggtggcttcatcacacaggatccgccctggaacatgaagagaaaggtccgcttcaaagtatgtacaaaagctgtgacgggcagtaacgcaaggcagtgctgcaggcaggccgcaggcagtgtctgaggatggccatagttggggatttctgatgaagaagcgagccgtaaaaatccaccccatgtgagaagtgaggagggcactcccatggggtctgaggttgaagagtttgaagattgggtgcagtggctcacgcctgtggtcccagcactttgggaggctgaggaggttggattaattgagcccagaaatttgagaccagcctgggcaacatggtgcgaccctgtctctattaaatttttttttttaaattagccagatgtggtgttgtagacctctggttccagctactcgggaggccaaggtaggaggatcacttgaacttgggaggttgaggctgcactgacccatgattgtgccactgcactccagcctgggtgacaagagtgaaaccttgtcttttcaat

SEQ ID NO: 654148 - DNA, 1059 bp, Homo sapiens
  misc_feature (1025)..(1025): n is a, c, g, or t
  misc_feature (1030)..(1030): n is a, c, g, or t
cacacacatgacagcaccaagagcaacgcacattcgaggaggaaccataaatagacgcacaagcacaccacggtgcaccagcacagaacacaaccaaattgcaagcacatcccacggcagcagccttaacaactagcaagctctacaccacgaagcaccagcagcgtgtgcagcacataacacatcaccagaccagcgcagtttaactactatggcatgcacctagggaacgttgccagctagcagcaacagcagcaaactctccacgtctttaccccaacctcatgtaccaaacagtctcgttagacacttatctaacactagcgttctacactcgtagcatttcgtcataggtgccaggtgcaatcatcgtagactctcataagacccacccagtgcgacagcatctcttaagctccttgtcagcaagcagcaacggctacttctacttcagccaccagcgcagtgcactctgtatattccccacagaacttgagagcacatgccaaggtcgtcacatttgtaagcgaggcattccagccccacgcaacagcaacaagccacatttgccaggcagcagcatgtcaaatgcactcacaccgaccattctagcaaagcaaacagtcacgtgtacagcactacagcaccctgtgttcaactgacgacagtctaccacttggccagacagatagtaagaccatatacattgtagaccacgcacaaacgcaactccctacaactaaaccgagagaactccacgtcgcaccacacttagaacggcttcaaggagattactacatcttcatggatgctaacacacgctcctaattcatgcagcacttttaaccttccttgaccagccaactcctgactgcagctgtgcaccggatacaaactcagcgatctaccgcaggtgcgcgtactaggctgcgcagtcttggacaccactgtcgcatatcagggggcgcacacttctgcgatctcgtaccatataccgcgaggcgcacatatcagttcgtcttccnactantccgcagtcctcgcgccaccaccactccc

SEQ ID NO: 654149 - DNA, 199 bp, Homo sapiens
  misc_feature (13)..(13): n is a, c, g, or t
  misc_feature (55)..(55): n is a, c, g, or t
  misc_feature (134)..(134): n is a, c, g, or t
  misc_feature (172)..(172): n is a, c, g, or t
cttgatttaccanttggacagctacgcgccacgggctgaggctgagaaaactttnatttatccgctggatctcctgctcaagctacacgatgagcgttttttggttgctttcggccagcgggacggcatccaantgggtcatgcagtgctggccatcaatggcatggacgtnaatggcaggtacacggccgacgggaaa

SEQ ID NO: 654150 - DNA, 915 bp, Homo sapiens
  misc_feature (4)..(4): n is a, c, g, or t
  misc_feature (68)..(68): n is a, c, g, or t
  misc_feature (73)..(73): n is a, c, g, or t
  misc_feature (76)..(76): n is a, c, g, or t
  misc_feature (85)..(85): n is a, c, g, or t
  misc_feature (92)..(93): n is a, c, g, or t
  misc_feature (106)..(108): n is a, c, g, or t
  misc_feature (110)..(110): n is a, c, g, or t
  misc_feature (118)..(119): n is a, c, g, or t
  misc_feature (124)..(124): n is a, c, g, or t
  misc_feature (126)..(126): n is a, c, g, or t
  misc_feature (131)..(131): n is a, c, g, or t
  misc_feature (508)..(508): n is a, c, g, or t
  misc_feature (693)..(693): n is a, c, g, or t
  misc_feature (695)..(695): n is a, c, g, or t
  misc_feature (702)..(702): n is a, c, g, or t
  misc_feature (716)..(716): n is a, c, g, or t
  misc_feature (725)..(725): n is a, c, g, or t
  misc_feature (728)..(728): n is a, c, g, or t
  misc_feature (743)..(743): n is a, c, g, or t
  misc_feature (752)..(752): n is a, c, g, or t
  misc_feature (755)..(755): n is a, c, g, or t
  misc_feature (759)..(759): n is a, c, g, or t
  misc_feature (781)..(781): n is a, c, g, or t
  misc_feature (784)..(784): n is a, c, g, or t
  misc_feature (792)..(792): n is a, c, g, or t
  misc_feature (813)..(813): n is a, c, g, or t
  misc_feature (826)..(826): n is a, c, g, or t
  misc_feature (851)..(851): n is a, c, g, or t
  misc_feature (868)..(868): n is a, c, g, or t
agcncaccctgtaatcccagcactttgggaggctgaggtgggtagattacttgagcccaggaattcangaccngcntgggcaacntggtganncccttttctatannnantaatctgnnctttntngcatntgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacncctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgnancctttcnacctgaaaatcaancagtatganagnttagtatttgtatgngtcactagngtntaangaagctttaaatttacaatttnttntttaaaanatttattaatgggaatggaanataacaattcagnttaattccccaaccttattttgggngtagacattgtattccncaattttgaaagggtgggttttacctttaaaaaaatgaattcagaga

SEQ ID NO: 654151 - DNA, 859 bp, Homo sapiens
  misc_feature (60)..(60): n is a, c, g, or t
  misc_feature (452)..(452): n is a, c, g, or t
  misc_feature (637)..(637): n is a, c, g, or t
  misc_feature (639)..(639): n is a, c, g, or t
  misc_feature (646)..(646): n is a, c, g, or t
  misc_feature (660)..(660): n is a, c, g, or t
  misc_feature (669)..(669): n is a, c, g, or t
  misc_feature (672)..(672): n is a, c, g, or t
  misc_feature (687)..(687): n is a, c, g, or t
  misc_feature (696)..(696): n is a, c, g, or t
  misc_feature (699)..(699): n is a, c, g, or t
  misc_feature (703)..(703): n is a, c, g, or t
  misc_feature (725)..(725): n is a, c, g, or t
  misc_feature (728)..(728): n is a, c, g, or t
  misc_feature (736)..(736): n is a, c, g, or t
  misc_feature (757)..(757): n is a, c, g, or t
  misc_feature (770)..(770): n is a, c, g, or t
  misc_feature (795)..(795): n is a, c, g, or t
  misc_feature (812)..(812): n is a, c, g, or t
gagagagagagagagagagagagagagagagagagagagagagagaggagagagagaganaggagaggagaggagagactgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaagtacagacttaaatagctcagatagctaattaggaaatttcaagttggccaataatagcattctctctgacatttaaaaataatttctattcaaaatacatgcataattgattttacncctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgnancctttcnacctgaaaatcaancagtatganagnttagtatttgtatgngtcactagngtntaangaagctttaaatttacaatttnttntttaaaanatttattaatgggaatggaanataacaattcagnttaattccccaaccttattttgggngtagacattgtattccncaattttgaaagggtgggttttacctttaaaaaaatgaattcagaga

SEQ ID NO: 654152 - DNA, 660 bp, Homo sapiens
gtagaagggaattacggagcacctgtacgtctgctttgacgccccgtaacgaaactcggacatctcaacattcacagcagatgactgatcggtgccgcgcctgccataggcgttaccaaagcgggtcaagaacagcaaatcacgattctcgggcgaggctttcgcctctcgttccatcctccgccagcctttggacatattccagcaattcatcacgcaacgcttcgggtatccagacctggccagtcacaccgaatttcgtgtgcactggcggagctgcgcctggaccaactgcaaggcgtagaagcccttcagcggaagggtcgggggcggcgcgctccagagactgaatcttgagatcacagatgctgccgagccgcatcccggtaaaaaatccaagggccaacatgaggtagagctcgggcgtggcgttctctgcggcgaaatccagaattgcatcgcgatcggtctccgagactggcaacagcccatcttcaagtgtttggcctgggcgcttacggttcgggatgctgaggtcggtggtggttccgctgatcgttcgctcgaaccccacccggtcgaagtattaacgacgtagggctttcccgccacagctggacgtgtggagaaagaagctcctatgccttacccacgaataga

SEQ ID NO: 654153 - DNA, 997 bp, Homo sapiens
  misc_feature (997)..(997): n is a, c, g, or t
aaagcatgggagagagaactggccagggtgtaaaaagggccgcacaaggagaccggtctctaggagatctcctaaggtcacccaattccgcgaacccactcagggttcgcttgtagtgagcaagctcgatccgtagtgtgacttaatgtgactccatggactcgcgtacgatccctggtccgggctatttcgaccatggtctgacttgatcatggacttctatagtggctggtgccgtccaataatcgtgtcgcgattatactcatggcttttatttgtgatccaactgggttatagtctacctaatgaccctctatgacgcagacggcgtgcgagacttgagtccattagtacgatccgttactcaagtgagtttggaacgaaattctattagtcgccataaggaatcaatgaacgtatttgatttctctggccattgatctgtcctctagaaaccttcacttatggctggcgcagaacatcttatatctcgaacagacccgtcccaaatcatggatggataacctgcgatacatgaatagttccatattcatagagcatgcttcgcgcaggtctccctgggcttgactcagatcagatgatcggtgtgctagggatgccccggggcgggttcctttcacgggacgtaatcgtctccaggccacttcgaatgcctgcgcttgtgattgaacctaccctgccgcgttaccagacgtactcgcattaattcaacccttcccttaacagggacactacaggcagggaagggatgttcaaaactgcttgacttggcgggcagggtgggccacaaatcgggcagaccggtctgtgaacttgggccagtgttccctcggaaggcagggatctagcggcacaggttggagcaccaacaatttccgcatacatcctattgatcgcacctggttccaagaaacctaacgcgcttgactcctactggggccagtggcagggacactgcgccaagcgtcgaggcctn

SEQ ID NO: 654154 - DNA, 117 bp, Homo sapiens
atgccacaggagcacgtaagtctatcggaaagcaaagacggttcaacattgagagaatctgttagttacgaactcactacatgaagagactataaaaagggaagactttgggcactc

SEQ ID NO: 654155 - DNA, 218 bp, Homo sapiens
tttcgctgcagtgttccccgagcctgttagacgcagcgcccggggagacttgagagaggaaaggataagaggaagtgctgccctaggcttgcatgagttcgaagcaagctttgtttccttcccgccagcaagttcccttagaaaccgggacccgccccttcctggcctgcattccatccctctcccggggcgaggtaggacctccttggttctttggt

SEQ ID NO: 654156 - DNA, 543 bp, Homo sapiens
cctcataatcatctaatagttctcatacatacctccttgtctactgactcctacctacctctatagcgtttcttgtcttcttcctcctccttaagcctactgctcctcgtcctgtttgtcctatcatttagtttctctagctgcctttgttacgccccacgtctacgttgccaaactcctcagcgtatgcctcatcgtatggtgatagaggaagttgtcaaagatggtgccagacttgacctgccagaggtccaggcccagcacgccaacagttatcataggcatagatactgggatcgggagaatactcggggttgtcaatatatactgggtggatccaagtgcccttgtaatctgggttgtcgatctgccggggcttccactcacccttgtactcagggttctgaatcactgggggttcccactctccgtccatctcttcatcccagtcctcgggcttcttagcatcagggtcagggatatgctcgggcttgtcccagtcctcaggcttggagtctgtgggatcatcgatcttggcccgct

SEQ ID NO: 654157 - DNA, 304 bp, Homo sapiens
tttttcttgtgtatttgtcagtccttggaatgcagcttcatttacacaacaggtctataataagaacatgaaatgacgagtccgtgggatctgcggcagaggtggttcttgtgtgaagcccaggcatccagacgtagggccaaaggaagggctagtgttagaggacctaatacttgaactcgttatatttcttgctgcccccacgactgtcctgaggctgagctttccgtttttagtgcttatgtttggcagcgtgctcagccaccatgtcactgaagtcctccttctctacttgagcctgctg

SEQ ID NO: 654158 - DNA, 182 bp, Homo sapiens
  misc_feature (7)..(7): n is a, c, g, or t
gagtatnttccgatgactccgccgatgccgctgggattacagctgtgagctactggacctggcctatttatttatttatttatttatttatttatttttgagacagcatcttgcaatgttgcccaggctgtatgcagtggtgtgtacatagctcatggcagccttgacttcctgggtcctcg

SEQ ID NO: 654159 - DNA, 882 bp, Homo sapiens
gcaggaagaaagattaaggcaaaataaatgaagtagactgcgcggatgaacaagaaacgtactagtagtggcaagtatcaggaacaagaagtgttgtttaaatagaaaaccaaagtgttgatcagatgaaatacaaaggaagatgatgttcttggaagggcaactaagtacaagaagagattaggtctgcggaatgaaggattctgcggaaaccaaccgtacaaatacaggctaattggaagttatcacggagcagttctgagtgagcatactgttcacttactgtagttgtggtgtcaggtatatttatgctccccctgtagcttgccctcagtgagctcattgcctatgacctgtcttaccatgtgattgtgaattggctctctggtcgtcgtccggagctccatatgtccatgtgcctactgaagatctcgtctgtggactatgtcagcagatgcctcaaaatcgaataggtcataatctccagaaaatcatttccccaattctctccctgaccccaagtctgttactcttcctgtggtccctataccagaaaattcctatcattactcatctgagtcacccgattatgaaacgctaagcatcagaacttgactgctgactccttttaacgcctggtatatactcaatttcacgaggactattctgtcctgtaatatctcaacatgttttaccttctcttgtctggggcattagcgttggaacccgcaatgggacgacctttctggacactccagaaagagaatttaggcgtgtggcccactagtctggtcaacacggggttaaagagcgaaaaagtggaaaggggggtgccaaacacatggaacggggggaggaaataaaaaaatttggggcccagaa

SEQ ID NO: 654160 - DNA, 313 bp, Homo sapiens
  misc_feature (295)..(295): n is a, c, g, or t
acgttagcagcgcagcacatcataaaaaagagaagaaaaaagagaaaccgtggcactatgttaataaagtaagctactttgttgttagtaaataagatgagggcatggctgggaaatggtcccttgggcattaattaagccatccaattattaattagtaaaccaggtgttccaattaaaaagaatttaccttggataggttaaccaggaccaggaaagtgagtttccctgaaggagttctttgttcctgatcaaaggaaattgatacctgttagcattcactggcaccataatnttaaggagaaagaactct

SEQ ID NO: 654161 - DNA, 180 bp, Homo sapiens
tagaggatcccgaagtcacccgcgttcgacagcaagtgatcaccgcgcaagttgaatgcgcgttcgcagatcgacgggccgatcgagaagccggtgaccgtgcgttgggcgatcgccagggaatcgccatggctgacatgactccgcaggacatggccagcaaattgctcgccgcgggtg

SEQ ID NO: 654162 - DNA, 169 bp, Homo sapiens
tgctatttccctttcataaaggcacacatttgatcttatcttctcttacccaacacgcagtggcagtgtgtattttccttctctttttttgttaaatattctggtttgtggaggttcacagacatgtgttagtatatccttgcctgcatgtagttgttcattactagac

SEQ ID NO: 654163 - DNA, 337 bp, Homo sapiens
tcccctaccattttcgcccagcgctaggcaattagtagggaatatggggaaaatatcattagcattaagggtttcaacatactactcagtccataagaagaataaaataatgctatttgcagcaacatggattgaactagagcctctcatattgagtgaagtaagtcagaaatggaataccgacaatacactatgcaccgagattactgtggaagatcagcttgcactttgactgaatctgaccttcgattcatccttctcaccatacactgggaaaaaaaaaattctaaactctatatctggttccatcgtgacctctttaacctgggctgcgaca

SEQ ID NO: 654164 - DNA, 291 bp, Homo sapiens
cctcaggtttcatagttaacagcgagcacatctgagcaaacacgtacctctttttcttgagtaatgtgtagagaacattttgtggtagtgtttatgtctgtcttttggaaacgttacacgatagtgttaattctttactcatcatctcagtatgtcattatcattctctgaacagcatttgtttgtagaagtcaacattaattaatcttctcaactgaaatgaaaatactttatgggaatacactgagaaccccccgcccccatcttgcacatggttatatgtgttgcccc

SEQ ID NO: 654165 - DNA, 157 bp, Homo sapiens
tctagtcagcggtgagggggctgggtttggggctcctgttcaggaatacatgtccgctgcagcctactcctggatgttcacctggtatttgtcccgtgccatctttgtctagagatttgaaggcacggaacatggcgtccagcctgacctagcagga

SEQ ID NO: 654166 - DNA, 681 bp, Homo sapiens
atcatgccccgctagacgaagagctgaccgctcagagaatggttacgaaagggacaaacaagccaacaaacgaagtccagtctccccatttgttgtaaccgccgggtcccctttggttgccatggcacttgaggccagaaagtcctcagctcccaggtgaagtcctccaccagctgcccattcctgggggtggatgccgtgacagccacgccagattgtcagctacccagaaggagaggaggtggccgtctgtgttctccaaacttctgggactcctcaaggagtgaagtctgatctacgcacggaaccaaccaccacggcaaaggaagagcgatggcgcccccatgtggcaacacaagcactgcgatttcacacaagaccaaatcagaattggccggaggggaacgtcagattcttagggagtgttactccaactaatgctacactcagggcgacttcttggaaggcaaaagccccatagtctagccatacaactttccagaaaagtagcactcttcaaaacagctggcattaaaattcttggctctgccatccacccgttctgtgagactctttcctcatccccaaaaatggaaggtctgatgacttcaaaaagagttttaccgtttttcccctcattgaaaataatagaaaacagtaaaatactgcatttctgccttc

SEQ ID NO: 654167 - DNA, 292 bp, Homo sapiens
gatctaagaggatccttttttttttggtgatagaataaaaagttactttgggctggcaaggttgctcaagcctgtaatctcagcactttggaaggcgaggaggtggaccacttgaggtcaggagtcaagaccagcctggcaatatggtgaaacctcgtctctactaaaaatacaaaaattagccagatgtgggggtacatgcctgtaatcccagttactcgggaggctgaggcaggagaatttgtcgaacgcagaaggcagaggttgaagtgagcaaagatggtgccactac

SEQ ID NO: 654168 - DNA, 292 bp, Homo sapiens
gtcagaggatctcatcagccctaaattattatgaagtctgctactatacagatggataataattttagacaattaatttccatctcccatctaagaacaaaatatgcatactaaatttttctacttaaatgaacttaagttcatttagattatttagaagttgatttatattatttaattcttcaacaaaactatgcaaatgcatgcagtaagtacatagtcataacagaaaaaaatgattcctatctttaaatatcatgtgatggacaccataataaatttagggttgatg

SEQ ID NO: 654169 - DNA, 242 bp, Homo sapiens
acctctcacgactccccggcacactctgaccccacgacaggccaatgctgatgacgcatggcctgacctgctactgacgtgaccctggcatgcctttactgaccacggcgcctgtggacgacacgggctactggacgctctccgtgcgaccgacgcgcacacccttgctctcacgtacgcctactaccgacacctgtggttgggctgtgccacgacggtggtgccgtggacgggttgcttgt

SEQ ID NO: 654170 - DNA, 347 bp, Homo sapiens
  misc_feature (258)..(258): n is a, c, g, or t
  misc_feature (316)..(316): n is a, c, g, or t
ctccgttacccctccaccctgtgactcagctctggggccaggaccagctaatgctaatgcaccccaccccacaggctgggagtcagggctcaggcctgtccagcatccccccgacattctacttaagacttaacctgagagctgaggacccagggggacctcctgcctcagcactcctcttacaggctgggtcccaaaaatgcagaaaggagggttggagcccaccagctgcaagtcccagggatattccctaagctnccacctcaatccatcttgcccctgcctcttggagacagttaacatccaccccaggttnggggcaggagggagcaggaggtctgagtcct

SEQ ID NO: 654171 - DNA, 346 bp, Homo sapiens
gagacagagtcctcagtgtgtcaccccaggctgtagtgcagtggtgcaatctcggctcactgcaacctccgcctccctgggttcgagcaattctcctgcctcagcttaccgagtagctgggaatacaggcgcccaccaccatgcccggctaatttttgtatttttagtagagacgggtttcaccatgttggccaggctggtatccaactcctgacctcaggtgatccacctgcctttgcctcccaaagtgctgggattacgggcgtgagccaccatgcccggcctggacctgcatttttaatgtgtgtttttaatatgcagaatatagctaagaaatgaaaaaaaa

SEQ ID NO: 654172 - DNA, 176 bp, Homo sapiens
atgaggcaagtaggtctacaagacgctacttccctatatagagagcttatacttcatgatcacgcctcataatcatttcctatctgctcctagtcctgtatgccttcctacactcacacaaactactatactacatctcagcgctcaggaatagaccgtctgactatctgccgcat

SEQ ID NO: 654173 - DNA, 627 bp, Homo sapiens
  misc_feature (28)..(28): n is a, c, g, or t
  misc_feature (138)..(138): n is a, c, g, or t
  misc_feature (151)..(152): n is a, c, g, or t
  misc_feature (187)..(187): n is a, c, g, or t
  misc_feature (200)..(200): n is a, c, g, or t
  misc_feature (207)..(207): n is a, c, g, or t
  misc_feature (213)..(213): n is a, c, g, or t
  misc_feature (224)..(227): n is a, c, g, or t
  misc_feature (241)..(241): n is a, c, g, or t
  misc_feature (247)..(247): n is a, c, g, or t
  misc_feature (263)..(263): n is a, c, g, or t
  misc_feature (270)..(270): n is a, c, g, or t
  misc_feature (324)..(324): n is a, c, g, or t
  misc_feature (408)..(408): n is a, c, g, or t
  misc_feature (449)..(449): n is a, c, g, or t
  misc_feature (486)..(486): n is a, c, g, or t
  misc_feature (511)..(511): n is a, c, g, or t
  misc_feature (600)..(600): n is a, c, g, or t
ggaagtctttcaattggtgtttgggtgncctgttcgtctagactgtggcgtgtttttcagtgcttataataaatgcactatttagccatgtgatggcatggtggtcccttatttgcttttttttgcgtgtaagaggcnggtctggggaggnngcgattctatttggttccgatatgacattctggangaaggggggtctntggcggnggtggngggtggttgcnnnngggaggtcgtgtcntttgcnggggcatgggtggggntgggggncgattgtccttttcggacttgcttagggacggggaccagattttccgtgttctngctagtgggggtggggttgcgtgggcgcgggggggtgccgttctggggcctgcctgggggtggggggtggggcggggtcggggncgggggagtggctgttgggtgctgggcttggttcctgggtngcgtgggtgatctgtataacaaacccccttgtcacgngtttacctgcacatgtaccccctgnacctaatttttttttttttaagtggttgccagggggttagggaagaaagggatgaacaggtgaagcatagagaagttttagggcagtgnaactattctgtatgattctataattgt

SEQ ID NO: 654174 - DNA, 687 bp, Homo sapiens
ccagtcttaattttctttcctggggctttataccccctcccgcgcggttggttttcgcccctcgacaccattgtatcttgttggccccgaacaattttttgtccttcccccccaccctgatatttcctttatggtatagatggtaatagttatcctcttcgtctcactagttgcttatcaccgccggcttattcttttatgagtcttttatatatctatgacggacaggccctccaccgtctcagagatagttgtgttataacgaagccgacacaacccaactgtgtttatttgcctttgtcacccccctacaacgctctttaaaaacactccctattacgccctgtgcgacgagctcgtcaaaacacacttgatgatccaatccgtctgtgcgctctgtaagagacttcttccacgcacactttatactcgcaccgagaattgtatagtttgcgccctgctcccaatctatgctccataatcgatagtatgaaacataatcgttcatacaacaccacttcttgagcttttttattgtcccttttcttgattccctcatttttcccctcgtcgtttataccctcctcaatttacatatactaccccactgggaggatttttctaaaagattcacacacatctcttttcaaaaaacatctttcgaaacaatcaccacaataacaaaca

SEQ ID NO: 654175 - DNA, 156 bp, Homo sapiens
ttcttttcttctctctccctccctcccccacttgctcatgtctccaaatttctcacttggggtcaatcaatcaatccagctttggctgcatagccaacacccttggttgcacatttaacacatgtctcgtgtgcattcagcttgagccacccaaat

SEQ ID NO: 654176 - DNA, 180 bp, Homo sapiens
tgagataccttaattgactattgaatagaatgctgaaccagcctatgaataacctgggataaatcccacttgagggtataattctaacatccctgccatatcatgactactaggtatctagatacttgctccatattctacagtacaaactagtataaatcattgccctttatatagtac

SEQ ID NO: 654177 - DNA, 321 bp, Homo sapiens
  misc_feature (181)..(181): n is a, c, g, or t
  misc_feature (260)..(260): n is a, c, g, or t
gtaagacactgatggtaatagtttttccagggttagtttttagtttatgtgttatccagaactttattgtagaatttgtccataataaatgtttaccatcatttctaaatatatatggaatgcctattaccctgaacctaagatagaaaatgctggttttttgttttgttttgttttgttnttaatgcagataacaagtgagaaggaaagagttaaaagatgtgcaaattagttcaggccagatgaattgcccctatatnaggcaaggttggtatctgcagtggtgaaattgtggcagtgccatcatagttctcagtagtt

SEQ ID NO: 654178 - DNA, 232 bp, Homo sapiens
ctcctcttgcaggtactcaagtccactggggtgctccctttatctttatcaagaccttggaaggacctccctgctggttttagaaaaagagaaactataattttacaaggaaaaatttgaaagaagaaaaatgttacttcagtgggatcagcacttcaaggacagagcttaaaatgaaatttactaatattttagagagctcatttttaatgaataataaaagtgaattatc

SEQ ID NO: 654179 - DNA, 989 bp, Homo sapiens
tgctccgtcctgtcggctggccactgccctcctacggtgccaccatggaccctggctgcactccggtccgcgtcccccccggggatcgccgtcgatcttccatccctgggcctcgccgccccggtctctgactccagcagcaccagctcctggtggaccacatgtggaaatgggacgctccagatcccattctgggagtcactgaagccttgaagagggacaccagtagcaaacagatgacgtctgggagttggtgcctaccggtgatgatcattggacagtcttgcgttctgcctagtcgtccgccaggcagaggcccagcattggcggaacgagatctggacgaggaatatgctgcccattgggggactgggtgaatcttgcaatggcatctgcatgaactatccctgggtgagaacagcgaagtcttgaagagtggccggttgtcactgtgcagaccatttctggaagctggagccttaaggatcggagccagttttctgcaaagattttttaagttcagccgagatgtctttctgcccaaaccagacctggggaaaccacacacccatcttcagggatgctggcattgcagctacacggttatcggtattatgaacccaagacttgcggtttgacttcacaggcgctgtggacggatatttccaacaataccagagcgagtgttcttctctgcatgcctggggccaccattccacgggagtggacccggggtccggacggggagcattgcaccgtggtgtagaaagggactcttgcgtctttgctgcctccaggtttgccggtgatggtacggacctgggggggcccactgcggcgttgttggctgcacattgcgagctgggttttttgggggaggctaatgtggaggacccgcggacgaggtgctgcgggtcttccccatgggggtgataccctaagcagtgcggtgtcaagcgcctgtgtcccgtctcgttctctttctctga

SEQ ID NO: 654180 - DNA, 441 bp, Homo sapiens
  misc_feature (162)..(162): n is a, c, g, or t
  misc_feature (189)..(189): n is a, c, g, or t
  misc_feature (195)..(195): n is a, c, g, or t
  misc_feature (227)..(227): n is a, c, g, or t
  misc_feature (282)..(282): n is a, c, g, or t
  misc_feature (284)..(284): n is a, c, g, or t
  misc_feature (346)..(346): n is a, c, g, or t
  misc_feature (361)..(361): n is a, c, g, or t
  misc_feature (381)..(381): n is a, c, g, or t
  misc_feature (383)..(383): n is a, c, g, or t
tgtttatcgatgccaccatcatgcatcaacatgatggtggggagtaaatagcacaccaggttaagtgtctgattctgcatatgcttgtctaatcaccacgaaccatgatatgcatgcagagcactcaaagcttttttttttttttttttggaaatagggttncgctttggtggcccagtcgggagtgcnggggcnccatctgggctcacggtaacctcggcctcccnggttcaagcgattctccggcctcggcctcccaagtagcggggattacgggtgccngncaccacactcggctaattttggtatttttagtacagacggggtttcactatgtgggccaggntggtctcggactccngacctggtgatccaccctcntnaccctcccaaagtacggggattataggcgtgagccatggtgcccggtggtggcatcga

SEQ ID NO: 654181 - DNA, 108 bp, Homo sapiens
gcggccgcctactactactactgctcgaattcaagcttctaacgatgtacggggacatgtaggttgtctaaaaataaaatgcatttaaactcatttaaaaaaaaaaaa

SEQ ID NO: 654182 - DNA, 729 bp, Homo sapiens
agctggacggtgcggcgcctcgggattactcgtggtgcgcgctggcttttggctcccgtgccatctgaactctgtctcagcgtcaaaagctgctgcgacgaacctgtctgtagcactgaaatgccatacctcgtcggggtctcctgtagcctcgagggctcccacacggtggcttacggaacccacaggtcttgtcgcgtcagccgccccggacatggtcgctgacaccggtgtctggagacagggatggtccggacggcgcggatgaggagagtaaggtcggctcgcgactgactgcacgctacgtcatgtctcggtcccgcttgccgggaaaggccctgactgtggacgtgattggaaaagcaggagttgcctccggattacgggaaaatcgctggcgcgaagatcgagggtgtgttaccctcaaattggtcatttaccgtacacggaagaaccgccacttgtaggagaatagccgcaaccaaggggaaacctttgtgcgttgtgcgaggacgaaaattggtacagggaagttaaagtaagtatttccaacgttgaggacccaagacgacgagggaaattgagcacgtaatagaaaggtgcacaaaacgccatggcataccttgacgattagtaagtagaggaccacggtcctactgcaaaaaccagagaacggtgccactggaacactgaagtgaggtcaggaactagtacaagccagtgtcaccc

SEQ ID NO: 654183 - DNA, 240 bp, Homo sapiens
  misc_feature (7)..(7): n is a, c, g, or t
  misc_feature (124)..(124): n is a, c, g, or t
gaccccncttgtccctcctccctcccctgttgtctggccgtcgtcaaccccaccttaacgctgtgttgagcccgtccttgggctctggtccctgcgggcagactctcccgggcccacggcggancgctgcataccaatttgccctgcaccgcctgtcccggagacgagcccgaagcctgccatgcggctgtgtcgaggatgcgtggcactgcgtggcggacagcgtgggcaggctcattt

SEQ ID NO: 654184 - DNA, 258 bp, Homo sapiens
gattgtgctgctgtatatgaggcttatgtgcaaaaggtgtgagtttgaaaatggcgtcagatctactgaagccatgttgaattcacagtgctgtttcaacactggggacataagtttttcagtcttggggacatctgctctttgttgaaaatgaaattctatgtgtccacacagtgactgcacatgtagctttatgagtcaaagtaggtctagttttggagaagtgcacctggtgtgagggtttttggaactggagat

SEQ ID NO: 654185 - DNA, 429 bp, Homo sapiens
ggctgaagttctgacgatgcttctctctagctttatgtgaagatattcttttccaccgcaggcctgaaagcgctccaaatgtccacttggaggctctacgaaaagaatgtttcaaaactgctctatgaaaagcaatgttatactctgggagttgaacacaagcctcacaaaggagtttctgagaatgcttctgtttactttttacgtgaggatattcccgtttccaaagaagtcttcacagagttccacctatccatttgcagatgctagcaaaagagagtttcaaaactgctccatcaaaacgaatgttcaactctgtgagttgcatgcaatcaacacagagaagtttctgagaaggcttctgtctagattttacgtgaagatatagccgtttcgaacgaaggccacaaagtgctccaaatatccact

SEQ ID NO: 654186 - DNA, 497 bp, Homo sapiens
attatggccgggggccactggggctctgtgctggtacacctaatccctgcacccaggggcgctggcattgtttacgcacccgctcctaagacgctgttgatgatggttgctatggacgactgctacaccttaagccaaagctgcactgtcaccctgggcaactccgctaaggccacctttgatgccattggtaagacctacagctacctgacccccgacctttgaaaggagactgttttcaccaagtctgcctatcaggagttcactgaccaccttgataagacccactccagagtcttcgaccagagcactcatatctcaggtgaggttacaacatggggtctttctacaagaaaaataaagtgaattaagcgtgtgaagccttctctttccactagatcatgccttgtggcccgtctaagctgcgtccactatagactttgacatgcttatgcatgcggtcaaattagggcttacttggcaaattcgccctattt

SEQ ID NO: 654187 - DNA, 177 bp, Homo sapiens
actcgtggcaggcgtgaggcacgagaatcagttgaacctggaagcggaggttgcagtgagccaaggtcggttgccatggcactcgcgagccaggggcagacagagcagatgaaacgaaaaaagacagaattggagttttgggaccaggctgttggatgggctctatcccgtggtaag

SEQ ID NO: 654188 - DNA, 104 bp, Homo sapiens
tctggagtgtaggttgccgtgagctgagttcgctacacttgcattccagcctgggctaaagagtgagactctaatctcgcagaacgagaagaagcgaatataac

SEQ ID NO: 654189 - DNA, 162 bp, Homo sapiens
  misc_feature (34)..(34): n is a, c, g, or t
  misc_feature (115)..(116): n is a, c, g, or t
tatatatgtggtaaaattatacaagaaataaaangcaagtaagtactggttggacaaagtgggtcacgcctgtaatcccagcactttaggaggccaaggcaggcagatcagttgnngccaggagtttgagaccagcctgaccaatatagtgaaaccccatct

SEQ ID NO: 654190 - DNA, 118 bp, Homo sapiens
aattctaggcagcagccattcttcattctgggggaaggtggtcaggaacaaggagggagagaaaaatgtatagcatagtagctagcagtggtccgagcgtgatcaagagtgttttcaa

SEQ ID NO: 654191 - DNA, 869 bp, Homo sapiens
acttggaggaaaacacaccccggtctcacattaaagaagccgggacgtgtcggcttcaaagagaaaaggcaacatcctgttcacatggccactgctctggcaaaaacccacagctccggagcgaagccccagccccggcccggaccataccagggcgtccgtgtgaaggagccgagtgaagagaactgcgtgaggaggaagcgaggccacgccagcagtggggcagcgacactgcaccatacaggcggtggtgctgcacaccatcagcacccatggacagaccatacaccatcgagatggggtccttcctgcctggacatggaaggttctgtgatctgcagtgacagaggaggctggcctgatgtgccagtctggttctcccagccacatcccgggacaaccgtgcagaccgcacgtgagtcgccatgggtagcattacaccagagtatgtgcgcctatgaagcctgtcaagatgaccctcatactcgagattgagatgtagtgtgcagcacggggtgacctccagggtaacacggacgagggagaggacacctgccctgaagtgattggaccaattggaacattctaacggcaatattcaatcaagcgaattgtgccgtaacaaagagggccttcggaacaacagactgggagtgaggataccaccagattgcgacggagcgcaggaagacaaacgaggaggagactcatgactgatatatacgtccgatgacccatcaaggcgccgcttgtccaaaaaataaccacacacataccaatacagtatcagtatcgaaacgtccgggaccccaaggcacatagctcggggcctcctagaatggacaatgatacagaatattcgaatgcat

SEQ ID NO: 654192 - DNA, 646 bp, Homo sapiens
caccctcacgctcctttaaaaggtgatcaaaagtaacggaatcgagcccagctgggcctgagtgcccatgtgcagcgtcccacaaatacccgctataagagaacgaaaccaacatcgctggggtgcggcccatcatagaaggtaatccccggggtcagttgttggaagagatactcctgctttagctagtcagctgggagcaaggcatcaaatggctctgggcaacatgttgtcggcgcatcagtgatgtttctagttccacaatggcccttttccaattgcagacttcaatctgatagatcacaggatgcctcattatcatgctaagaacaaagggtaaggaatctgcgttcctgaagtgctcagtttaagccgtgtcttcggaaagtaatggacaggctaggcaagtgctttggctaacctcacctgtagctagcatggatagtgtaagactcaatgtggggaatcctgcggcttccctgagagaatgcattttatacaaggcccagttgtttcaaggtttcggctcgttcacagggtctggtggaccaggcatgtggccaaacccggcggttgggttttacagagtaggaagccctcgctcagtaataaagcgtatgttatgtagaacatcatcgcccaaaga

SEQ ID NO: 654193 - DNA, 162 bp, Homo sapiens
ctgggtgacagagagagactgtatctcaaaaaaaaaaaaaagaaaacatggatataaattggtatggaaagccagatggttgcagatttgttgatttccagttctcccatagattttatagtgctcatgaccagcctgggtgacagagagagactgtatctc

SEQ ID NO: 654194 - DNA, 1346 bp, Homo sapiens
  misc_feature (1026)..(1026): n is a, c, g, or t
ggcgaacgcggagagctcgccatgaatggcctcgggcacgctatgagagtataaggtagtggggtcgcgtgcctgtcgcacctcccttaatatgcgcataagccgcccctctaccagcaatgctgaattcttagcggcgcttaatccatgtccgtcgccataagtccccgtcttcatcggtcactattgtatcgtccagctttacaagcaaggatgacatgaatgtccttccagggcgacgcattagtcatacatgagggcgggctcgtgagacgacatgtcacgcctcactcgtgggctgatagaagtttgcagggaatctcgtgcatgcgtcgttatgattacgccagtgagcggagatcaccaagatatatagtacctggtggatacacggtggagccctgaatccacaccgccaggaggcattgggcatactcgacgtgctaaactgacaacgataggtcgtatgcacgctggggagactgagcccaaagaatggtacattccaagttccaaggccattcttggtacaagggtatggcagtgagagtccattcaggggcaccattgtcaacatgctttgccccgagccaaggcacacggagggttcggtgcggataagcctaggtttttccaagcaagtagactccccaaagatattcagaggatgtgcccacgacttgccacaccgctaaccgtgggtgtggcgcatatgtgggcccagctgaaagtcgactaaagggcttaacgtgccatatgcagggctaaaccaaatagtaaggcggccccacgaagaaaacacccttttatccacttctcctaaaggggtgtggccaaggggggcccccatcggaatagcctgggagggctgtggttgccccgcccaaaggaatttagacccctttgcatggggaaacctcggccgcaataaatagcatcacataaagacaagtaatacaagaccggccatcaggaaagggaacaccattacgcgatcacacagagggtagagtcacgatcgttgcnaaaaacagggacgacacgtggtcatgataattcccacgagagggacggagcccaccacagtgtggttgagcaccaaggagtaggagtagatgacgttggcccgcctttggacagacccacgggagcttgtcaaaactctggggagatcaacctgacacacagaatgggcgaacaacaacacagctaccgtcgggccagaaggccacccctccctcaatagccagtgagaggggacccgggcacgaagaaaatcaagacgttgcgggacacaaagccggcactcagtgggtctaccaacagcgggcgacactatcaatgga

SEQ ID NO: 654195 - DNA, 104 bp, Homo sapiens
gagttggtgggttacctagactatagtgcttagtattcgcagatggactatatttatgtctgtagaaagctaacccagcagttgctttgtgggctcaaggctca

SEQ ID NO: 654196 - DNA, 369 bp, Homo sapiens
tgccctgtgacacgaggtgtttgtgttttgtgaggacaccttctccagaggaagagagggatgctgtgttccaggtggtgtcgccgtgggtgtcgcctgtggcctctccggtgtctccccacctctctcttctccacccaccccccactgtgtgtgctctcccttttgcccccatcttgtgagagtgctgtgagaggttctccctgtgttgtggggtgcagacactcggagggtgtgtttgtgtgggtataaaaaaaagagagaaaaggcgttttccgtggtgtgggctttttgcccaacaaaaaccttttacctgtgggaggtattttcaagctcccggaaaagaggccccaccaaccaagttttcca

SEQ ID NO: 654197 - DNA, 411 bp, Homo sapiens
  misc_feature (255)..(255): n is a, c, g, or t
  misc_feature (283)..(283): n is a, c, g, or t
  misc_feature (287)..(287): n is a, c, g, or t
  misc_feature (304)..(304): n is a, c, g, or t
  misc_feature (308)..(308): n is a, c, g, or t
  misc_feature (330)..(330): n is a, c, g, or t
  misc_feature (337)..(337): n is a, c, g, or t
  misc_feature (356)..(356): n is a, c, g, or t
  misc_feature (358)..(358): n is a, c, g, or t
  misc_feature (375)..(375): n is a, c, g, or t
aggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttcaaacgnctccacctggtgtgcacagctgcctggntcanttgtacttgggggcatnaggntgtcctccgattttagtggagnttcctgntttagagtgtcctagctgntnactggctgggtgggcantaggggtacccttgcgttccttcggaaaagccagag

SEQ ID NO: 654198 - DNA, 88 bp, Homo sapiens
aaaaattacggctaggtacgaggccgcgtgtttggttgtatggctccgcctgggcaggttagagaaagaagagggccaggcaccacgt

SEQ ID NO: 654199 - DNA, 273 bp, Homo sapiens
cttcctgactcagcaggatccctctacaggatcctgccaagtcagaggatcgccacgtacagtggctcacacctgttatcccagcactttgggaggccgaggtgggtggatcacgaggtcaggagatcgagaccatactggctaacactgtgaaaccccatctctgctaaaaatacaaaaaatcagccgggtgtcgtgactggcgcaagccttgcgagctactcgggaggctgacgcaggagaatgacatgaacccgggaggaggaacttgca

SEQ ID NO: 654200 - DNA, 99 bp, Homo sapiens
gacgccaggtattactgcgcgagagcgtgggaagtaagaattgaccatcgttacttctttgacctatgggggcagggaactctggtcaccgtctcctca

SEQ ID NO: 654201 - DNA, 120 bp, Homo sapiens
gcgcaagtaggtctacaagacgctactctcccctatcatagaagagcttatcaaccttcatgatcaagcctattatcaatttccatatctccttcctagtcctctattcccttttcccta

SEQ ID NO: 654202 - DNA, 273 bp, Homo sapiens
agaaatgatgacaaaagaaggaaggttttccaagaagaaacatttttttgaaagaattctttggtgggtccggtggccagctactttaccagcttttacagggtaattcactctacaagcagtctcacacaaaagactacatattgtatgattctgtttatatgaaatggccagaaaagggaaatctattgaccaagcaaattaatagtttgctaccgcccaaggattggcttccaaaaggcttcaaaaaacttttggaagaagggaaaaaat

SEQ ID NO: 654203 - DNA, 208 bp, Homo sapiens
actcacccccgccacccggccgtcgctgtgctcgcagtcctcttcccccgaacctgccccgcctccccagcccgcccattggccccacgcccgacgcgtcagtggaggcccaggaccaatccacagcgacctgcacgttcagagcccgccccaccctcccgccgactgccagccaatcaggcgcgagcctggccggggcagcccaaac

SEQ ID NO: 654204 - DNA, 115 bp, Homo sapiens
gcaagatggcagaagtagagcagaagaagaagcggaccttccgcaaggtcaactaccgcggcgttgaccttgaccagcttcttgacaatttctacggacagcttgatgcagcttt

SEQ ID NO: 654205 - DNA, 296 bp, Homo sapiens
cggtaccggatcggaagtaggtaggtctagaaggtcagttgcagtttgatttggggctggggtatcctgggcaagtgtcttcagaactcatccaagtgacgagacggaatagactgagatcacctcgttaaggttttcccttagtgacgaccaaggggatttatgtaatctctgagtgaactacatccctattcgcagccgctgatgaatatgttctccaggacaaggcagcattaaaaggaaatactgttcagtagtttcttggcatgccaaaaaacctacctatttcacaatcg

SEQ ID NO: 654206 - DNA, 160 bp, Homo sapiens
ctgtgccatggggtctgtatctatctttatgtgtgtgtatgtctctatatatgtatatttttctgtgtctatcggatgtcccctttatctctaggtaggactctgtatgtcgttgttatcgtctccctgtgtgtccaatggctgttctctgctagctgga

SEQ ID NO: 654207 - DNA, 345 bp, Homo sapiens
gactgcctgaagggacgaacatgctcgaatcttgagtcccatcaacacggtctcttcgaatcctaaagtcagtttacattcccccgagcagatactgagtataattaacagattcttagcagacatcttacaatttcaaacaccagatactgctaatagatttgcatgatttaatatcgtattacacttaaatcagaaagcaaaaattaaatactgctaagtatttgccacgaactcaaaggtgaataatacgataaaattcacgccaggtgctccagcagccaggttgtatgaaagcaagaatgtctttactggggagattacaaaaggtcccgcaggacacta

SEQ ID NO: 654208 - DNA, 2161 bp, Homo sapiens
ttcgggagccggccgggagagtcccgacgacgtcgcgaactcggagagagggcgcagggggcagacgactcccctgccgacagaccccctgcacctcgggctcggctggctgtggcccgcagccgaagggtgccatgccccagccaagccagaaggcagcgggcaccgcgccagggcagcgcttgctccgaaggcgaacagacagggtatggggcaatcaacaacccataccaacagggccacaggcacgcatctgacggcagcacataggaagggcaacggcccaccagaaacatgggcattggcccacagagggagaatcagatccacgcgggcattggaacccaggggaaggagattacaggcaagcacaaggcaggatggcatggggcggcgggaaacgcggaggaacaaccccaaccacgacagggaaccaaggaacagacaaataggcgcagagaagaacacctgaaaagaccacaccagaaacaaacaggagaacacaaacgcaaagacgggaacagcaagcaggggacgacacgcgcgcggacaagagccaacacccagacgcagacgacaacgacacaagaagaaaaacagaacgaacaaggcgcgcgaacacaccaaaaaagaagaaacagagaagacaggaagagaaacaggaaagagagagaccacaaagcaaaaagaagaagaagaaaaaagagagagagagagacaaaaaggaaacgaaaagcggcacgggggcgcagcagacccgaggacagagaaagcacggagcgacgagcgacacagaggaggaacaacgaaaggaaaggcgcacgcgcgcggcggagacgagcgggacagagacaagccacaagagaagacgagaagagcgcggacacgcccggagcagggcacaaggcacaccagagggcagccaaaaacaacaccacgagcccaggcaacagagcgcggaggaccgcagcgaacaaagcaacacgcaaccacggcccagggagaacccgccacgaagcacacagggcgggacgacaagaagaacgaaagagaacaaacagcggagcacagaggcaagcaaaagagagaaagcggccggacaagcgaaccagaagaaaacacaaagacgacgaagagaaacaacagaggcaaagacacgggagcaagaggagaaaaacagggaagaggaaaacgcaggaagaggagaaagcgaccgaccgagcgaaaaacaaacaagaacaaaacgagaaggaaaagggcaagaagacaagagagaagcaaggcggagagagagagagacgaacagacagcgacaggccacggaggaggaaaacgcaagaaacaaacgcgaagcaaaagcggagcggaaaaaggaaaacagaacgaggaagaaggaaggaaggggaagaagagacaacagaaacacacaagaaacagaaaaacaaacgagaagcagacacacgaacagggagagagagaggacggcaagggagcgacagagagcagaaccgcccacagaagaaggacaaacgaagaagcaaagaccaacaacgaaagcagaaacaaggaaaggaaggaaaagagagaaacgaaaagagcgaaggagaggagaggagagatgaagaggggaaaaggaggaacaagaaaaagagaaagcagaagaggggacaaggagaggaggcgggaggagcgagaaaagcggaagagagagacagacaaggagaagaggacgacagaggagcaaagagcgaacaaaggacgagacaaagagagagaaggagagaaggagaacgagagaaacagaggggagaagaggcgcggggaaagagagaaaggagagcaggagagagagcagaaggagagagaaccgggcagacggcaaagaaggaccaagagagcgcagagcagacagaacaagaaacgagaagagcaaggacacacgaggacagaggagaggaccgacaaggaacaaagacaacggaaggcgaagaggcagcgcaaacgagacagacacgagggacagcgagaggcggagcagcgagcaaccagacggcgccacgacgaacgacagagaacgaaagagaagagaggagagcgaagacagaccagagcggccgaggacagcaagcgagagggggacaagaaaggcagagcggcggaa

SEQ ID NO: 654209 - DNA, 1257 bp, Homo sapiens
cactacagatgtcgccgccggtctgcctgcgatagccccggaccatggctctgtagcctcgaaccccatttgtgcccccggcccgatcatccggagctcaccacgaccatgcgctcatccgcatcccaccttctttcttcagaccgaggccgcacgaccgacctcatccttgacatgcagaccatggcagtcttccactattcgcacattggatgccatgtcttcgccacaccatgagacatccatccagagaccatcgatgccagcatgcatggatgcagcactcatccatgattgccactcaggtgcccagaaacctgatgctacacgccatgatcacatcctggacgaccctgggagctggagctggacagggaccctgctccacagactagtgggactgggatggctcgatagactatgggaacactccaccccggacccatgcaccaccacatggcactcccatacagaaggataccattgagagaggacgccacaagagaagggcgcagggcatacacacgaagagggggcagcagaccccagggaccaggagagaatggcaatcatctgaaaatggaataaaaatgacggcggcagattatgacttcttcaacaaagcgtcataccattccccagtcatggcacgcgccctcgcccacataaccgacgacacaaccaaacacagacagcccaacacacagaaaccaccaacaccaacacgacacccaccacaaccgaaccaacaaacgaacacaaacagaagcccccaccaaacacacaccgcagccccaaccccagcaccaccaaaaccacaacaccgcaaaacaccgacccaccgccccccaacgcacacaaccacccagaaacccaggcaacacccacaacacagccaccaccaaacaatacaacgacacaaacaccagcacccaacacacccacaacaaccaccaccacgcaaagccagacagacagaacagacgacacaagaaacagagcacgagaaagaaacgaagcaacgacaaaccaaccaaccaacacgcggaccagcggacgaagcaggcaacggccagcgggcaacagcacagcacgaccgaggagccgccccggagccacgggcaacggacacagcacaaaagcgaaagcacgaagccacgagaagcaccgacgacaagaccaggcacaacagcagcacgacggacccggacggagtaacacgggcgcaagaagaggactcacaccgaacaaaaaaga

SEQ ID NO: 654210 - DNA, 425 bp, Homo sapiens
ggggtcagaggttaaaaaaaaaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaacctgggggcccgcttggcccaagccaattttaaactggacaagcttaatcctggggcccgaatttgggcctaattggccaatttccccttatggggggccgattaacattcaagggcccggggtttacaacggttggaatgggaaaaccctgggggtccccaatttaaatcccttggaagaaaacccccttttccccagtgggggaatacccaaaaggccccgcccgaacggcctttccggtgccccaccctaatgggcaatgggaatggggcttttttttt

SEQ ID NO: 654211 - DNA, 956 bp, Homo sapiens
gcctggctggactcctcgtgatagttcccggcacgcggcggccgacggtgacccaggacattgtgctctgtgtgccggcgctgcccgctgcggggaagcacgcgggtagcggagccatgggtgcgacgctcccagtccctgaacgagcaaacgtgcaccttatctatcccggaacctgacaggaggttctgtcggtgcaatgcagcaagctgaacgcgagatatctgcaaggagcggtcaacttaccaatttactggcgtgaacggtcaaccatcgggcaaatccacatgtgtgcttactattgtgcccatgtctaaagattgcaagaccttcgttaagaggcaggggtgtagagagtaatcaagttctagcttaatgcgtgaacctccacggcattatctggatagcagttgaaatgccccatgggaaactttcctagtaacttccgacgtcagattagcttgtgagaattgtcgactcaaatgccaatagcatggagacgcaacttgcgtgtgcccctatggagaagcttacaatgtatcagtcaaaagggcacttgatttaccaggctcaggcatacaagatggtacaacgactaagactgttgtacaggactctcctcccgtgggtcacaccaagcagcgacttccaagaaagtgctggaatgctgagcgtggtaaacgacaggtggatgacaccctttagctagagcttggcctcatatataacctaccgggaactgccagcggctattgcgaatcgaaggaacgtactaatagaggaaaggtacacagattgcccaacaattttgggcaacacgcgataaagaatcctcaataacatagctttgtccgcagcctttaggcagaaactaggttaccaaagtccaggcgaccattgcgcatacgtccaggcaaggggagtccagtcatgcatgaagctcctcatggcctcca

SEQ ID NO: 654212 - DNA, 1599 bp, Homo sapiens
gacaatgctctgaggctctatttgttcaccggcagcatcacgcgctgtctcggtttctctgccgttctcaataaacagagagagatacgcacgcgtcggtatacatctgcactgatgtgcatcaagaacggtgctgacaaaaagtcttgggttatgcgtgaggagacagactgctccccgaagaccagtgactcttccatctcgcaatcggttgagctgcgcccaggactaatatggacgttgactagctggcgcgaagcagcccatcacatcgtaatccgtcaggttggcagcagatgacagtccctgaggaaatctaaaggccgatgtgtccattcccttagaggcccttggagaaggtacgcgcacaattaggagtcacttggacagtttcgttaacaccaactcggggcgcacggaacattagggaggaacacgaatactaggacaaccaacaagcactatcctgaacaggcaccggaggacttggctgtcggtagcgccgcgcgcgcgaaggaaagcaacccgcattggtcgtcgttggccatagaaagcgccgggaaagggctctccccccaccatcggaaaaaacgcaacgcaaaacgatggcctaggatccaccgtatcaagaaagaccgacattggaaagttttcaaaagcgattccaatagctatctcgaaacatctccgtattcgaggaacgaacacccaaccagggacaccaagtcgttcaaccggttaggggctcgaggttcggcaattcttggccccggtagccgcgaagggcttcgccgtaactatttcgccgaacctcgttacgtgcgatgagcggtactgactccatcttggtgtggcaccttttgggatgcgacttgagtgtgaacttttcgtggagaaaacgacaatgtgggtggtgggtatttccaccctcatacgaattgggaattgtcacctccaagaatcggtagcacgaaaggggggtgccactatgaaagtctcgtcgtagtcaaccccggctccatacagaattccacaatcccagttggacacagaggttcaatggttgacccccgtcgggacgttgaggtcccccggcgcgtttaacccccttaggcaccgcggtatacataacctcactgcgaaattaggaacacgcaaaatccgcgttcgggaccattttagggcgcggaaggggcgcccttaggcgattggcgattaacaacctcaattccaagcgtgagcctgacttttcgggagacaggacctctgtaataggccgaaatcaaattgcaatatcgcggagcacgaagccattgttgggcgctggatggggttccagaacatgcattggcgaaagaatctattcgccgttaccacgtgtccatgaatgggggcctccacgcagggatcgggcccaatacgcgtcttccggttaccattatactgtgctgtgagacagtgacactgtaaacggcatacacgctaatggcttctggcctcgcaaatgttgcgcccatgtgtatcacattgttaccccagttggtggtggcgaaaagtgaataactgtggttacgcgagtgagagtatccctgggactgg

SEQ ID NO: 654213 - DNA, 828 bp, Homo sapiens
ggcccggcccccccgccccgttgccccgcgttcccccgagtgggggcccccgcgccaaactcagacaagaacacgtcccgcgtgagagaggaaacgagtggtgcgcgctttgtggtgacaaaacgtcggatgaggtgccccccaacatctccagaagtgctccgggcaagcacagccccactgcgtcgacaaaggggtccccgacgcgcaaacgccacatagcctaggggagcgacgactttccccagacaaccacaccgccggcggacgcccggtcagcctgctgggtcaatacatgtgaagcacagaaccgctggtcaggtcagggggctcaccgaccaaagccctgggacacaccacaggggccactcgaagactagctccacgattacccacaatgctgccccaccaaacgtccacaacgggcagaatactgcaatgatgccccccaacagccgcccgcccccccctctcgcgagaaccacgcgcggggagaacaggcgattccccgggaaccgagtctcgctttcacacatggcccgacatgacaatgcctatactcagataagagggcaaggggtttacgagaagacacggagggcctccctgcaaaactcactacgacgacagaatagagagcaagtagttgttggagggcccccgtagtgtatctgtgtttctgtgacgagccacgcgttgatatgagtacgagttcctatataaaccccacaacgcgtcttttatggggtaacacacctcggcgaccaacacatgtgttcccgcccgactttggcggccgccgctataaaaaacagaaaaaccaaaaca

SEQ ID NO: 654214 - DNA, 429 bp, Homo sapiens
actccgcttgatactctcctttgctcttttcatgtttaggagaataaaagtacttcttcaggaactggcaagccagggtttcaggagagtactgttgcaaagtcctgtccacatgtccactggtgcttttgatcttagaattcaatacattcaactccaaacataatgttgtcaattcagccaggtcgttccgaagaccacttgcaatggcgcatggagaacatatttgaaacaggtcatccaaagactcccttggactccttacacattcacatgctgttttatcaacagattcttcattgcctaaagagacccttttttctttttcattatcttcatctaatattcccttttttgattcattaactaatagcacatccttggtcaatttaatggatgagttgtcagattctgaaacaccctgaaaag

SEQ ID NO: 654215 - DNA, 138 bp, Homo sapiens
  misc_feature (3)..(3): n is a, c, g, or t
tangctcattcatttctctaacaccagtaatatcaataattttcatgatttgagaagccttcgcttctaagcgaaaagtcctaataatagaggaaccctccataaacctggagtgactatatggatggacggatatat

SEQ ID NO: 654216 - DNA, 177 bp, Homo sapiens
  misc_feature (152)..(152): n is a, c, g, or t
agtaaagcaggtgcttaacacaagtgtatcctttcacgtcttactactctccaaatcggagtcatcacttcacttcagttattcatcattcatcattccttttgattctttgaatgcattaaggggttcctctacagctttcctaggaggtngtatagtcttctgatgggacgaaga

SEQ ID NO: 654217 - DNA, 231 bp, Homo sapiens
gtacgcttcaactcacacgacgtgtaaaaaaaaagtggatgtgaaaaaatgaaaacagatcctgggagggggcgggaaatacaaggcatattttttaaaggaggattctcataagtgaagccatgacttgtcttgcgggggataaaaaagggcttgggagattcatgcgagtgttcccatcggagacaaaagcagtttctctccaactccctctgggaaggggtgacggtg

SEQ ID NO: 654218 - DNA, 230 bp, Homo sapiens
  misc_feature (121)..(121): n is a, c, g, or t
  misc_feature (145)..(145): n is a, c, g, or t
  misc_feature (156)..(156): n is a, c, g, or t
  misc_feature (217)..(217): n is a, c, g, or t
  misc_feature (227)..(227): n is a, c, g, or t
gccagaactgttatgagattaacatttctattgagaagcttttgagtaaagtactgtatttttccatgaagatgactgagatggtaacacttcgtgtagcttaaggaaatgggcagaattncgtaaatcctgttgtgcagatgtnttttccctgantgctttcgtattagtggcgaccagtttctcacagaattgtgaagcctgaaggccaagaggnagtcactgtnaaa

SEQ ID NO: 654219 - DNA, 116 bp, Homo sapiens
agcggctccaacttcagttttctcagttttaaaaataggaataaaataggcgttcccgtcatggctcaatggttaacgaatctgactaggaaccatgaggttgtgggttcgatccc

SEQ ID NO: 654220 - DNA, 314 bp, Homo sapiens
tccgggtggtgtgctgtacacggttctactggacgtcgacaacgctgaccacgcttgatggcagagatgaccacccaagtgttctttgtcgccaacgaggcgcgcaacgtgctgaccgctcccatcgccgctctgcaggacggccagcaagccgatcggccacaagtgcgcgtagtcgccagcgacggcacgatccagacgcgcgaggtgcgcaccgtgcatcagtgaccgtgctgcgtggtgcagaattcctcgaacggcttagaattgacggcgacccatctgctgattcggtccttgcttgacgggctgcc

SEQ ID NO: 654221 - DNA, 315 bp, Homo sapiens
  misc_feature (56)..(57): n is a, c, g, or t
  misc_feature (73)..(73): n is a, c, g, or t
  misc_feature (78)..(80): n is a, c, g, or t
  misc_feature (100)..(100): n is a, c, g, or t
  misc_feature (107)..(107): n is a, c, g, or t
  misc_feature (114)..(114): n is a, c, g, or t
  misc_feature (135)..(136): n is a, c, g, or t
  misc_feature (147)..(147): n is a, c, g, or t
  misc_feature (166)..(166): n is a, c, g, or t
  misc_feature (188)..(188): n is a, c, g, or t
  misc_feature (207)..(207): n is a, c, g, or t
  misc_feature (217)..(217): n is a, c, g, or t
  misc_feature (265)..(265): n is a, c, g, or t
  misc_feature (297)..(297): n is a, c, g, or t
ctcccttacagctcgctggtgtgaatactacaacacatatgcatgctcagctgganntctgcactactataanacttnnntccccccaagaatatctctngggaaangtttttngtacgttacttaactttattnngctgctaattngcgcattagccggtaactngcaagtctggagaccacttacngttgagggtagctggaatnttagaccctnggcagtatttaagatttagacatttagccttgtgaaagttaccacagngctccatgtgattcattgactgtgagcctgtngtccatcgcacttagaca

SEQ ID NO: 654222 - DNA, 137 bp, Homo sapiens
atactgcttgtcaggctggagtatccactttaatactgcttgtctggcttatgatccactttaatactgcttgtccggctggtttgcatccttagagtattaaagtggatcatccagcctgacaagcagtattaaag

SEQ ID NO: 654223 - DNA, 829 bp, Homo sapiens
  misc_feature (4)..(4): n is a, c, g, or t
  misc_feature (85)..(85): n is a, c, g, or t
  misc_feature (91)..(91): n is a, c, g, or t
  misc_feature (100)..(100): n is a, c, g, or t
  misc_feature (103)..(103): n is a, c, g, or t
  misc_feature (106)..(106): n is a, c, g, or t
  misc_feature (118)..(118): n is a, c, g, or t
  misc_feature (138)..(138): n is a, c, g, or t
  misc_feature (143)..(143): n is a, c, g, or t
  misc_feature (146)..(146): n is a, c, g, or t
  misc_feature (151)..(151): n is a, c, g, or t
  misc_feature (175)..(175): n is a, c, g, or t
  misc_feature (188)..(188): n is a, c, g, or t
  misc_feature (192)..(193): n is a, c, g, or t
  misc_feature (201)..(201): n is a, c, g, or t
  misc_feature (265)..(267): n is a, c, g, or t
  misc_feature (271)..(272): n is a, c, g, or t
  misc_feature (276)..(276): n is a, c, g, or t
  misc_feature (303)..(303): n is a, c, g, or t
  misc_feature (312)..(312): n is a, c, g, or t
  misc_feature (323)..(323): n is a, c, g, or t
  misc_feature (333)..(333): n is a, c, g, or t
  misc_feature (342)..(342): n is a, c, g, or t
  misc_feature (345)..(345): n is a, c, g, or t
  misc_feature (355)..(355): n is a, c, g, or t
  misc_feature (375)..(375): n is a, c, g, or t
  misc_feature (402)..(402): n is a, c, g, or t
  misc_feature (408)..(408): n is a, c, g, or t
  misc_feature (428)..(428): n is a, c, g, or t
  misc_feature (434)..(435): n is a, c, g, or t
  misc_feature (471)..(471): n is a, c, g, or t
  misc_feature (474)..(474): n is a, c, g, or t
  misc_feature (496)..(496): n is a, c, g, or t
  misc_feature (502)..(502): n is a, c, g, or t
  misc_feature (520)..(520): n is a, c, g, or t
  misc_feature (528)..(528): n is a, c, g, or t
  misc_feature (717)..(717): n is a, c, g, or t
  misc_feature (752)..(752): n is a, c, g, or t
  misc_feature (806)..(806): n is a, c, g, or t
cggnctgtgcattatcttgcaaccccaatgcccagtataataaacgattaagagaaaaaagtgattgggattattcctgattcanacagcnatgattacngcngcngtatcacctganatgaaaatggttaccaagcncaccnctnaagtnggaacagtaatttaaatgtaaaanaattatgaatggnatgnntcccccanacttttctactatagtgttagacctcttttgttgtaattatatattcattacatcagtcttatnnncccnnttcntttttagagaccaagtctcactatgtngtctaggcnagacttgaacncttgatttcnagtgatccnccngccttggccncccgtgtagctgggcctgcnggcatatcccattgcgcctggcacatnacattnatttttaagagtcgcagagnatttcnncataatatgggtaataatctgtttaaataattcacnatnttgggcattcatgtcgatttcnactttngccattatacacaaagcngtgatgcntgccggtatatctttgggaatgtctatcacttttagaattaaattctttagaagacaaatttctggtcaagggtatggcagagactactaggtatccaccaaattctgttttctccttcctacacatatggctgccctaccgatcaacatttcccagccttccatgcagataggtggtgtgcccatgtnactacatttttaccaataggatattagtggaaganatgcatgccatttctaggccagatccttacaacactggtcataactcctctgtnttatttttcctcttcttgccagc

SEQ ID NO: 654224 - DNA, 364 bp, Homo sapiens
  misc_feature (259)..(259): n is a, c, g, or t
  misc_feature (267)..(267): n is a, c, g, or t
  misc_feature (358)..(358): n is a, c, g, or t
gacagagtctcactgtctcccatgctggagtgcagtggtgtaatctcggctcactgcatcctctgccttctggcttcacacaattctgcctcagcctcccaagtagctgggactgcaggtgcccgccaccacacccggctaatgttttgtatttttagtagagacggggtttcactgtgttagccaggatggtctcgatctcctgacctcgtgatccgcccacctcggcctccccaagtgctgggattacaggcgtganagccgcgncccgacatctgtagacatatttattacccagcatttaccatggcagttgtggactttttaaaatcacttatattaggcacttagttgtttncctgcc

SEQ ID NO: 654225 - DNA, 426 bp, Homo sapiens
tcccagcctcccaaagtaactgtaggtgtaactctcaaggtcacatctgaggtcgagtcaggcctggtcatgtaatgtaaatgccaaacaaaatcctaggtgattttaacacatggccaaagttgagagtggtgttaaggccctccaacaacatacaaggaactagagggaagtgtttttaaacactaaaatgaaaagaactcaccgggcgcggtgggtcacgcctgtaattccagcacttttagaggccgaggtgggcggatcacttgaggtcaggagttagaaaccagcctggtcaacatgaagaaaccccatctctactaaaaatacaaaaaattagccaagtgcggtggcggatgcttgtaatcccagatatgcgggaggctgatacatgagaatcgcttgaacttgggaggctgaggaggc

SEQ ID NO: 654226 - DNA, 155 bp, Homo sapiens
gactccctccagtgattggtagatgcccttgttacctgttcttgtcggactccttggactggtagctccatctaccttaacacttcagcgacactgagagcacagtgatctcacatctccatcgaagactggacggggacacctgcgtatcctca

SEQ ID NO: 654227 - DNA, 181 bp, Homo sapiens
ggatatttggaggtcgggtaaacaaagacatttgctcctgaagaaatttctgccatggttctaagtaaaatagacgaaacccttgaaggcttatttcgggaaagaagggttacccatgctagttgttactttgaccatcctattttcaatgatgcccaacggccaaggcaaccataggacg

SEQ ID NO: 654228 - DNA, 373 bp, Homo sapiens
  misc_feature (33)..(33): n is a, c, g, or t
gcgactttcctccccgtcctcctccattgggcntttcatgggcgtaatggcataggtggtgcttggtgggatctgaacggtgtagtccactgggttttcgttctttggtttcttgtgcatcttggaaggcacattgtccatgcctaggactttatgcagctggccggagtcatcgatccgcagtgcgtaatgcgcactctgtgtcagatctttccgatactgtgtgtgtagatgccctatagcatgagcggcttatttttcgcatgggtcagagctgacagtaccgtgtgacatccccacgtcatgttgccatactatctggcactcaaacagggtctctagggtcacggggggtcctctagagtctccctgg

SEQ ID NO: 654229 - DNA, 699 bp, Homo sapiens
  misc_feature (1)..(1): n is a, c, g, or t
nactgggtcttttgcaaattagggatgattatgctaatctcactcccaggatatagtgagacacaagtttttgtgaagatctgacagagggaaagttctcatttccgtactattcatgctatttggtcaaggcctgagagcaccccgggaccagaatatcttgcgcccgagcaccagtacctagatattaaaaaatactgtggacaagtatcttgaggatgtaggttcttttgaatacactcgtataccccttaagagcttggagcttaagcctataacagattgatgcacgtggtggggacctgagctagtagccctagtaaacacttaagtaagatgttccaagaagaaatggataatgttaagccattcttgattggacctcatagcttattttagttaatcttttttttgtcttttagccggtgaccacctggttgaaaaaatttgttattctcccgagaccagtaaataggtgagtaggggtggtgcaagtgaattcgttttcatttagagagccccctctgtaccagataatccaaattcaaagattgaaaggaatcacaaagccagccccagtttatgtaggtcttgatttgaatgtcataattgcagtgacaggacattgccccccactttatcctactaccatcaatgttgtgtttattccgtccaattaaaaagacttgcttcccggga

SEQ ID NO: 654230 - DNA, 315 bp, Homo sapiens
ttaacctgaaaactagttcaggccatgatgggaaaggggaggtcagacatgtctcattataccttcctcccttttggaattcagaaaaacctgaccagcattaacaccaatacagatcttaagtctaatagaagagactctttcaatcgtgataagaaacatttacaatctagtctctcagaagcctgatatcttgacggtttcatctacttaataaacccttggtctccacaaccccttatcttaaccgagggattcctttctattgatcggaagcctttagacaattacttaactctcccaatagcgaatctg

SEQ ID NO: 654231 - DNA, 1267 bp, Homo sapiens
  misc_feature (916)..(916): n is a, c, g, or t
aaaggttgtcaacagagtgtaaagagtggcgccacttgggaaaagccggaagaaaacgtgcggggtcacaaagaaaaagagcaaagtcccgggcacccttagaaggccccccggcgccccttgtattttcctttaagcacccagggacccggcaaacaaggggaaaaaatgcgccaaaagaaacagtggaatttttagggcgcccccgcaacacagcgccacaaggggacacccgacgtgcccacaaatggggaattggggcccctcccctcccactggggtccatagaacccttcttcaagggcccctggacaaggcccaaatgttttcgggtttttttttctctgttggtgttaaaagactggcgcccctgcccttcctctcgggaaagaatgtgagagtttttcttgaaggacccacggtgttaatccagagttccagagggacatttggcacccaagaggaattcccagatgttcttggccttttttgtctcctcttgggaccccccaaacctgcccctgggggaaaagaggttctctctcgcctgttcacacaattggcttggcgctctcttaagagggacaccagaacaccaggtggacccccccagagtataagccatttcccaccccgaataccccagaggctgggcgtctttgccaccttaagaagaaaaaatttgcgcacattaaaatggaaattttcgtgtctcccacagaggaacatgagccccccttgttccagaccgtggagacccctgggggacatgtgttctcccaaaagaccccagatgtgaaatagttgtaagaggataagatgggggctctcttctctggggcggagatagcttctcccctcagccttctcagaagaggagagctcttatacccctgcgtcccctgtcttttggctntgaaggggctcttgggagaacaaaaacttggcaaccttttttctgtggtggagatctttgccaccaatttcttgaatcaagagagggtggacaccgaaacactttcccccgaggctcttggcctttgcacatttaatttaaacacagtgccttgctcggcgcccacccacccccctcaaagccccacagcacagccctcacacacacggccccgggagagggaaagtgtgaggcgccttggtatgacttataaaattggaaatgtcatctaacccttaagtcacagtgtgaacaccactaaggaacgtgtgtaaaaaagtacacatttgtctttttataaaaagtaaattg

SEQ ID NO: 654232 - DNA, 160 bp, Homo sapiens
taggaatgggaggatgctatgctcgtatgtttctcgctggaatatctgcgctcgtcctcttgctcatccacatttttggaatatgccaaaccccagtcaaatgtccgctacctcctccagggagctcccagtcagaatggttctctctcccgagcaccag

SEQ ID NO: 654233 - DNA, 109 bp, Homo sapiens
gcggccgcctactactactactactgctcgaattcaatcttctaacgatgtacggggacatgccactacactaatgcctggcgacagagcgagacttggttccaaaaaa

SEQ ID NO: 654234 - DNA, 293 bp, Homo sapiens
  misc_feature (5)..(5): n is a, c, g, or t
  misc_feature (122)..(122): n is a, c, g, or t
cgtantgtcgagagcagagactggcactatcgaaagagtctggctcagcatatcattccaagctcctccttacaagagagagcaagcacgggaatcctttgcactgtgcatgctcctgctgntttaaaccctatcttgtctccagttttccagaagaaatctctaatggcccgcagcattattatagctaccgggaaggtggcatgtacatgtctcttttccacgtagagttcttacataaaatctgatcctgccatcattgctatcatactggcttaatagacattagtaag

SEQ ID NO: 654235 - DNA, 860 bp, Homo sapiens
  misc_feature (494)..(494): n is a, c, g, or t
tctaaaatgacaggaatggtacgcttggacccttacctctgctacagtgggttagatacaaatgacgatagtaacattcatagaaagagaggtgtttcacagtatttgtctgatattagaaaactccaagagagggcaaatcctggtttctgatcccagaatacagatgacatattgattgtaggcacatgatgtgaatatacagtgaaggagtggtggcttgaggaatttgttgcagaagtttcttggcttgtgttttaaggctgaggagtggaaaacattcctgtgtgaaccatctagagagacttgtggcaggggtagatttctttggcatttgcgcaccggagtccgaaaccaatgatgtccatagcatttggctgggctaacgtctaaagtcgttagctttagacgagtatgagctctcactctgtgttacctggtgaggtccctgtagggcattgttgagttccagtcctgaaacagagccactgagnccgtgtcacagatcccaggttcgctaagctcaggtttagccatgttatggtttatccgtttctccaaggtccattccacaaactctcatatagatacgaattaatttcagcgtacacacatgggggtcctctattcttcagatacctaagttgtcatatctggggccgggagacccttaaaatattggagccaaaaatactgcagaccgtgtatctaacttttcaatctccttttcttcttacagtccagagcttttagcctccccattcattcttccaggcctcctccaatagcacccttagcgcgggctgaaagcacttcttcagtatcgtcaaccaattccttgagcgcagcaccactccaag

SEQ ID NO: 654236 - DNA, 164 bp, Homo sapiens
taaaccaaccaaaaccctggggggtatccttaaaaaagtggcttaaaggatttggttttaaaaggaaaggtaaaagaaatgtgccagcccccaatgtcccattaaaattttccaaataagggaactaagcccctggggtattaaatttagtccttttttttcca

SEQ ID NO: 654237 - DNA, 223 bp, Homo sapiens
aattttcatgcagtcacttaccaattttttctttcatgaatcatgcttttggtatgtatttaaaaagtcattgccaaactgaaggtcatctagatttttcttctatgttatcttctaaaagtttagtagttttgcattttacatttaggcttattaccaattttgagttaatttttgtgaggggtgtaaagtctgcatctatattcttttttttttttttttt

SEQ ID NO: 654238 - DNA, 667 bp, Homo sapiens
aaggcaaagttggcaaactgtggcccccccactgtcatatttgttaataaaattttattggaacacaatcaaaaaaaaaaaaaaaaaaaaaacccacgcttccgtgcttcaacttgggggtaaccctgattctctggctggggcgggcgcgttggcccgccgcactcgctgtggtttcgaacccggcgggggtggtgggggcccgggcccattatgggccggggaaagccgggccccggtattcccgaattgggggaagccgggaagggacggggaagctgcaggaggtggagagtgtcccgggtttctcccgggggccctcaagtttgaaagcaagggcctccgtgccccgggcgctccaagggcgggccccttgtggcgccgggtgtccttgccggtgtgtgccgcagcgggcccttgtgttccttctacccccgtggtaccgggcgcgcacgcgtcgggtgtccagccgtcccctggggaccagctgggtcccttctaattaaggggacgtattccatcgactcaggttacagaagagtccgggcattgcttatacagggcagggaaattggtcctagggtgtaacgcttcggggtgtccggagcagctcttaagccgggcaaatgtggccggtgttgcccttggcaatccaaggagaacaggg

SEQ ID NO: 654239 - DNA, 308 bp, Homo sapiens
  misc_feature (25)..(25): n is a, c, g, or t
  misc_feature (231)..(231): n is a, c, g, or t
  misc_feature (248)..(248): n is a, c, g, or t
  misc_feature (265)..(265): n is a, c, g, or t
cattttagaaattatgagggttttnccccaatagaggttttaatgtgagttttgcaaaaaggctagacagctaattcgtctctcaaacaacactgagaactgtggatttctgaaagaagtgaccccagattcactcacttaaccacttctagctcttaagtaacttaaaattgacaaagtacggtatcaaaatgtgaacagtagcagatagtaagatattttatgaatgancttggtagaaggtaganaaaatattccattagancatcttctcctttagcaaaattatactgtttattatactaaat

SEQ ID NO: 654240 - DNA, 1093 bp, Homo sapiens
agcggtcctgtcttccccagcatggtcaatgggctgcctgaccactatcacacgggcctggccttcagcagctcttccgaggtgggggtatttttacgcttcctactccaatcagtgaaccgctttccacatcactcgtctttgccagagcttccacgccactttttgggaagggagcagggacccagaccaccaggccgttctcctctaagcatttagggagaaatgaagtctacataaaagtgctccccgccttaaaaaaaaaaaaaaacaaaacaaaaaacaaagggcggcccatacccgaaagtgtgtaagttctccggggcgagatatttcccagtgggactttttcccaaaaaaggggtcaacatttgtggacccttaaaactttaagaggctttccataaagaacttcccattattcccgcggtccgctttgggagccatggtgttatcatataaaaccgcgtggaattctcttaaggcctttgcccctaggcgtgggtcctaacagtattccttaagcattttcccttcgtggggctctcaccacattagccatttgggcccgtaaaataatttccactcccccataactggcgaagggggcgggcatactctctcgggctgcagaacaaccttttatagcctttcacacggcgttcatcccagaatgggctcttaagccaccttttttcaacccaactaggaccttttccaccattgctatctgttccaacaccaccggggggtccccccctgtgtggcccccagggcgtggggaagatgccccaggggagcccaacaagggagaaatccctggtggccatcacaggccccccctcgaggattggtgccggcgcccccaccggggcgtggccatccaacagacgcccgggggggcgacaactttctaacaagtttttggtcgtcacaacgacgggggctcgtcgccccaatattgggcgccaggggttggtcgccacaaaagctgcggggaacacaagacgaggcccctccgggtataaggcccccccccaacgggtgggcgaaaacgccgaggcccccacagagagggcccgataccccacgt

SEQ ID NO: 654241 - DNA, 343 bp, Homo sapiens
  misc_feature (30)..(30): n is a, c, g, or t
tgattttttaaaatgtattctgatacacanaatatataagaatgaaaaataaaaaatttggccgggcgcagtggctcatgcctgtaatcccagcactttgggagactgaggcaggtggatcacctgaggtcagcagtttgagaccagcctgaccatcatggtgaaacccccatctctactaaaaatacaaaaattaagctgtgtgtgatggtgcacacctgcaatcccaggtactcaggaggcttatgcgggagaatcgcttgaacctgggaggcggaggttgcagtgagccgagatcgggtcactgcactccagcctgggcgacagagtgagattccatctc

SEQ ID NO: 654242 - DNA, 686 bp, Homo sapiens
agaggcataaattcaaactctccagaggcctctaccctttggtcgcaagccgttaccggggtctttgccatcggccgggggtttgttgaagtgtcataagagtccctttaggaccctgtgatgcctcaggtttgagaatacaccatactgggggtctcagataccgaccttgggaacccccatgagtgtctcccatagtgctcccggcggcactttattcgtaaagaagctgcttcccaatcttgcagagttgtagccaggagttattgaacacccatagacagatggatttcctccgtcgcagtaaagattcagctttaggagcaaattcacccctgtgacctgggcttagcaatctgtggtgtctgggaggccacgtacgagagccctcgccttccaccggtcatggctcagggtcgtgcacagagcctgcctgtgtacaggttactccagcagccgtcagctccgttaagctctgcccacacagttgcgagtccagcatcatgacatgtgtcaagttcctgtcagtcatgtgccaccccccattcgatgtggtcagcctcaaatagcctgaaaattcagagtcagcatctcctcagcagctttccttccttcatggagtttttatttcagaacaagggttctgattcccccacagcgcttaaagtgataaatctataattaca

SEQ ID NO: 654243 - DNA, 113 bp, Homo sapiens
cgaacgcggccggaaacttgcgccatggcccgatgaagccaaggcctcaccaatgagcacaatccgacggtcaaggcctatgcggtcgtgcagttgcgtcaggataatgcgct

SEQ ID NO: 654244 - DNA, 533 bp, Homo sapiens
tagagatccagacacctctcttctggtataggaacaattgccttttccgtaaggatcatctcaatgtggcagagaggagctcatgtataggtaaatccgaccatgagctctgtaggtccggcggcgcatcttaggtgctatagttcaacttggatatagctcaatgaccagagaatctacatctaaacccttaagttcagcattactctcagcgttattaagcatgtgcagcaaaaattaagcactctttttgggccaccgaccttgtattcagccccattgcttggcctgcgcacacctgccaactccaccattgtaacgtcggaatggtacacactgtttctgtaaagtgacatctttcagataacttcgtggcttttcgtatattcatacccttgatggcctgagcagtttcacgagtgttcttaaagtgaacacgaagattggaacctcttgatttgcatgatttcgaggggttctccgggtcaagtgaatagcgaaccattttcacagatcacctcaggctgcttagg

SEQ ID NO: 654245 - DNA, 110 bp, Homo sapiens
gtagattgatttagacacactgaggaacggtactatttaatatcatctttaaaaatggaaatagccttaatgatatatactatgaagttattacctatttacagtaaata

SEQ ID NO: 654246 - DNA, 825 bp, Homo sapiens
  misc_feature (498)..(498): n is a, c, g, or t
gacttgttgtcgtgttcgcgtcacacaccaactgtgggtggactcgcctcttttcccgccgctttgtttccgtagctttttcggtggcggggcggggtttttccccgcgcctgccgcgtgtgtgtggtattcgtgacacctggcactcctcgggggtgttggctactcccccgtcgtggtcttcctcacgggtggtttgaggaatactaccagggtgggttgaccatctttcggtccgcgcggcatcccctctgtggtttggtgaagcaccccgtgtctctcgtcggtggttatatagtcggcccgccggtgtcccgggggggctagatggggccgccgccatggtgtcgcttgtgttgcccttctcgccccccgtggggggggagaccctttgcggcgcgtttgcctgcctgttgtgggtggtggttttccccgaaagacggcgttggttgcggtggtaacaacttcgttctcgtgacacagaagatttgtctgtgnggagatcaccacccatgtctcatgtttttcttgggggtaaacaacgtcaatggttcggtgattggagtgtggcgtaatatatatagcgcaaggtgtattatgttttatccgtcttaagtaaaccctccatccgtcgttgggccaccgtgggggtgaccccggcgtgggggccccacaacaattggggccgccccgcggagagggggaggtagatgatctcttagagagaccttcttgggtgtgtaagaacacgcctctcgggccaatgtgttcaaatccccccccaccaacaggccagcaatccctgaacccgacccacaaagacga

SEQ ID NO: 654247 - DNA, 778 bp, Homo sapiens
ggacgcgtgggagtcggtggatttacctgcttcaataggtgcttgtgacggtaatcccggcgctcgttccccaccccggacggtcgcccatagccagccctccgtcacctcttcagcgaccctctcgactggcccaagagccccgaccttgccacgtctccagcgccgaggcgaggcaccggcgcagacgacgcctctccttagtcgccgccatgagtgaccgtgtccactctctgacgatggtgcgccagaactacacactcgaggatctcagaggccgccatcaatcgaacagatcaacctggagctctacgctctcctacgtaaacctgtccatgtcttagtacttgagaccgcgatgatgtggttttgaggaactttgccaactactttcttcaccaatctcatgacggagcacggcgaacattgctgagaacccctgatgaagcatgcagcaaaccaacgatggttggcccgaatcttcctttcaggatatccaagacaacccagacctgtgatagacttgggcagagctgggctgaaattgccacatggagtgtagcgataaacatttgggacacacaaaatgtgaaatcaagtcacttactggaactgcaccacatcttggcctactgtacataaaaatgacctcccatattgtgtgacttcatttgagacacattacccttgaatgagcacggtgaaacgccatcaacagaagtagcggtgaccactgtgacccaaacttggcgcaacgataggcagcgccacgaaatcg

SEQ ID NO: 654248 - DNA, 608 bp, Homo sapiens
caaattcaatctatgtttcagaaagatgattaggtggaactttaacaaacaaaaaaacaattttatctagactaaaacaaatgcaagaattagaagaacatgctgaaaataacttcagtaattacaccaaaaaagaaggtgtattgatgtctaaaaagcttgctaagttacaaaaaaacctaaatggtattagaggattaaaattcataaataatgataaattaattatgttagtagcagatccaaataaagatattattgctattaaagaagctaaaaaagcaaaagtaaaagtaataggaattatggactctaacaccgatcctgctttattagattttggaattccagcaaatgatgattctgtaaaatcaattacattaatttttacagttttagcagatgctattgctacagctaaaggcggaaaagctttatttgcttaccaaccaacagaaaatatagttcttccagaagttcctgataaagaacacaaagcattaaataaatttagaaaagtaagtgcagaagttcaaaatcaagtacatcacaaaagttttgtggctaaagcaaaaccagaagtaacttctcaacaaaaagaagaaaat

SEQ ID NO: 654249 - DNA, 141 bp, Homo sapiens
cagggctcagcagagcgttagaggtgaccccacctgggcccccacccgggaacagtgtcgtgtgctgggtgaatcattagagcatgttcttggaacatggaataaaataagttgaaataaagcttatgacatcctttaata

SEQ ID NO: 654250 - DNA, 726 bp, Homo sapiens
  misc_feature (290)..(290): n is a, c, g, or t
  misc_feature (317)..(317): n is a, c, g, or t
  misc_feature (341)..(341): n is a, c, g, or t
atgttcaaactagagactgtgaaagataaaccccaataggagcccaccacctggacggggtacttcgtgaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggaggagcggcgaagtgtgccctngatgaagcaagcaccggtctgtgacgngcagtcatggaaacgaccaatagnagattcttggacttctgccctcttcacgactagcgcccctatagatcactacagaacaatacgtgcgtcatgctgcaaggaaaaagccctaccacaagacgactctggtgtgtctagtgaggtgggcgccctgtcctaggagagacagagagccaggcgcccctgcgctctggaatgaaggacaagcgaggcacccgccacatagatttcttcgagacatgactagaaccttagacactgttgaccctcttgaacccggaggaagcaagagtaacacttggtcttctacagaaggacatttgtgcatatgactagctaatgacacttctgaccctgagtcgtggggaggatgagatgtgcaagagagcttctattaaaagaaaca

SEQ ID NO: 654251 - DNA, 115 bp, Homo sapiens
cactgtaaagctggaaaggaacgaactggtgtaatgatatgacaataatatacctaagaggtaagaaactaagttatattggcagaaatgaatacaaaaaccactatagctgggc

SEQ ID NO: 654252 - DNA, 293 bp, Homo sapiens
  misc_feature (23)..(24): n is a, c, g, or t
  misc_feature (41)..(41): n is a, c, g, or t
  misc_feature (146)..(146): n is a, c, g, or t
  misc_feature (154)..(154): n is a, c, g, or t
  misc_feature (218)..(218): n is a, c, g, or t
  misc_feature (226)..(226): n is a, c, g, or t
  misc_feature (276)..(276): n is a, c, g, or t
ttgctgctggtagaatcagggtnntaaaaaaacccccgcgngcccaaagtgccagtctgcgattggaaatttccagccactttaagccagtgctgagtagggcttctgcagagccatgtttgagccaaggtcttggaaggcattgncccatggntcaaggtgactcggggtggagtgagcacgtctgcagggccctatcatacacgcctgaggcagangcagcgtncccccgtgaaaagccaaccttcccgaagctcctgcgtttttttgcaaaanttgggtttccccccagg

SEQ ID NO: 654253 - DNA, 1124 bp, Homo sapiens
  misc_feature (392)..(392): n is a, c, g, or t
ggtgtgcttgttccctcgttcctccctcttccctgtgcctctgtattctcgctgtccctgctctaatagtaccttctcatctggctctttaatattgactcagcgcctgctttcgtacacgtgctcgtctcacgcgtgctcagctctatacatgcaacgccacgcttgcataggcccttctaagaagctcttgctaatgtgcatacattgtcgtcataccattatggcacgtctatagtcactactcagagaactcttatacagtactctccgcaatatgcggcatggaactgcgtagttcctccaatagacctattaatcttgactataccgtcatgttctgaccagctcactacaccctagcatatttttttacctcatatctcctcacntgtgtacatcatactatattgtggagatccgctacacaccacaatgcgaccgcacatggtcgccgaattcccccgtgtgttgccctcttgttacaccagtctttcttcaatcactcttgccatatcgcaccgatactatatgcgcacccgaagcaaaatataacgcaaagaccttcctcgagactgggaggtctgcccagcaaatcttttggtttttgaacagagccgtaaaaaaacaacaaggtggctcaagggttttggcttcatgtggtcaatggttgagggacggcgtgttccccaagcgagacctcataggggcttatctaaccagatgaagaccccatctcctggggaagaaatccaaacagctcgcgaacgctaaagtccaaggacctggaagtggagcttaacgatgctcatcggagctccttcagtgccttgaactacccggccctgaaatcagggagacccttgcttggattaatccattcaaccagaactggcttggttggacacgggtccgttgggaaggatttgaccgcagaccgcagggtacacccccgaccagctaggggagaatgcaaggcttgtcttggggctttccctgggctggggggccagacaatcgaaaaggcaggagaaacttgtctccgtcttcccaggaattagtctccaggttgtggttggaaccgtccaaaaatcctggactaattgatgaagtgcgacgaaaag

SEQ ID NO: 654254 - DNA, 107 bp, Homo sapiens
ctttgtcatcaaagctccatgagagcctctacagcaacactggcaggatcagcaaaagaatggcctctagagctaactgagcctgacgtcagtacctgctggcagat

SEQ ID NO: 654255 - DNA, 115 bp, Homo sapiens
gccaacactactgtgctgctattgcagtgaggacacactgatgttctaaggcctgaggctccttccattcactgaccagagctttgggggctgccattgggcggctgccattggg

SEQ ID NO: 654256 - DNA, 711 bp, Homo sapiens
taaaacccccctccaaaaaagggaaacataaaaaaatatcaacccctcttttaaaaaaggccaatttacaggggggggtttacaaacccacaagtgttttttgggtttataaaggagaatattatttagtgtgcggcgggatacaaccatctattctagttgaggcagacattgttacacccccccataactgagacatgtagaacctccggggggcaacgcctttgttcttgttcaccacaaatatatgtattggcacgccgtgaaatatcgccgcgccggaattatggtgtagaaggagagaaccctcacgagatgaccctacgtcgacggtgttattagggggggtgtaaacatatagacaaaaccaccccctacaccaaaatattgtgtgtctatatcaaccagccgcgtgtgtctgtaatatatttactttgtggtgtgtcacgagagtgggtgtgttctctcttacttgacagcctctatagtgtgtgtgagcgcgtctcccgtgggtggagtaatgtgagatatcatctcctcctgtgtagtggggcgagaactagtaacactacacacggagtatgtgttgtgtgttcaacgagagagtgtgggcggatgctcttctctcgtggggagtggtattttcacgcggggggtgatgagtcgctcctcctgtgtgtgcgggggcgcgcccaagtgggctccacatta

SEQ ID NO: 654257 - DNA, 265 bp, Homo sapiens
aaaagagcaggcatccgataaacctccatctctgagaaggtgctggcctcagagaagacatctctatcagagaagatagcagtgtcagagaaaagaaacagctcagcagcaagcaagtctgttctagcaacaaaaccagtgtctctgcagcaagtcgctaggccccaagtggcatggcacttgggctccaggaaaggcaggcttggttgtcttgagcaaagcttccgatcatctttgcagcaaggccacttggcctccagagcaa

SEQ ID NO: 654258 - DNA, 563 bp, Homo sapiens
gtcgtgtgggctccgtgcttgcgtgcggagatgagctgggtccctcggcctgagctgcggcggctctgctccgctgggtgtgcgctggcgcggtgcggctgtgtggcctattggggtcctgggctgttgctggtgccggctggtgctctgtggctgctgtggctgtgcaggcgagctcaggacgagaagacagtttagagacctgcgctagggtgaaaggacatggcacaaagggttagtgataggtacatatcgcgtacaacatgtggtgagaaacaggcccagagacggcgaagaagcgcacaaagattggcggaggccttatacatgggacgaaacgcaggcgccctggttggtgataggcccaaaggcaatttaccccttttgaccaggttgagtccatttaggcacacatatgggggcacgaggataccgcctgccgaggcaacttttagaaaccggagtcctggctgccctcgtgaaacccagaagcagggatatagcccttaaggggcaaacactggaaaaccccccatgtaggcacaggcgcgtacctcctgcaa

SEQ ID NO: 654259 - DNA, 473 bp, Homo sapiens
  misc_feature (76)..(76): n is a, c, g, or t
  misc_feature (79)..(80): n is a, c, g, or t
  misc_feature (86)..(86): n is a, c, g, or t
  misc_feature (137)..(138): n is a, c, g, or t
  misc_feature (172)..(172): n is a, c, g, or t
  misc_feature (174)..(174): n is a, c, g, or t
  misc_feature (298)..(298): n is a, c, g, or t
  misc_feature (301)..(301): n is a, c, g, or t
gttgaatctagaaccgtagccagacatgggactggaggacgagcaaaagatgcttaccgaatccggagatcctganctnnaggaanaggaagaggaggaattagtggatcccctaacaacagtgagagagcaatgcnngcagttggagaaatgtgtaaaggcccgggagcgncnagatctctgtgatgagcgtgtatcctctcgatcacatacagaagaggattgcaccggagggagctcttggacttccttggcatgcgaggggaccatttgcggttggcccacaaacttctttaancanctttgagaataaatggtggtggaccttaatttcacccccagtcttccatcatctgggcatcagaatatttccttatggttttggatgtaccatttggtttcttatttgtgtaactgtaagttcacatgaacctcatgggtttggcttaggctggtagcttctatgtaattcg

SEQ ID NO: 654260 - DNA, 747 bp, Homo sapiens
ggtgctcgatcaagccttgccaggagggaggcgtcttccctcgggctcggggggccacctcggtaccgacgcgggtccggggtctcagcagcaagcgtcccgtgcgcggggctcttgtggttcttgggcgccgggatcccggcccccgcaaggcgcgctcggcccggctccggcctgcgggcggcaagttttctccagcgagtgggacgagaggttggaggaggttcggagctgaaggtcctgcaggatgcggagcgtgtgcttgttgggccagcccgcgtcgccggcggcggaggaggcggccgggggctccccggggcggccccgaacctgggcccagccgggcgcggccacctcggcggcgggctgcgcgcacgaacagccgggctcccccgagggccgcgcgccgcgtcgctccagcctgggcagcaggtccagggcgatgtgcagcgcgcaggccaccaggaacaccatcaggatgagcacgcggaaccggcgcaccagcatcatcttcatggccgcgcgggccggcccgggcctggagcgcgttctgcccgcgcgcccctctagctgcagctgggcacgagcgcggcgccgcctcgcgggtcaaggtccatcggtgccgggcggctaccagctccggggctgtccccgggcccgggccgcgtgcagggcgcccgccgccggagcgctgggtccccgcgccatctcgggcccgtccccgctcggcctctccggagcggccgc

SEQ ID NO: 654261 - DNA, 505 bp, Homo sapiens
tggtgtaaagtggcgcgctcagctaaagacagatggggccgcgccacagaccgacattaactgtgtcaggtgcctaatggccaaacacttttatcctacgtcataccatttacatcatctgatctaaaaagcctgttatttacagataacgctcataatgtaacacaggttaggcaacttgtccaaaagtcacatggccagctacgatatccagtactgttggacaccaaaggttcagtatctatccataaagaggtgatacagagtgtgtacagtcagtagtatggctgatgcttgagggggtggttaagaaaaacccagactaggaaatcacttggtgcacaccattgaaagcccttgaatgccagggaggcagaatactacttctctgcccctaagtacccttccatataatgggttccttgtgcaggcataaaatgagataacccgtgttgtcaactataatataccaagattaggttttaaggataatgaatagcctatg

SEQ ID NO: 654262 - DNA, 127 bp, Homo sapiens
cgatcgagagcatcctgggctcacacggtgacatcccgtctcatactaaaaataaaaaaaaattacgctagcatgtggatggcggtgacgcctgtaagtcccagactccatagagaggctagaggca

SEQ ID NO: 654263 - DNA, 368 bp, Homo sapiens
  misc_feature (123)..(123): n is a, c, g, or t
cccataggtggaagggacttgcccctgtctcggatgagactttgggacttgggactgtggactttttgagtaacacttaaaaataattaatgctgaaatgaattaagactttgggagacggtngagaagccatgactcattttaaaatgtgagacatgcctttcaccttctgccatgattgtgaggcctctccagccatgtggaactgtgaacacacagtgttcatcccctcaggaggacacagcttttgaggtaccatcttggaagcagagaccagccctcactagacacaaacttcctggcacgttgattttggacttcatagcctctagaactgtgagaaataaatttttattatttataaatta

SEQ ID NO: 654264 - DNA, 728 bp, Homo sapiens
  misc_feature (655)..(655): n is a, c, g, or t
  misc_feature (662)..(662): n is a, c, g, or t
tgcagtggctcatgcctgtaatcctagcactttgggaggctgaggcgggcggatcatgaggtcaagaaatcgagaccatcctggccaacatggtgaagccccgtatctactaaaaacacaaaaattagccaggcatggcggtggcagacgcctgtagtcccagctaatttttgtatttttagtagagacagggtttcatcatattgctcagactggtcttgaactccagacatcaggtgatccactcgccttggccccccaaagtgctgagattacaggtgtgagccaccacatccagcctatttatttatttttgaaacagggtcttgttctgtcacccaggctggagcacagtggctccatcacagctcatggttcactgcagcctcaaactcccaggctcaatcaatcttcccacctcagcctcccaactaactgggactacagggacatgccaccatgcccagcattttttcttgtaagcaaagatggggtcttgttgtgttgaccaggctggtctcaagctcctgggctcaagtgatcctcttgcctaggcctcccaaagtgctgggaatacaggtgtaagccaccacgcccagcctttagtctcattatttctcttctgatttctagaacttgcttcataggtcacttntctaggnaagactcttgattagacccagggcatccaaccttttggctttccttggccacaatggagctgcttg

SEQ ID NO: 654265 - DNA, 806 bp, Homo sapiens
gggagatcccggggtcgcgcgagagccgcaagcggagttggtgggctgctatgctatcacccgaggcagagcgatgtgctgcggtaccttgtagaagtggaggagctcgccgaggaggtgctggcggacaagcggcagattgtggacctggactctaaaaggaatcagaatcgagagggcctgagggccctgctgaaggatctcagctctctctgaagcatgtgatggttctgcttcgggtaacatgtttatcaagatgcctcaccctgagacaaaggaaatgattgacaaagatcaggatcatctggataaagacatagaagaactgctggaagtcgaacttaatagtgaatggtcaaccgccgtttgcgaggcccaaggcaaaccggagctgaagggttttaccgttgaaccccctcaaccaggatgagcttaatacgctctcgagggtcatcttgcaatacggcatgacgactcaagaaccaatgatggggtgaccagcgatctcccagtgtcatggaggacccagtgaccctccaagcttgacacctgtaaggacaggatctgccctgtaaggggccagtcgtcaggaatctggccatgaaaagcctctgtggtagtgcttgggttactctgtgatggcaggagcggaaccttcagccctgtctggggtgctggacctggtacctccagggctcggtggacaccagatctattgacggggccttgggtagccatccagtgggttgttgttggggccgtgggcttgcgggggtgtacggactgactgccacaggcaccttcca

SEQ ID NO: 654266 - DNA, 1252 bp, Homo sapiens
ggtttatctcccgcggcgttgttgagttgtgtacgttcctcttgtggtggttgatattgtggtggcgtgcgttgatagtatcgcctcgctgttggtgatattgaagctgtctgttgtgttgttggcgggttattcgtagttcattcttggtgttgtttcgggggtattttttttgtggggtcacgcccccactttgttttgtgtggttcttggatattgtgtgttgttgctgcgtcgcgcgttttttgtgttcgttgcttgtctggagataggatgtggggggtttttgtctcttgccctggggtctgatgttgttttgtgtattggttttgcgcgcctctatcgtctccgggggggcgacgtattatggtgactgttgttgcttcacttggggtttttgtggactccctcaggtgtgtagtattgtcttatgttgtttttgctctcctgattggtggggcttggtatggggcgcctcttttttgttttgttggcagtgtctgcttgttgctttagggggtttgttggtgttgttaccactggcctctcagtttttcttttcgtttgggcgtgtgctattgtttcccatatgttgggtttctcttacaatgagggggcgggttttgtggctcctctactatgtagagggggcgcttgcttttcgtccgggtttgtccctccctggttttggtgcgggaccccgcctttgggcgcctcacgagtactcgtcccacgacgtatcttgtttgttctctgtcttgataaattttttttgggggggaaaaataaaaaaatttttgtttccccacacaacatttttgtgtggggcttcttccgggagataacccgcgcgcccgttttattgtgggagtgcgccccgcgatgtagataccacccaccctgaaatatcttctctgtttttttttggggcgatttatattttttttattcaccccgcggatatatataataaagaatttttctgttgttgtgtgtgagaagacactctttcttgttttgtagaggcagagaaaattttttatatatatagaagagtagagagacacacccccctaacccgggggggagaaaagaaggagggcgccccccccccctcccgccaccttggagagaaccccccagaacaaaaaaaaatagagagacacacacacaaaagagagagagagagagggcggccccaccccacaccggggttgtacccccccccccgggggccctttttttttttcca

SEQ ID NO: 654267 - DNA, 117 bp, Homo sapiens
  misc_feature (78)..(79): n is a, c, g, or t
gggagggacccacgtgggagcctgggagcgggtggtcgtagctcggtagtccagttgtgggaaatcgtcttagatagnncctgttcgagagagctcggcggatacggctgtctttta

SEQ ID NO: 654268 - DNA, 158 bp, Homo sapiens
agtcaagaaagctgtggaaaggacctgcccacataaaaggataagccaagatggctgtaaagcacagagcatataagctgccacacttggagcacattgactttttcaaacagccagctctgtcagagaaaggaggtgcatgttatgacgcagctctt

SEQ ID NO: 654269 - DNA, 804 bp, Homo sapiens
tcagccttccgaaagcaccgaattttttggtttttaacaattagcaagtttagtcccccctgaaattcgttttcttttactgcatgattttggaatcttgttttcacattgatattttgacataccttataccctgttcctcccagtacccatcttttcccacgggcaacatactgtcacagccgtttatctaatgctcaagggacccgactatgcgtgaccctgtactagttcctttcttagtactgaaggggagacatgttgaaccactgccaccccccctggagtacttcgcgagtttgggcaatactcgagtatatttctcgaggcataaaggctggccttgagcctcacacccggtatagttgcagacacactgcgctatctttaacctggtcctttcctagcctgtaggccacgccatcaccacaacttgcttgtggataaacgagtgctcttcctcgatgacccaggatgagacacgatggctgctacatccacgactggaggacacgcaccccgcaggtatctgaccaaaccccagataactgattagtcttctttaaccatatacattacccttcgcccgcgcgttttcctgcctcctggaacgcctaacaatctagctttaccttcgtctatgttcacacttgtgtcctgtgcaatgtattctttgtggaagatgccatatagatccagagcattgtcaagcccctacttggtgtttaccttttcattgagtctttctcccgtgctgatgtacgttgcatatattaattgaattacttgtttttctccttgtta

SEQ ID NO: 654270 - DNA, 484 bp, Homo sapiens
agatacatcggtgacgagcgtcaaccagaactgcacgttcttgtgtgatagtggctcacgtgacgtgcgtgtagatctccttggatgtcggggggcttattcaggtcctcaaacttactcgggatgtcgctggctgcctcatcatatttgtaggcccctgatgtcctcaggaaagcacatggtcagggcactgtgtgtgatcttctcctcaaacaggtcctacttgtcgaggaagaggatgatggccgtgtctgtgaaccacttgctcgtcgccgatgctctcgactagcttcatgctctcatgcatgcggttcatctcctcgtactcagctagcaccaagtcataggcgctccaggctacgcataagatgatggctgtgacgccctcacagcagtggatccacttcttccgctcagaccgctgaccacccaaatcaaacatcttgaagtgtcggtcctttaaggtgacgtgtgtctccacgat

SEQ ID NO: 654271 - DNA, 124 bp, Homo sapiens
  misc_feature (1)..(1): n is a, c, g, or t
nagcatcatgtctttggaaccacttgagaatctagtttgcgttgatggagggtgttgagtcagcatcagcatctcttccaaattatgtctggtctgttgataatgacagtaaagcaggctctga

SEQ ID NO: 654272 - DNA, 556 bp, Homo sapiens
tcattcatctcactctgctttcaggtacccccatcagtcttacctttctcccttctttcataatcccataattctcagaggttttgttcattccttatcattcttttttcattattattttctacctctcttatttcagaaagatagtcttcaagctctgagattctttcctccacttggtctattctgctattgatacttgtgattgcattgtgaatttctcttgtgtttttcagctccattaggtcagttatgttcctctctaaattggctgttctggctatcagctcctgcattgtgttgttatgattcttagcttctttatattgggttagcacatgctcatttaactcagtaaagttagtgattacccaccttctgaagccttatttctgccaattcatgtatctcagcctcagcccagttgtgttgaaatcaattggaagaggagaagcacactggctttttgagttttcagtgtttttgcatttattccttctcatctttgtgggcttatctacctttgatctttgaggttgctgacctttgagtgggg

SEQ ID NO: 654273 - DNA, 422 bp, Homo sapiens
gaaagcacggtcatctacgcttagacagatgtcctctggaattcccagattcctcttttgatctgtagtgacatatggactagttggttatatgaggatcattataaaacgaacatccagtaatagaatctcatccagattatgcattagaggatctacgactagatgagccatttcctgaactgagagaacattttcagtcctataatttggatcatatggaacaaaaggaccacagtcatactccatggattgtgatcatagctaaactatttagcacagtggtatagtgaaacaaatggacgaatacctgaaacgtataatgaccaagaggacttcagagatttgattagacaaggaattctagaaaatgaaaatggggctccagaagatgaagagaatttgcaagaagcaggaactgg

SEQ ID NO: 654274 - DNA, 185 bp, Homo sapiens
gctcctacactgtaggagtccctgctatgtaccaagcactctgctagggactgggaggtggtggtacagaaaacctgtgtcccaagcccctcatcactgacttcctctatcactaactccaacaacatctttccacctcctataactattatcattcaccctacccactagtgaacacccacaga

SEQ ID NO: 654275 - DNA, 156 bp, Homo sapiens
cagagattggctggagcaagaagaacagctactaccctctgcctccaatctgcagcagtgaccccatggcagacaggaaaacagtagggtggaacgtgaggaaggtgatgcagacttcagcaccctgtggggagccctgtgtacagcccccaataa

SEQ ID NO: 654276 - DNA, 406 bp, Homo sapiens
  misc_feature (341)..(341): n is a, c, g, or t
  misc_feature (366)..(366): n is a, c, g, or t
  misc_feature (378)..(378): n is a, c, g, or t
  misc_feature (402)..(402): n is a, c, g, or t
cctacagaaatagacaaagaaaccaaaatttatatataaggttggtgcaaaagtaattgcgtttttggaccattaattttaaatcactgtaactagactcagacacatctttattaatcaaaataggaaccactgcaatcaacacatttttgccactgagaaataagtttgtttattcctgtagcctaaaaatctatgcttcagggattcgacaaactcttgggaaaatattttctggcatcctgctgggttgtggggaaggcaccttcccctggttaaaaagttgttcaggtgcttggaggtgggtacccggggttggccgagagggtcagggtggaacngggccgggttgaggacggaaactcntgttggtccaantttgttttccggcagctttccggnaggt

SEQ ID NO: 654277 - DNA, 1695 bp, Homo sapiens
gaccccatccgctggctctacacccctcggagacgctcgcccgacagcatagtacttgccgcaccagccaacgcccgcgcgccagccaccatgctatggtaacaagcgactggggctgtaccggactgaccctcgccctgtccctgactcgtgtgcctgggtgcgctggccgacggcgtacccctccaagccggacaacccgggcgaggacagcacacagtcggaggaccatggcccagatactactacggcagctgaagacacctacatcaaccctcatcaccaggcagagatatggaaaacgatcacagcccagcgaccactgaatttcacgacctcttgataacgacgaacgcccctgaaccatgttcccaagaacctcggctatgaccgcactccttgccaaatgtggatgcatgggcacatgaagactcgctctccatggaccttataccgtacttcttcagaccacatatagtcatcgtgtacaacagagaatccacaccatcctaacaatgcatggcagccaactgtgctgcactcctgcaatgttaaccttggtcagcactcggcacacccctgcgcggtgcacataacagcagcccggccatcccgaccgacaccacaaaaacccacacaccacaccacgctcgcgccagcaaccgacaccagactagctagtccaaaaccacaacgacagacagacaagacaccacacagacaaacacccacacgcaaacaaccgatcaccaagacacacacgcgaacagacgagcacccacacacacaagccccgccaacacgcgccacaccccgagtgtgcagatgacgacacaaggacaccgagaaagaacaccgggcaaagacaaacacaacaccgacaccacagctgcaacagaccccatatcccacggccgaacagaagagcaaagaatacagcgcccaacagaacgaccacaagagacaaaccaaaaagaaacaaccaccccacacagcacgagacacaagccagacgcacaacgaccgaacgacaccaacaccacaaccaacagacagcgccccacaccagccaacgcagacacagatcacgcagaaccagccggcacgccagagcggagcgccggccgcgacccgacgaggccagcgccccctgcggcgcaggctgagcacggccgcagcagcgacgagccccgacgcgcagacggagcagctgggtgggagcacggaggggaccaacaggagacgggagagcggcggaggcagacgcggcggagacgcggcaggagggacacgagacggagcgagcggcggcggcgggccgggggagcagcgcgaggacagcacgaggcggcagacggagaggagaggcgagaaggcgccgaaacggagtggctggcgtagagacgagcgggcaggcggggaggagagcgggagcagaggacgagggcgaaggagagcaaggggagagaagaggagcagacggagcaggaggacgacagacagcgcaggcggacacgcagcgggaagatggcgaacaggcggcacgagaagatcgtcggggcggcgccgcaggagcagggtggaatcagagaggagcacaggggcgtagacgcagagagcgagaagcgggaaggcggcggcagagagaaggtggcccacagcgagcgaaaacgcctgacacgaagagcgagacaa

SEQ ID NO: 654278 - DNA, 164 bp, Homo sapiens
gcgggttcctcccttcttccgagcctttcctttggccgccgcgggaagaaaggccgagatggcagatgagattccaagtctcaggtcgtctcggcctggtggcgacacgatctttgggaagatcatcccacaagaatataccacccaaaatcatttttgaggat

SEQ ID NO: 654279 - DNA, 1367 bp, Homo sapiens
  misc_feature (168)..(168): n is a, c, g, or t
  misc_feature (293)..(293): n is a, c, g, or t
  misc_feature (474)..(474): n is a, c, g, or t
  misc_feature (1367)..(1367): n is a, c, g, or t
cccaggcagaagccagcgctcgctgggtgccggtgagaggcacatcctttcaaagttgcatgtcagatggggccataactcggtccgtcaacccaaggtcgtgagtcaagaggtacatgcgtgctacacgagagtgggcacgagatacgcgcctcatctgtgcgccanctagtcaatgtgctgtgaacacacaggaaattcctccagtagagtcttcgatcatggacacaatgcatggtatctcgtgtgtcaatctgtcctcagtgtatgtcatgtgtgcaaggtatcccagntccaggaaggtcgcgtgggtcatgagtggaacgctggtgaccctccatggcggttgtaccctgtttcgcacgcatgcacatcgttgcgtgcatacatggcgctcccagtagtgcctttcatatgcgcatagcaaacgcgcggaagcatcgtacgcgtcccatttggtacgcatggacaccngcgcatatgtgctgccatcctcgatccatgcccgtgtccctatcaaccctaaacccactgccaatgcccgcatgctatcgctgtctcatgttgaccgcagttgaatttcgtgcaccctccccaagaaaagcctccctatacacccacacgggcacactcacttgaacttccctcactcgcaaacgccgcacaggtgccattccctgtccccctctcctgcacaggcccccggctcctctcgcgcacctgtccccttgttccccctcttacctctgacctcgtcccacgcctccctctacgcggcccgtggcgtccccttttacgccccctttcaacccttgccacgtacgcgcgcacggcagcgcaccttattctctcacttcccaccacccggaccacactgcacgacacgggtatctcccaatgcctcacctcctcggttcacaacaccccttctcccttcgtctgcccaaacgcaaaatgtttctagttccacagagcaacgcacggaacttccacacagttggcaccctgtgggtcccttcacgcggcgttggcggacaccctcggtctcctctccttcgccaccctccacttctctccttccacacccatcgcggctgcgcctcaccccttcttgtcacacggcttggcccttcactcacgccccctctactttcagcagcttcccaccggccttctgccgcgcagcacctctgcccacaacacttctctggctcacgccgcacacccccatcccccgtcttgcgtcaccccacaccctcattctgcgcgctcccccgccttggtcccaccccccacctccggctgccacctctctttccgcccctcacccaccctcgctgcgccccccacgccgcatgctcacacgn

SEQ ID NO: 654280 - DNA, 392 bp, Homo sapiens
cccaagtttttgggggtgaaaatataccctttgcccttcacgtctttgccaaggggagggccttttttcccccttgggcctttcccctttggggggcccccgggtgggcccaatttttggccctggggggttgggaaagtgggccccttgtccttaaagccgaatggctccggcccccgtttgggcctagttaatggcttttttttcccccccccctttttttttcccccttcccctttccccccccgggccccgggggggtttttcctgggggtccccaggcgggttgggttttttgaaaaaatttttttcccccttgggttttttccctggggttatggggggttttaaagggatttttttatggggttttttaaaaatttttccaaaga

SEQ ID NO: 654281 - DNA, 513 bp, Homo sapiens
  misc_feature (51)..(51): n is a, c, g, or t
  misc_feature (61)..(61): n is a, c, g, or t
  misc_feature (83)..(83): n is a, c, g, or t
  misc_feature (109)..(110): n is a, c, g, or t
  misc_feature (165)..(165): n is a, c, g, or t
  misc_feature (239)..(240): n is a, c, g, or t
  misc_feature (258)..(258): n is a, c, g, or t
  misc_feature (271)..(271): n is a, c, g, or t
  misc_feature (309)..(309): n is a, c, g, or t
  misc_feature (478)..(478): n is a, c, g, or t
  misc_feature (484)..(484): n is a, c, g, or t
  misc_feature (492)..(492): n is a, c, g, or t
  misc_feature (503)..(503): n is a, c, g, or t
ttgttgattatcaaacaaatctaggtacttcaatacacattgtttctttgnaaaataaagnctgaaggcataattcatttcanaaagtcacaggttagacaaccaattnnccttctggggctcattttagcaaatcctccaagtgttcccaaatcttttaaaaangctacatcccctgggggggggccctttccctgtagccctcttgctctgacaccagcagccctgcacccttcggnnaagtggctccctgcaggncggtgctgttgcngggcggggatggccctccatggcaacctccagcgggcnggggctcaccacctgctttctgcaaactcactcacttggctcagctattctgcaatggagaggaagtttccttagcagccaaagtattctaagtatcacattttccagtattttccagatccgtagtgtgctcagaaagccagagctgtatcaccaggcttttagggangattancacctgcncatctgggtgncctttaacag

SEQ ID NO: 654282 - DNA, 301 bp, Homo sapiens
ttaagcagatgcactgactcatgcctgtatctcagcactttgtggaggcacgggggggcatcccttgcggttccggagttcgaaaccagcctggccaacatagtgagctcctgtctgtataaagacctttaaaacttagccagctgtggggccaggcacagtgtctcacaactgtaatcccagcactttgagaggccgaggcgagagactggtgtgaacctgggcagcggcgtttgcagtgagctgagagaatagaccagttaatactcggcagtgggctactcttcgtgatatggccata

SEQ ID NO: 654283 - DNA, 98 bp, Homo sapiens
  misc_feature (44)..(44): n is a, c, g, or t
ttgtttttctcccttttgggtgtaatgttttagcaaatcccttntggcctgaaaacataatatgttaattgcccttaaataaattatatagaaattct

SEQ ID NO: 654284 - DNA, 238 bp, Homo sapiens
catcgctattactataatcctaactactaccgcctacctaatactcaacttaaactccaacaccacaaacctactacaatctcgcaccatgaaacaagctaacaatgactaacacccttaactccatccaccctcctcaccctaggagagccatgcccccgcatacaccggctttatgcaccaaatgggccattatcgaaaaattcacaaaaaaacaatagccacaacacaccagtca

SEQ ID NO: 654285 - DNA, 149 bp, Homo sapiens
gccctgtctctatagcgcatactacttccatcccgtgcttccccaaccttccatgaccctccctatcctcttacttacacctctctcggagtgagtgtgtagcacagctgtctcactctctgattctttgcagatcgacgtaattaaca

SEQ ID NO: 654286 - DNA, 710 bp, Homo sapiens
gtcccagctattcaggaggttgaggcaggagaatgcttgaacccagaaggtggaggtgtagtgagccgagatcatgccactgcactccagcctaggcgaaagagcacaactctgtctcaaaaaaaaaaaaaaaattatttccaaatatataatatcctactttataacgggacttactaaagactactttcgggactaacaggtcaatgggccttaaattctttctaaaaagatcattagaagctcccagggtagaacgactgggactggcgggaatataaacacaagttagctctatcaagggccttaccaacttaagggaatgggcccctatgattattattaacgcgtacctgggatcagcaaataattctataacccggtaaaattagcctggcttcacactggtcatttactagcaccatcacctaccacagattactatgtcagaaatgggcctgttcggcctctaatgaaattcaaccaggatcttagaaccttacttgaccatgcatgtatgctcgaatcccctgtataatccgccaccttttcttctttctcaaaactaccaggttggcgcatacagagattccctgggcgcaaaccacctattacactccggggaaacacgccgttttagaacccaccactccacggggactcaccccattttccagaggggaaacccggctcgggggacatttctggcg

SEQ ID NO: 654287 - DNA, 121 bp, Homo sapiens
taacaaaaagaaaactgacagagaatttaaaggacagacacaccctgtctccccaaattagaacaaaacatcactagctctattgggcagggactctcctattaaatggtcagaggtatac

SEQ ID NO: 654288 - DNA, 660 bp, Homo sapiens
acagagcctgacaggggcagatgcactggaaggaccctgtctgggtttagcaaccaagcagccatcctggccccacaggtgtgggaccagcaaccaagcagccatcctggccccacaggtgtgggacttctgggtcttctcctggctggcttcttgctagaggatttcaagagacccagcaagactgtattgtcccactgaatgctcaagatattggttagaagtagaaaaggggagggggcagtatttagcctctgtccccactaaaaattattcccaattgtcatttgtgtcatctgtttagcttacagttttaatccttgtcaaaatgatcatttgccagggtgcataaaacaccctatttgatgagaactggttttaaaggaaaatggggccatcagaaggaagccggttggtgtgaagagacgtctgggaagagcccctggcgagggccctcattccactgggtggcccagaaggagaaaaccgcgatggcgcttctcatttgaaatgttttctttatggacagtgtttagcaattgttataatgtgtacttttgttgattgatctgtatacatatgtaacaaataatttgttctctgagttaatttgttggaaccaaagactttagtgcttcctacattaaaacattttactgc

SEQ ID NO: 654289 - DNA, 641 bp, Homo sapiens
  misc_feature (302)..(302): n is a, c, g, or t
cgacgaatactcgggtggttgatatgattgctacgattacaagtgctatatgacttactgatgaataggcgattaaggattttaggtcggtttgacgtaagcagatagagctggttatgattatgcctcatatggaaagcatgaggaatggataggctatgtagtttgttagtgggtttagaatagtagtgattcgcattatgccatagcctccgagttttagcagtacggctgcaagtactattgaacctgcaatgggggcttctacatgggcttttggcagtcaaagatggagtccgtanagaggtatttttactatgaaggctatgatgcatgctaatcatataaaaatgtttgatcaagagttggataatgggtgggatcagtaatggataattaagaagtttagtgagcctgtggtgttttggatataaactagtgctactagcagtggtagggatcctgctagggtgtagaataggaaataaagtcctgcattgagtcgttctgtttggtttcctcagcgtgtgatgataattagtgtgggtactagtgttgcttcgaataggatatagaataagattacttcggtggcggtgaaggcttattattaggactagcttgtagtagaacttcgtatc

SEQ ID NO: 654290 - DNA, 793 bp, Homo sapiens
  misc_feature (78)..(78): n is a, c, g, or t
  misc_feature (764)..(764): n is a, c, g, or t
  misc_feature (769)..(772): n is a, c, g, or t
ggggactaggctgagagtgaaggcgtaggatacggtggttttaacgtagttagggtaaaggttagttttgtagatgtntgacgttggatattataattgggatggttagaatagttagtgtggttaatgtgagtgaggcgaatgggtttattacttttatttggagttgcaccaattttttggttcctaagaccaacggatagctgctatcctttaaaagttgaaaaagccacatttttaagtgtggaagcatgagttagcagttcttgcaaactttttcggtagataagaatatttaattttctattactagattcacaatctagggtttttattaaactatatctacagtaaaggggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggctgtgtactcgttcatagttagtgttggctaggcagaatagtatggaggatgncgacnnnncaggtctaattcgggtgtgat

SEQ ID NO: 654291 - DNA, 906 bp, Homo sapiens
  misc_feature (78)..(78): n is a, c, g, or t
  misc_feature (795)..(795): n is a, c, g, or t
ggggactaggctgagagtgaaggcgtaggatacggtggttttaacgtagttagggtaaaggttagttttgtagatgtntgacgttggatattataattgggatggttagaatagttagtgtggttaatgtgagtgaggcgaatgggtttattacttttatttggagttgcaccaattttttggttcctaagaccaacggatagctgctatcctttaaaagttgaaaaagccacatttttaagtgtggaagcatgagttagcagttcttgcaaactttttcggtagataagaatatttaattttctattactagattcacaatctagggtttttattaaactatatctacagtaaaggggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggctgtgtactcgttcatagttagtgttggctaggcagaatagtatggaggatgttagtccgtgggcaattatgagagctgtggcncctatgaagcttcagggggtttgaattatgattgctacgattacatagtgctatatgacttactgatgatgaggcgattaaggattttacgtcggtgttgacgttacaata

SEQ ID NO: 654292 - DNA, 751 bp, Homo sapiens
  misc_feature (78)..(78): n is a, c, g, or t
ggggactaggctgagagtgaaggcgtaggatacggtggttttaacgtagttagggtaaaggttagttttgtagatgtntgacgttggatattataattgggatggttagaatagttagtgtggttaatgtgagtgaggcgaatgggtttattacttttatttggagttgcaccaattttttggttcctaagaccaacggatagctgctatcctttaaaagttgaaaaagccacatttttaagtgtggaagcatgagttagcagttcttgcaaactttttcggtagataagaatatttaattttctattactagattcacaatctagggtttttattaaactatatctacagtaaaggggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggatctaatgcggaaagtgggatcctctagaatacgcgcagc

SEQ ID NO: 654293 - DNA, 728 bp, Homo sapiens
  misc_feature (78)..(78): n is a, c, g, or t
  misc_feature (686)..(686): n is a, c, g, or t
  misc_feature (692)..(692): n is a, c, g, or t
  misc_feature (700)..(700): n is a, c, g, or t
  misc_feature (704)..(705): n is a, c, g, or t
ggggactaggctgagagtgaaggcgtaggatacggtggttttaacgtagttagggtaaaggttagttttgtagatgtntgacgttggatattataattgggatggttagaatagttagtgtggttaatgtgagtgaggcgaatgggtttattacttttatttggagttgcaccaattttttggttcctaagaccaacggatagctgctatcctttaaaagttgaaaaagccacatttttaagtgtggaagcatgagttagcagttcttgcaaactttttcggtagataagaatatttaattttctattactagattcacaatctagggtttttattaaactatatctacagtaaaggggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgttcctgnccgggnaccgctcnttcnnggtgacaccggccgtctcatgta

SEQ ID NO: 654294 - DNA, 401 bp, Homo sapiens
  misc_feature (9)..(9): n is a, c, g, or t
tctcatgtngactgtgaacatgaaaaagccaaaaacccagatttgggagacgatgtggggagagagcgtgctgggagccacagtagcctggactcctcctggtagtaagggggatattcagggacctcccccgggtcctgggcagtcgccggtgcccgagggagccccatcgggctctgtgccttgcgggcagaacttggggtcatatatctgccggcccaggccgaagacctggccgctctggttggcgccctgcgtgtagcccatctgcagggacatggaggagttgtcacacttgtcggttcccagcttggtatcatagatgtgccgccgggtcccgggagccgtcatgcccacctggctggcgcacttgttcgtgcccatctggaggctgatggtcg

SEQ ID NO: 654295 - DNA, 355 bp, Homo sapiens
tcttagagtatccccccccgtccccgggctagctgaaacgggtgctggcaaccatgtgccccgggtagtgtttgtagacttggaacccgctgctcattgatgaagttcgcactggcacttaccgcccgctcttccaccctgagacaactcatcacaggctaagaacgatgctcgcctgttactatgccctgacgggctctacaccaattggcaaggcagatcatttgcacctccctgttggtaccgatagtccgcgggcctgtctgaccagtgcaccgcttcttcagggcttcttggttttccccagctttagtagggggaactagttctgcgttcacctctgctgctcatggaa

SEQ ID NO: 654296 - DNA, 1014 bp, Homo sapiens
  misc_feature (302)..(302): n is a, c, g, or t
  misc_feature (985)..(985): n is a, c, g, or t
  misc_feature (990)..(993): n is a, c, g, or t
cgacgaatactcgggtggttgatatgattgctacgattacaagtgctatatgacttactgatgaataggcgattaaggattttaggtcggtttgacgtaagcagatagagctggttatgattatgcctcatatggaaagcatgaggaatggataggctatgtagtttgttagtgggtttagaatagtagtgattcgcattatgccatagcctccgagttttagcagtacggctgcaagtactattgaacctgcaatgggggcttctacatgggcttttggcagtcaaagatggagtccgtanagaggtatttttactatgaaggctatgatgcatgctaatcatataaaaatgtttgatcaagagttggataatgggtgggatcagtaatggataattaagaagtttagtgagcctgtggtgttttggatataaactagtgctactagcagtggtagggatcctgctagggtgtagaataggaaataaagtcctgcattgagtcgttctgtttggtttcctcagcgtgtgatgataattagtgtgggtactagtgttgcttcgaataggatatagaagggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggctgtgtactcgttcatagttagtgttggctaggcagaatagtatggaggatgncgacnnnncaggtctaattcgggtgtgat

SEQ ID NO: 654297 - DNA, 259 bp, Homo sapiens
aaccttcgtctcgggggtgccacctggtagtttctgttctaaatctagtcccaagaattgccactgtgcaaaactgatgagctaagtcagcatgctaagtgcacttactccagagcagataaccaacaacagtctgatccagaagacttgtttgccatggattttgggctgcattaggctacggaaaggatggctcgtgaagcaatcatatatgatgagcccactaccaaaggtaagcacagctccacttcgtgggcag

SEQ ID NO: 654298 - DNA, 981 bp, Homo sapiens
  misc_feature (302)..(302): n is a, c, g, or t
  misc_feature (952)..(952): n is a, c, g, or t
  misc_feature (957)..(960): n is a, c, g, or t
cgacgaatactcgggtggttgatatgattgctacgattacaagtgctatatgacttactgatgaataggcgattaaggattttaggtcggtttgacgtaagcagatagagctggttatgattatgcctcatatggaaagcatgaggaatggataggctatgtagtttgttagtgggtttagaatagtagtgattcgcattatgccatagcctccgagttttagcagtacggctgcaagtactattgaacctgcaatgggggcttctacatgggcttttggcagtcaaagatggagtccgtanagaggtatttttactatgaaggctatgatgcatgctaatcatataaaaatgtttgatcaagagttggataatgggtgggatcagtaatggataattaagaagtttagtgagcctgtggtgttttggatataaactagtgctactagcagtggtagggatcctgctagggtgtagaataggaaataaagtcctgcattgagtcgttctgtttggtttcctcagcgtgtgatgataattagtgtgggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggctgtgtactcgttcatagttagtgttggctaggcagaatagtatggaggatgncgacnnnncaggtctaattcgggtgtgat

SEQ ID NO: 654299 - DNA, 302 bp, Homo sapiens
  misc_feature (60)..(60): n is a, c, g, or t
  misc_feature (73)..(73): n is a, c, g, or t
  misc_feature (77)..(77): n is a, c, g, or t
  misc_feature (79)..(79): n is a, c, g, or t
  misc_feature (102)..(102): n is a, c, g, or t
  misc_feature (127)..(127): n is a, c, g, or t
  misc_feature (131)..(131): n is a, c, g, or t
  misc_feature (134)..(136): n is a, c, g, or t
ttaatcgagctcggccctgattatacgtgtccacctattttcaacgctgtctgttaagtnacacaggtccttnttgnangcaggagtacgttagctcatttnccctcaagcgggttgtgacgtcgtngaanttnnnatgctcaaacttccaacacttgttatacacttgtaacccagctttggtaatgagacacgcatcaaaatcagatgaacaattgacggctgtttagcagtcagcaggtgggttaggacagttgtagcactgcaggctatgacctgaatggcagaagacagccaggacg

SEQ ID NO: 654300 - DNA, 541 bp, Homo sapiens
  misc_feature (512)..(512): n is a, c, g, or t
  misc_feature (517)..(520): n is a, c, g, or t
gaggggtggtcctccttttctggtttacaagaccagggtattttatatactacaaagactcttcactttaatagatgtggattgtagatagcgaataactcatccgtaatttacgacaatccacatccgccggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggctgtgtactcgttcatagttagtgttggctaggcagaatagtatggaggatgncgacnnnncaggtctaattcgggtgtgat

SEQ ID NO: 654301 - DNA, 663 bp, Homo sapiens
  misc_feature (78)..(78): n is a, c, g, or t
  misc_feature (621)..(621): n is a, c, g, or t
  misc_feature (627)..(627): n is a, c, g, or t
  misc_feature (635)..(635): n is a, c, g, or t
  misc_feature (639)..(640): n is a, c, g, or t
ggggactaggctgagagtgaaggcgtaggatacggtggttttaacgtagttagggtaaaggttagttttgtagatgtntgacgttggatattataattgggatggttagaatagttagtgtggttaatgtgagtgaggcgaatgggtttattacttttatttggagttgcaccaattttttggttcctaagaccaacggatagctgctatcctttaaaagttgaaaaagccacatttttaagtgtggaagcatgagttagcagttcttgcaaactttttcggtagataagaatatttaattttctattactagattcacaatctagggtttttattaaactatatctacagtaaaggggtcctaggattattttagggtttaaggtcagtagtagtagtggtagaatatgtagggctatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgcctgnccgggnaccgctcnttcnnggtgacaccggccgtctcatgta

SEQ ID NO: 654302 - DNA, 400 bp, Homo sapiens
  misc_feature (371)..(371): n is a, c, g, or t
  misc_feature (376)..(379): n is a, c, g, or t
agctcggtacccctttccgattagatgagggcgttttctcgtgtgaatgagggtttgatgttgttaatgtggtgggtgtattttcctcgttgtgtaataattagtatgtagagagagtagagagctgtaattattatgtttattcctatgagaataattgtgatgttggatcatgaaaatgatgctgtaatgataaataattctccgattagattgatggatgggggtagggctaggtttgtgaggcttgctattagtcatcatgttgctatgagtggtaggagtgtttgcagtcctcgggctaggattatggttcggctgtgtactcgttcatagttagtgttggctaggcagaatagtatggaggatgncgacnnnncaggtctaattcgggtgtgat

SEQ ID NO: 654303 - DNA, 301 bp, Homo sapiens
  misc_feature (1)..(1): n is a, c, g, or t
  misc_feature (217)..(217): n is a, c, g, or t
  misc_feature (262)..(262): n is a, c, g, or t
ntgatctagaggatcccaggggattggcagggtcacaggacaatagtggagggaaggtcagcagataaacaagtgaacaaaggtctctggttttcctaggcagagtgtgtgtgtccctgggtacttgagattagggagtggtgatgactcttaacgagcatgctgccttcaagcatctgtttaacaaagcacatcttgcaccggccctttaatccantttaacccctgagtggacacatgcacatggtttccagggagcacnagggtgggggataccaaagggggggtaccggagctcgaa

SEQ ID NO: 654304 - DNA, 474 bp, Homo sapiens
attaaaccgtttcagactgccagactgtcttggctgcaccattttacattcctatcagcagagtgtaaaggttccaatttcttctccacatccttaccaacactttcttatgatttttttttaagacagaatctcactctgttgccaggctggagtgcagtggtgcgatctcggctcactgcaacctccacctcccaggtccaagcaattcttctgtctcagcctcccgagtagctgggcgcgtgccaccacacccagctaattttggtattttcagtagagatggggtttcaccatgtgggccaggctggtctcgatctcttgacctcgtgatccacccacctcggcctcccaaagtgtggggattacaaccgtgagccaccacgcccagctgtccatcattcttttacactactgagatttagggtaatttgttatgtggcagtagatcattgacatacgcccaggtacgca

SEQ ID NO: 654305 - DNA, 289 bp, Homo sapiens
cacgaggatcatgttgaagatgagcgggtggcagcgacagagccagaataacagccggaacctgaggagagagaacctggtccacgtgcagtcatggcagctgagtccctgcctttcaccttggagacggtgtccagctgggagctggaagcctggtatgaggatctgcaggaggtcctgtcctcagatgaaattgggggcacctatatctcatccccaggaaacgaagaggaagaatcaaaaaccttcactactcttgaccctgcgtccctagcttggctgacagagg

SEQ ID NO: 654306 - DNA, 1077 bp, Homo sapiens
  misc_feature (540)..(540): n is a, c, g, or t
ccacggactgtccgcacaacgtgcgtgcagacgcacgcgatccgactcatatgtagcgccaaagctaatgtgcagtgacctgcctagtgctcttatgcgatcgggatacacttccgtaggctcatatacaacctactgtccatggccccaacgtagaatgcgccttacgagggtattatactagcctctttcggtctcgcacgactgagttagacatacctcatatcactagaaggagtgttcgtaaaaaatcacggcgccggacgagtcgtgaccgagtcagccccatcgtactttgcaccaggcaccccggagctctgtgaggctcctaccatgaatcgcaactcctacgaatagtgaacacccactcttagcggtacgcatagacgctggtacaccgtcgagttgagcggctccttaattgaatgccagccatctgtctagggcataaagacccggctcttgggtgctcatcctcactttgcctcgacatcgacgtggcggttcggttcggccaagtgcctatgccacccctttcantatgactcttaccttgtcccacccgcaccatcgggcgagacagccctgtctgatgccctagctgcgtccccttcaatcatacctcatgcatatctctgagaggccctcccccgcctttatgcccactccacaccttacttcacttctcaagcacgaccttgctaaccaccccttactcttacactgctgcccctcgcttcttacgcacgcgtgcgtggtcgcacccacgtaatcagttactgcaccgcgtcgcccgtaaccgcccactccctcagcaccttttcaccttccctttcgccgcgagttccctcgcacgcgccttttgggggcctctttccactcgcggccttcccaaatcgtggcccacagggccagctcgagccaagcagcccaatctccgcacaacgcccgccttttccggcgtgcttggcgcacgcactcgcggtggctccctccacgcgcacctcatctcctcttgctcctcccgccacccgcccccccagccctctctcggccgcgatcccgccccttcacgtc

SEQ ID NO: 654307 - DNA, 117 bp, Homo sapiens
atagctgaagatagggggaagatcttagaccagggggaggacttcccagcatcagagagtacagggatcgccaggctgatggagaaagaacaagaatgagtaaccatttcgagaagt

SEQ ID NO: 654308 - DNA, 450 bp, Homo sapiens
ccgggcaagcgtcggctctccactgcaagcggacatgaatctggaccgtaggcacgggtgccagccttggggcacaccgctccaccgggtaccgctgcagccactgtgttactgtaagccacactgaaacttctcttaagcagctgatatagctttaatatttctgcatgaacggccttggatagcttttgtgcccacatggacatggtccaggcttcccatgtgatttgtggtctggtcctgggatgaattgggattgcctcatgtttttttctttttctctttctttcaggcttcctcatggtttttctttgtttctgtttacatgtaagttccactcgtgaagtacaccaaatctctctcacacaaccaccctattgaatggttttcactttatttttctaatctacatttcaaaggatgtatgcataaagtgaaaataaattttga

SEQ ID NO: 654309 - DNA, 163 bp, Homo sapiens
  misc_feature (8)..(9): n is a, c, g, or t
  misc_feature (31)..(31): n is a, c, g, or t
gctagaanngaatgatgtctgaaaaggtgtngttgcagagtgctggccagcttccgaccgtctctccctgaagccgccccgggggaaaggtgcggaggacgcagacagcgggcccgagagccgcagcgtgggcgaggagaccagcgtgtgcgagaaatgctgc

SEQ ID NO: 654310 - DNA, 906 bp, Homo sapiens
agcgggctttcggcgtcggcctaagtgcgctgtcgagcgcgcgcggaccgacgcacaggcggcggagccggtatgggcccgcctgggcccatgtggcgccgtgaccgacgagcaccgagctctagagccaggatctgaagacttcaagatgggtgatcaggaccctgcgggacataagtcgcccctccagcaaatggtggcctcaggcaaccggggcctgtggttacctctgctcttacatgacaccctctggacggtggtgaagggttcagccatgcgagtctcagcggcccgtccatggccgagcgagtctgatgccattccgtccaggacgtgtggagcctctcctatacgcaagattgcccgtcctctctccaatccgacaggggaagtgccgtcctgtattgcacatggtgtcctggagcctctgtacctgtgcccaaatggtgcccgctgttgccactctggtttcaagaccctacccgcttcactggcaccatggatgccttcgtgaagatcgtgaggcacgaggggatccaggaccctctgggagcgagctccaccgtacaccctgtgtgatgactgtgccagtctaccgccatctacttcactgcctatgaccaactgaaggccttcctgtgtggtcgagccctgacctctgacctctacgcacccatggtggctggcgctgctggctcgcctgggcaccgtgactgtgatcagctccctggagcttatgcgggacaaaggctgcaggctcagcatgtgtcgtacccgggacttgggtgcctgtgtccgaactgcagtggctcaggagtggtggcgctcactgtggtgggctggggcccactgcctttagatgtgccttattcaagccctgtactggtgaactataagctggtgaaa

SEQ ID NO: 654311 - DNA, 176 bp, Homo sapiens
taatctcagcactttgggaagtggaggcgagaggattgcttgagcgtaggagtttgatatcagtctgagcagcatagtgagactttgtcactgccaagaaatgaaagaaattagctgggcgtggtggtgtgcttctgtagtcccagaagctggggtaggaggtttgcctgagccca

SEQ ID NO: 654312 - DNA, 907 bp, Homo sapiens
ctatagagacatagcgggtgtgcgaaagaagggtgttgggattagaacagtgtttcgcaaaacgcggaaccctataggccgtggcacagttgggcgccgttcctctcatgacccatggggcccacagatgaacttctagggtaactgcaaagccgctttcctgcgaacgcacaaaatcttgcgggggccccacgccctaagtcgttaacgaggggttctgcccatagtgaaccgtgattttccctacacgcccctggtaaatatgcgcgtttctttacgacggtcaaatattctaaaaaaggttggaaggtaacccacaaaggcgtgaagggaccaccgcccccgtccgggagaaattgacacttgggaaagaaggtgcccttaagggtccccggtgtactactgctgcgcgaaaacactgggggcacaagaaggggtaacctccccgcgggccagaaattagaggaccacaagtggtgggtctctggaacactctgcaatctggtggacgcccctggaagatggtgaaaaaactccggggaccaaactaaaaaaaagggcgcaagttctgtcacacagaagggttctttagagatttctaaaaagggcgaggactctactaagatgctcgggacccgccccacgatgaaatgttagaaaaaagaagtgttctgccgcaaggagtgtttgaatgcttgaggaaaagagcccgcaggggagcccaaataacgttgctttctttgtagaagagaatcccccaagagttgattcacttcttgtaaaggccacaatgtttgaattctcttaaaacggggccacccttgtggaaaaacttttacaaaacccccaagatgaaccccttggaatctttggggttccaaaaaaaaacccgggacccccaaaaaaa

SEQ ID NO: 654313 - DNA, 1254 bp, Homo sapiens
agcgggccgagcggttggccgccgacatccctgtctttccctctcctactgtgctgcggaacctgggccgtccgattctagtgtgaaacgcggcacccagccctgatgcttcgacgcgcccgggcctcccgtcgcatgttctgatatgactgctgcgagcgtcctgtccggtgcgtgctcacgtcatcaagacccgttgacgtcatcccgtagatgccgctggctgtgtgcaggtgcactcggtggcatggttgcctggttccgtgagcctttgattctgagcattgcgcaagaagatcgtttccacagccgaactgcgtcgaggagttgcgattttggctggagcagtacgggaccaacccatttgactcggcagacagtgcttagtcctatggagaacgtccatgataaacgtgcccacggcgacacccggaagttagacttgcgactagggaggcaggatagacatccggggaggcgccagtagtaaaataagtagccactttcgtagcacccccggctgcgtgttacccacaggttgcggtatccacgaaatagaaccgttatgacaccggcctatgaacatcacgtggcgttccgtagaaaagtatccataaagcttatatctaacacacaccggagcattctcccacaagggccaatagcggaaagcctaagtaacatcacggacgggaacaccatcccagcgcacaaagcaacatggtaacaccttaacaccgtcaaccaccgttgaacttgcgcatcacacgtgcagtcaacccctccgttgtcacttgtatccctaaacacgcataggttccacattactgactcaattcccccagcacaaaggcggtacaccgccatcagcatttcccgcaaatcaatgctgacaacacgttaggcatctacacttgcatacacagattgtgtggcaacacacaagtaaagcacaatccctcatctagactgatgcatgttcgacagagtacgctgacaattttataagcgccctgagctgggtaacgctcacatctgcatacccacgccagtgcctcgtgtgagtaccattcgagagacaacgcgagtgatacatcgtgaacaacacaacaggtcgaatcaacacaacggggcgcacttgtgctatatatgttaaagagacactatcttacaccacaagagggagtgccaactaatacctgcctcaacacccacactacacgcgcaaaccagattacaggacacaacaaccac

SEQ ID NO: 654314 - DNA, 168 bp, Homo sapiens
agacaaagtatatatataacagaaaatgagtaacaaaagggtatagtaaatactttcctgtaacaatacttgaaaggtgaatggataagtcaccaatgaaaagatataaagtgatgaaatggattttaaaaaaatcatcacccaactatatgctgccagctggctcag

SEQ ID NO: 654315 - DNA, 1079 bp, Homo sapiens
ggtgcctcactatcctacaacgagcagcctgtggcattgttgccttgggctgctcctcatggtccggtttcacgtgatcaccatcagcccctgaggatgcaaagggaagcgtagtcaaggtgaacatcgtatggcgaagcctggtagggtcttcctcatactcgtcgagggcgagtgatgcggcgcacggaattgatgaggcactgtctgcatgtgggtggtggtatgggcatgacttagtaacgtgccagtccatggccctggccaggacagactctgtgtgcccactggcgcttgctccaggggctggtggccagcctagggcgttgcccaggggtctcaggacgtgggcccgtgcgttcatggcattgcatcttgtccagaggccgtctccctaccttcgtctgtacgtagcctctcgaggctctgtgaggtcgtgctcttgcattcgccccattgggtttcccctctcgctgccccgtgggactcatactcgtctggtacgattactctgtggatgcacctaggggttctacatagttaccctttgctcggaacgcaatgagtgattagccttagtttggttgctgcaatgtcgatgcctccttggtagttcccattgggtgtttgaagtgcaaggcgaagacttcgtgtccgttgcaccttggccccattcccccagtgctgagtaggcattgctcggtctgggcggggagtaagggagaagcccggcaggtgccttgcaaatggcgatacccttgtcgccaggtgccgcgttagcgacccgccggggcctaagacagtgccacccgtgaagggggtcaccggaggtttggccatggcaaggagcgcgagttctggtgcctggggtggttgcccaaattggcaagaagaccacgcctattctggggtgcatccactggcatgtgcatgaaaaggcatgtggggccacattggttgttcaagggggcctagatcacggaatggattgctccccagcgaaaacatacacatccgatgggccgttccattcctacgttgtggacaacgacctataggtgggggaagagcgccaacag

SEQ ID NO: 654316 - DNA, 829 bp, Homo sapiens
gctggagctagccccatgtccactccaccttacgaccaggacaagctgagccggaaccattgaccgcaaataaagtataggcgatcggaattgatagtgcgggcgcaatctccagactactagataccgcatggggaaacagatgaccaagagttatgagacccaagcgatgacctaggagacaaggagataacccccgtaatagctgcggcatagaggaagtgacacgtagcaactaagctgtgcaagggagagcgcaaaaagctaaaggaatccccgcgaaaagcagaacgagctacgcgtacaagaacagactaaaaaaagtagcggcaccccgtcataatgtagcaaaaaaataggtgggaacgattccataggtacgaggcgacaaacctaacgagcctggttgatagcgtggttgtccacagatagacactcttagttcaacctttacaattggtgcccacagaaccctctagatcccctttgtaaatttaacctgttagtccaaacgaggaacagctctttggacactaggaacaacaccttgtagagacgagtcaaaaatctaacacgccatagtcaggcgtaaaccagccaggccacgccaattacgacaaggcgtccaaggctcagacacccacaaccttaacaagaatccccaagcgccacaatccagccaccaccaaaagacaaccggtgccgcgccgaccgccccgcggaagacctgcaacacacagagtagggagacggccacaaatgacgacccgcggcaaggtggtgccaagaccggcgacgcaggccggggagacaacacaaaagccgggga

SEQ ID NO: 654317 - DNA, 144 bp, Homo sapiens
gctcgacctcataaataaacccctaagatgacaacacttttggagttggcactacaagatgcatgagaaatacagttgatcctagaacaacacaggtttgaactgcatggggtccacatatatgtggattttcctccacctttg

SEQ ID NO: 654318 - DNA, 763 bp, Homo sapiens
ccatacccaccccctggtcaaacctcaaacctagtcctccctattattctaccaccctttagcctagccggtttagtcaatcctctgatcagggtgagcatcaaactcaaatacgccttgattcggcgcactgcgagcagtagcccagaacaaatctcatatgaagtcaccctagccatcattcttactatcgacatttactaataagtgggctcctttaacctctccgcccttatcacaacacaagacacctctgattactcccccctcaagagctctaggaccatacatgatggatcttattatccacacctgtgccagatgagccctagcgcgaaccccacttcgcagcctgtccgaacggggcagtccgagacctacgtggtccagcggattccaacactcgcagagtactgctcaggcagtgccccttcggccctggttttcaaaagccgcaactaggaccaacacgattatgtatcaattagaccaccctctacatgtacaatattgctcgggacaaaactatgacgccattttgccatgagctccgcaaaacacagggatgtcactcagagaccactgacttcctatacctgccctatttatctagaatttaaacagcatacccaggattccgcacgcacaacttaaaccccttctatgaaaacatccaacactcaacatagcagttaattatatgataggtacccaataccattacgatttccagaattccccctctaacctgataatataatca

SEQ ID NO: 654319 - DNA, 133 bp, Homo sapiens
acgtacgtgctgcctcactttcgaccctcgactctcctccacgtgacgcgtcccttgtgtctccggacactgacccttaacctgacggacccacaccgcgactcaccgacgtgtttacccactgggggactcc

SEQ ID NO: 654320 - DNA, 143 bp, Homo sapiens
ggcgacattcaagcaagcagatggttaattgctgcaacatcaacaaagagagcatgtggatgtagaaggtgtgtgagaaaagtgaatcagaaaatgggaagctgtacacagcaagacgttgagttacatgttcagacagattt

SEQ ID NO: 654321 - DNA, 969 bp, Homo sapiens
  misc_feature (604)..(604): n is a, c, g, or t
ctacaatctctgttagagcatgtgctctcgccttgttcttcttcaagtcacttggcgagtcgtggctctttgtagttttatcacttttttttagaatcagcttctcagtttctacaaaaagccccattgggattttgcttataattgatctaatggatcaatttggaaagaatagggggcagtatttttaatattgagtcttttacccagtgaatttggtatctttatgtaggtattcctgaagatctcttagtaaagttttatcattcttaccataaggtaaaatggtagaaatgataaaactttgctaagatatattgttgacagaaacatatttgatttttttacactgattttatatccatcaactttgctaatgatttacaggttatgttgtgcattttctctttctttctctctcttttctttctttttttttttttttttattgagacagggtctggctctgtggctcagactagagtgcagtggcacaatcttggctcactgcaacctctgcctcccaggctcaagcgattctcaaacctcagcctcccgagctagctgggactacaggcctgcgccaccacgcccagctaatttnggtattttggtcagacatgttgttcccccatgttgtccaggcttatctcaaaattcctgagcttaagctatctgcccgcctcggcctcccaaagtgctgggattataggagtaagccatcatgctgggccttattggcgatttctttttgcctttgtcttgttttggagatgggaccctcgctttttccggccaagcttggattcgagcggggaaacctcaggtcactggaacgccccgcccccgggttcaccaagttccctggtccccccctccagtagtggtataagggccgcgcaagaggccacatattggcttcctaagaacgggttccatttcgcggggtgcttactcgtccacggtccc

SEQ ID NO: 654322 - DNA, 278 bp, Homo sapiens
atgtatggacgactgagtctcaagagaccgatgagaatcaaccctcttatttcatgtggcgctattcacatatattctcatgtgttatgggaaaccatttaagcaagggatagacatgattggcgtgcagcagttgaaacagaaacagtcctccaaaaagtgtcagtactatggcaaaccggcaaccttatgccatcgctagccacgtctcgggaactacaactcttcacatatggcacacatgatcctttctacaaaacagaaacgaatcgtggacc

SEQ ID NO: 654323 - DNA, 1596 bp, Homo sapiens
  misc_feature (288)..(288): n is a, c, g, or t
  misc_feature (1439)..(1439): n is a, c, g, or t
gcggagacacgcggcggtgttctgtgttgcgccatggccgactacctgattaggtggtggcgcacgttctaccgtgccagacgacgtgactcacatgcatcagcacgtcctcttcgaactcgcgcgaggatcggcactctacgctacaattgactattcatcattctccctgaggatacgatcagacttctagcttgccaggacctcacggctgtgcaccccatgtaggctatcatgacctcgtgtaccccaatgcaacagagtcaccatcgttaatgaccgcgccantgtggcattgtccttacctgcgccacttggcaacacacagtgtccaccatgcacgaggcatcgggcacttggacccaataggaccaacttgcgtgcgcttatccagggcccgcctattttggcctatccatttcccagcccacaaccttggtatccatccgttgaaaagttaccccatggacccaaatttgccaactgtctccctgcgactagcacgtccgaaaacgcacacactcattccgacagcgcaccgtgcgctattttcgaatgcaaaactcaatgcaaccaacgttccgctcgagttccccctttcctatgccgccacaaataagcgaaattccctgcctgtttcggctggggggacatccgtcttctatctgtggaacgttgggccccaaccatggggcacccccctgttgccacactttcgaggtgttgtctccatttggcccgttgggtcaattcccttccaacatttttccaacccacgggaacccaaacgaatggagggcaccccgcgagaaattccggaggcgcacgaagaggcccccggcccttttctgtcggttccggtgctggcccacgctttcaaatcgttcagttatccccctttccccaaaggggtgggcggcaaaacccacaagctttctccgtacagccattctatgtcgcttctcattcccaagtatcacactgaccaagggacggacccgctcgggaacaacccctacgtgtagaacacccgtttggggtgtcttcgtgacccttctctggtcgagcacagcgggacagtggaacgtttcaagacgctttcggagaccatcaaactactgcacacctgtgctcagaaacaacgtgtcaaacccccttctcgggcgagcattgtgcagcgattaaatacggccacccccccccctgtgtgtctcgcagctgctccccagtttttccacagcgcaacgtgctctgccatacaacgcctcggatcacgatcgctcgcccgcgacccgtttggtcacccaccgtggtttacccttagtgccagaccgcgcccggcgccgggttgtcccccccgcgcgtccaccagtccggtgtggccaacacacaagctgctggtgtgtggaccccccctcagccgtttgcgtgcgcttccnctctctcttgttgagtcgttcgggccccttttcacgtccgtcataacggcccatctctcggcgcattgcggcgtgtgccaccatcctccacccgttcttgcgcgtgtctccccggcggtctagtagtcgagcggtattgccactctgtcccctgctg

SEQ ID NO: 654324 - DNA, 670 bp, Homo sapiens
gacccgcgcgtggcgggccgccggggcagtcgctgcagccgccgcgggaggcgtccgtgacaaagatgaagctcatctatcctggagcactattctcaggcgagcgagtggggcggttaaattacatcagggaaccgcatcaatccaggtttaaaccccagggcccaggagaaaggtactttccaacccttgggggccttcccaaatggggagaggagattaaccccaatttggggcctgggcttaccaaagggaagcgcctgcactgggaatttaccttacttagacgaactgggggggaacctcgtgggtcctttataaacatctttattggtagaaaggaaccttttcagagccatttggaattgaaggataccggtggaggcccttccatccggagaacacagcccgggggacgaggttaaaccacaagtctcccctttttcccagtggtttgggcacaaccaaagtttttccttctccataggcccaacatgttgtggcaagatattttccataagcccaagaggaaagagagagcatacccacagacaatttccctgggcgcaatgtgggggacacatggtgccgaggttcacggacctctgttaaataggggggccagggaaatctgggtggagtgtggccccttttgggaacagaaagcaat

SEQ ID NO: 654325 - DNA, 703 bp, Homo sapiens
agtaatgcctttcttcccaagcaaatcaaacctctccctatgtaaaagttgatagtgtaccaagagacacaataccactggtgggctggaactagctcgttctgatgcataaaagttgataattaaagtaccagaaattttgtaagctcagttgttcaaacattacccattcattcaacatcatgcacacattcataaaaccaccagtggcacatcacatttaaaaacccaatgtaataatccaaaacatacctacttccccaattattttactaccttatactcatttcattcagtcactcttgcagtctcatttaggtctcattacatctttcacagtgcaaacacaggatacaatattgtgctcactgtgggtctcttcctgactgcagattcagtaacatggtgttcgtagcttgaaacctgtccacagtgggagtatttacaccatagaaactggctggcaaatgctacaaactagccaattttaattcctggaaaaggcgaattgttgagacatttaccagcaccacaatgaatgccatattctttttttcttgtattaggaacatacaattatcggaaggcagataaaaattatttcaccaaagtcatccaaatgccaatcccttatctcacaggactggcctatacattggccgatataacaagtgcaggtattaacccttctttcaagactcct

SEQ ID NO: 654326 - DNA, 445 bp, Homo sapiens
ggtcgaccttgagatcaggaatttgagaccagcctagtcaacatggcgaaacctcatctctagtaaaaattaaaaaaattagctgggcgtggtggcaagtgcctgtaatcccagctacttgggaacctgggaactgtggaggttgcagtggcccgagatggcgccactgcagctattactccagtttgaaaatactagaagttgccaatatatattttttccattgccagacttgtctgcaatttgtactggatctgatagagaaaccatttccatgggtctatatgaaaatgtggagccgggggtagtggctcacgcctgtaatcccacaacttgggaggccgaggcaggcagatcacctgaggtcaggagttcgagaccagcctggccaatggggtgaaatcctgtctgctacaaaaatacacaatttagccgggtgtggtgg

SEQ ID NO: 654327 - DNA, 614 bp, Homo sapiens
ctaacgggacgacgacttacgactactgaggacgacgtgggaacgcaagaaggtcatgaagtctgggtcatttcagggcctaatagaaatgattttctcgcattagtttcaagaacattagcaattacttcacgggcataagcacagttcacaggaatttctggcaaggaataaaactataaaaattagtcaaatggtcaaacatcatcagaactgtgtaaaagcatataaagtttcatcatatctttctttggaaaaacaaaccaaacacttcatgtactagccagtagctacatagtgatcagttgatgaatacacctcatggtccacgcatataaaaattttacaccatgtctagtccataggcattagtgtaggagtcagaataccaacctgaattctgtacgcagcttcgtgccttgtcgataaagcagtggacatctctccacagggagatatgtttcctcccgtgatatagaggatgttgattcactggtctcctctctattccgaaaagctgctctgaagattagtgagaacaattagctgtaaacgctctttgcacggtatacaacataaatcatacacagacatactggcatgagaaacgctat

SEQ ID NO: 654328 - DNA, 1301 bp, Homo sapiens
actctttgcgatggaccccgtgtgtgctggccctggggtgagtgctggccgatggctggctggcggcgtgctgtgcctggggtgcgacatggctggagtgatgcatgtgacctaatctggatgtgttgtgatgctttgatgcccctgttgtgtgctctgtgatgtgatgcccctgcttgccgttgttcccctgtgtggatgctgctgcccgtctgctttagtgtgccctgactgtgctgtgcgtgctggctgtgactcgtgtgccatagctgatgccatgccctgtgtggccatgtgctgatcgcttggtgcagagtggttcaatcgaaggtgaagcatgcatgtgacttggctgaaggctgtgactgagtagacagaggtttcccctgttgttgcattcctgtcgatgtgccgtgtacaggccacatgtggttgcttcatgctgtgactaaactgatcttgtggactgcttgtggttgcgccaattgcccactgttggctagctgttcaaacctgtgtccagctcagagcaagaatggcaagggacctgcgactggtacaaatgctgtgaccacgattgagactgcgctttcgagttgagttgttgcgtgctcatgtgcaatgctgcgtgcaaggggagagggcgtcagcttgtggaccctatgttacccccatgcgaaccattgcaagcaaagcgtgctatgaggcatccatggcgaagtgacctcgccttgtgtgcacaaaagacatctatgggaatggtggcttttgcttttgagagccgcagacagaggttgagacaacatggcgtggcagccccttttacaagtactggaaggtggaatggtgctttgagtgacgtgagggctttccctggtaaatttgccaattgacaatcaaaactagaacacagtgaactcaagacccctggtggaaacttatccagaatggttatcccaatgcgccccccaattgtgcctggtgtctggtgaacatcagaacaccctgcgggagggaactaaccggtgcctctgcacacacgatggtgtgacctggatctgcgagctgtgagaggtatacgaccacacgctgggaggttggggcggtgaaatgtgagcacaggaaaggccacacacgtcggttggcgggaacccctgcacacttgactcaattttcacaagtgggcaaccagtgattatacaaaaagtgaaaggctgcccacaagagttattggagacgcaccaacctcgggagcaacccccaatgtgatggcaaggggaggcgttcccacaccaaatttg

SEQ ID NO: 654329 - DNA, 1091 bp, Homo sapiens
ggcggctccaggtaagatggcggcagccgtggtgctggctgctgggttgcgcgcggtgcgcagagccgtggcggacacggtggtgcgcggggggcacggtccgaggagctgcaggtgtgactgatgggaatgaagtggccaaggccctagccaggcaaacttccttggtggtgagcagtcctccaaaactatctttctctccagtgatccttggacaatgagccatcgccatgatgaacattctctatgaggaccagcagttgtcttgtgttgccgtgatgtggctcgcttcagtgctccttggtgcaatctttccttgggtctagtatccttaatgaagagcctcatttaccgtctgcgcatttagactcgcgagctgataggaacgaacgtacgcaagtcatgcattcataggggacacccatacatcccattggttgagccagtgcagacatgccacaaggggcttgagggcgccctggggacggatcggattaccgaacctttcgtagatccacaacgattgcggaacgcgtgggggttgcaacagatctgttgtaatcattcttggcagcagttaatggtaccttggaggtgtgcccggcaggctctcgggctggggctcccaagagttgaatcctgacctgctgggttaaagggaccagcagaactctgggattgcgttgggaatggacataggtggaaaaagaattgggaatgcgtggtgagtggctaaattcaggagcttggtggctctcgtttaaagatgaaaataaaatgaaacggagtagagagaaataaaaagagtattggaggaactatagtgctattcttgaagaaagagaagaaattgtgtggagcagaaattggaattcacgtcctgttagctcatggagggaaacgaatgggtgacgtagatagtaaaggggagtcgacacacgtattgtgacacaaacatttattaggcttctagatatggaaggagaagaataaattatgtgacatatagtggattaaaggggcaaagcggtagtatgcatgggttagctgagggagaacacatagagtttgagtgtgaattgtgaggggaa

SEQ ID NO: 654330 - DNA, 884 bp, Homo sapiens
ggatgaggagccagctaggggagcctttaaggggagcctgagtctcctttaatctgtcggtgtccccagcacctaacagggtggagcatgcagtgaatgttgaatgaatgggtgcaagggtagtcaatgtcccttaactttcacatccatcatctcatggcagcttccacagggcactccaaagtgttaattatggctgcttaaccctggctaatgtttcggaactcatcagatcctgagactcagtggacagtgtttgtttcaaatagattccctaattcctcccctggaggttatgattccgtggggtctatgcacagactgggaagctatataacaaacactcttctaaaactgagaagaggctgggcacggtggctatagtgccagcctatagtcccagcagtttgggaggctgaggtgggaggacggtttgaggccaggagttcaagaccagcctggccaacatggtgaaatcccgtctttactaaaaatacaaaattacctgggcatggtgcacgcctgtggtctcagctactcgggaggctgaagcgggagaatcgcttgaacccaggaggcggaggttgcagtgagccgatatcacgccattgtactccagcctgggtgacagagcgagactctgtctcaaaactcacattacaaactattactgtgtgcgtaatgactacttgcgcaccatctttcggcacagtacgtcgactgactgggctacaacgcttcggcaaaccccgggcgttccggacaaagcagccccagacaacaactttttcccacaaccgtgtttgacccggaacatcctcctgcgtatacccgaagagcgcccaccgcgacaacgccttgagctcacgcctatacccgtcttg

SEQ ID NO: 654331 - DNA, 249 bp, Homo sapiens
  misc_feature (182)..(182): n is a, c, g, or t
  misc_feature (208)..(208): n is a, c, g, or t
  misc_feature (229)..(229): n is a, c, g, or t
  misc_feature (248)..(248): n is a, c, g, or t
gctggtaccagatcccctttcatcaaacccaaggctcaggagtcccgtcgtccccaccgaacggcatcagccccatcatggcccagcatgtgttatggatctgggactgggcactctgcacattacgccgctcctcgcaggtactcaatagtcctcccgcccagctctcctgtctgccatcntgccgtggacagcaggagagtcacanggcccggtgagacctctgcanggatggaaacgggggatcnt

SEQ ID NO: 654332 - DNA, 1250 bp, Homo sapiens
  misc_feature (135)..(135): n is a, c, g, or t
gcaaaccctgagaatcgaaaatgaacgaagattctgttcgcttcattgcattagccttccgagcatagtacctagagcctacccgtcgcagatactgatcattctatttccccctctatagatccccatgctccnataatatctcatcaacaaccgtacttaatcaccaacgcacactaatgtactgaagtctacaatcttaacgcgtctaaaacacaatggatcaccgcattcacaacactaaaggtacgaaacctgaatctcattatactaatatcctatctaggtcactttcttacttgtccacaaagctaagcctcctcgagaccctcgctggcgctactacatcagttataacatcccaagctcatcctctagacttagtcatattaatagcctttagacccatgggcctcattcacccctattatcgacgcgagtggcgtcaggatgactttaatcaaggcttctcccgtctgctattagacttatagacatagttgctcctatgctcccctagcatttacttaaccaacaaaggacgaacacgctaacaacctcgcattattcgcccaattaactaaggtttatttactccgaatatccaatcagaacttacttccatttcagagccgagaattagacgcccattggtcccaggtaacgcccttaaagccaagctacacattttatccttggcacatgggcacaggccctagacatcatgttgacaaccctaaaattgtcgagaaacggcggcacatccccaataaagtcaaacatacttcagaagcccaatgaaaacccttatcccccttcgtaccaactttttattccattccttttccagccaaagatttccttagaatcttcgttaactgttgaacgtaatttccctttaggtacagactctgccgtggttcgggccctttagatttcgcgaaaaggcccgtgaacgggttttttgatccaacacgcgtttttccgttaaagttaaaaagggctcgttccgttaagccccttggacctgcagggagccacaggcaaacattttagggaagacacagcagcgaccattctgtatacatgaagaaatctctgcgaaggggagcaacaccattatatggtgacacgcgggaggataggcgaggaaataaaacagacgacgagggataatacacgtccgaagaacagtgtggggcacacaatgtgctgggcccaataacaaggacgaggttgtccacccctaa

SEQ ID NO: 654333 - DNA, 226 bp, Homo sapiens
tggttcccttttcctgtggattttaaactggaatccttcctggtggttggttccctgggtggaaaccattccgtaaagcctcctgcctccggatggatttcctttcctggttcctgtggccttcccagggtttttcctgggtccttcccagtgttttttggtccttccccccttccctgcgaaaaaaccccccctggattaagccattaaatttggtttgttagga

SEQ ID NO: 654334 - DNA, 1301 bp, Homo sapiens
agctcctccgaggatggggtcaccagtctctgctcttcccagtctctccggcgcgctccaaggggcttcccgtcgggaccatgcgcggcctgtgagctcccgcttggtcctgctggcgctaggtcctctagcctggtggccctcggggcgcgacgtcgtgtccctgcgtgcctgccgggtcggagaggactcgtgcttgatccatagattgtaccctcgtcgctgcggaaccacctggtgcctggtgggcgtcacattcattgcgtggaacatagacgaggcacacgggagatgtccttctttcgtcgtattctcgcacgagcacgtggagacctagcaacgctatgccacgcctggagcagcacgtacgacatcagcgatgtgcccaaggaagcctgctagagagcaatctatgcgtgagtgtcatccatcaggacagcccaaaacggaggaaccgagcagaacgcgatcagcccaaccctccatacccgaaaggctcgcttggcggcagagtcgatgccaggccttctccggtagcgagcatttccatggagcgcattcaggcgaagctagacgtttccaacaggatgtctagagtatctgacacacgggcctgcagggttattggctaggcaactttcatccattgacgttcaccaacgacatatctgtcaggcgccttgaaagaggagaggggaaacgcatccgcagcccatgaagaacgcaaaggcacactgtcagtcaatgtgtcgttggcgtcctccttcttccacagacaggaaggaaccgacacatgccaatagaacgtcccccggtaaaggatgaatctggccggtttacactgtcgacacgcgagttccggggcatccgtaccagcgcatttccattcctatagccaacacaggaattggttaccgtgtaggctgagcagagacacagtagtttactcgcaccaggcaactttccgtcgggtagcgtccatctgatgccacttcccctagtagcaactgaacaccgtgtccggggggagtggcttccacaagcccaagtccacttcttgaccttgggcttctcaacgagcctacggtctcaaggccgttgttgcaacccaaattagctccgaaaaccgacgaaggtatctttgccccagaagatataacatgggcctgtagctagacattactcactagggggcttaaccctgcgtcggcgttaaaggcatgtaccagaggcgcccagggaaagcatggctttaccctatctagccacccacgcagacagaggtcgtaaaaccaccggaa

SEQ ID NO: 654335 - DNA, 978 bp, Homo sapiens
tgggttggggctctaaagggggtaaagggggtgctaataggggtaattaggggcccatattttcaaagattttaaggggagaattaattctcataggaccagaggggcatgtgaaacgtggtggttggcctccaacagatttctcaagagcattggaccgtagttataccccgcggtgtgcggtgttagcgcgggtgaaagaggggttgtgggtctaacaacgttcgcgggaaattgtgcattcgtgggtttataaaagccctataagtggtggcggaaacagtcctcagtggagtgtgcaaaggagagatcgtgggtgaagtggtaattatattatattaccagaattggggggggtttacaaatgcgggagagtgtacatacttcagattgtggctacaacggtcaaagggaaggtcagaaagggtgtggcccgggggtctcataggaaaaaataaaggggggcggaccaacgataagttgaacgggcaacgcttgcacagaatttcaaagctccgcgcgcgaaaacctgcgcgggagataacacctccgaagaagggtctcacaagaaatcacccatgttggggggggggggccaaaatgtggggcaacttgcggaagtgcgccaacacgggggaaggggagaacctccggttgaggacaccccaactcgacatgcggggcgtaaccagccgtgcatacacagagggaaagtgccgccgctctaaggcgggaccaagtggggcgccgaggggcgaccgcaacctgagaggggcaccatagggcaaatgccaaccgggcgacgggcgcccgcagcagacaaacaaaggcttcaaccagcaccagagggggcgattcaacaataattatcccccctgaggaacacggcggcatctgctgagacaaaaattggatcaacaaccaaactgcaaacacaatccaaagaaacaaggcggctgtcggcgaagaagcggtgca

SEQ ID NO: 654336 - DNA, 471 bp, Homo sapiens
  misc_feature (36)..(36): n is a, c, g, or t
  misc_feature (98)..(99): n is a, c, g, or t
  misc_feature (341)..(341): n is a, c, g, or t
  misc_feature (366)..(366): n is a, c, g, or t
  misc_feature (434)..(434): n is a, c, g, or t
ggtcgacaaattaccagccagcccagctactcaggnttgcttgcacttgggagactgaggctacagtgagccatgcttgcaccactgcactccagccnnggaaacagaatgagaccctgtcccaaaaacaagaaactcaaattatttatttaacagagatatccagtcttttggcttccctgggccacattggaagaagaatggtcttggggcacacatagaatactaaaatacactaatactgacgatagctgataagtttaaaaaaattgcaaaaagtctcataaatctcataatgttttaagaaagttctccaggcacggtggctcacacctgtaatnccagcactttgggaaggctgaagcnggcagaacaccaaggtcaggagattcgagaccattctgggttaacacgatgaaaacttcatctctacntaaaatttccaaaaaaaaaagttcgacgccggccgga

SEQ ID NO: 654337 - DNA, 203 bp, Homo sapiens
taccgaataacatctggactaggctgaagcccacggacagacccagaatcaccaacagggaaacggggcttcctcccccgagccgagcttgtgtcagactgacagcatgagaccagcaggcagagacaagccagcatggcaaaagcaggcatccccaaagcaggcaagcaagcgtgtgcggcccgtgctgactccacagtccc

SEQ ID NO: 654338 - DNA, 383 bp, Homo sapiens
  misc_feature (46)..(46): n is a, c, g, or t
  misc_feature (383)..(383): n is a, c, g, or t
caaccaagaaaaaaaaaaaagaaaaaaaaaaaaaaaaaaaaaaacnggggttctgcatagtcctagtaatcgttaacgtgcacggatcccctcagccagcatagtaggtattgtaagtgtgtgagtggtgttggcaatcgaaatgagtgggtgtgtaaaggatatagtaagtgtagggggcatgaaaaagactagagtgttgttgctggccggtagactgtggggagccaagggattccacagggtcactgttgagtttgggggcataaccatgaaaataagcatatgcctaatagtaataattagtagtgataagtaaggctgataagggagaggggatccgtgcacgttaacgattactaggactatgcatattttgggtn

SEQ ID NO: 654339 - DNA, 1003 bp, Homo sapiens
  misc_feature (280)..(280): n is a, c, g, or t
tcactaacccctaatgtttaatgtctggaagccataaagagtcccccgagtggagaccaccgtgtggaataaagcccccgttggaagtccgcgccagctggtgtagccggagtgtcaaacagagttccaaagtcgtctgtgatctcttgcctaaagacgaaacaagtaaaagaaggctcccacacccgacggtgtattacgggacacctgaaaccttggttcgaaaatgctcccaagatgcttgggccgaactctgctattgtactcgagtctacggccntgttccaaagcgagtggtgtcccttgacgcattcgcatggacgcactatgaagaacgccatgctgcagagcacgtgtccgttgcggtatacaaaggggaaccgagtccccattcggtagccctcgtatctcgcgtgccatggcaccggcgaaaggttcactgaaagaccccacaggggagcttgcccaagttgaatgtcatgacgcaactcgcggaaaaccacctatccctcgccctcacctctgcaccgctcccctccacgcacaccgcacccagtcactgcgcctccgcattggagcccaccgtagataatagtagcccgtatgatcacagttagacccaccacaatcacacgtcctgcacactggacccacggcccacggcacaagcaatcccctgcgcgtggatttcacctcaccactattgtaaccacgatgttgagtgaccaagactcatgtggccctgtatcgtacagagagctatagtagattaaactgtgacggcataaccacatgacttgtccacacgcatagggccaggcattcccctgtcctcccacaggtcggctgcttgcgcaacggctgttcagatcgtgcacttccccaagtcggcactgagtggcccagcaaccaccttagcactgccaccccactgccctcctgggccttctgagactggatgggcacctggaggggttcaggttttaacttttttaatgtaagt

SEQ ID NO: 654340 - DNA, 578 bp, Homo sapiens
  misc_feature (46)..(46): n is a, c, g, or t
  misc_feature (578)..(578): n is a, c, g, or t
caaccaagaaaaaaaaaaaagaaaaaaaaaaaaaaaaaaaaaaacnggggttctgcatagtcctagtaatcgttaacgtgcacggatccccctgatgaaagagtagggaagatcggatgttcagcataataactaccatagagggattaagtggtgatagcattgtaaaagcgatgcagggaaaggaaattacctccacttcagccagcatagtaggtattgtaagtgtgtgagtggtgttggcaatcgaaatgagtgggtgtgtaaaggatatagtaagtgtagggggcatgaaaaagactagagtgttgttgctggccggtagactgtggggagccaagggattccacagggtcactgttgagtttgggggcataaccatgaaaataagcatatgcctaatagtaataattagtagtgataagtaaggatgataaggaataggaactaagaccggtgtgatataagaagttgtggtatgcataatgttggtaatagtccctactctttcatcagctgataagggagaggggatccgtgcacgttaacgattactaggactatgcatattttgggtn

SEQ ID NO: 654341 - DNA, 399 bp, Homo sapiens
  misc_feature (46)..(46): n is a, c, g, or t
  misc_feature (399)..(399): n is a, c, g, or t
caaccaagaaaaaaaaaaaagaaaaaaaaaaaaaaaaaaaaaaacnggggttctgcatagtcctagtaatcgttaacgtgcacggatcccctcagccagcatagtaggtattgtaagtgtgtgagtggtgttggcaatcgaaatgagtgggtgtgtaaaggatatagtaagtgtagggggcatgaaaaagactagagtgttgttgctggccggtagactgtggggagccaagggattccacagggtcactgttgagtttgggggcgacacctaaatgctgtttaggattagtctgagtatattagccaggttccaggaagggctgataaggagagggctgataagggagaggggatccgtgcacgttaacgattactaggactatgcatattttgggtn

SEQ ID NO: 654342 - DNA, 325 bp, Homo sapiens
  misc_feature (46)..(46): n is a, c, g, or t
  misc_feature (164)..(164): n is a, c, g, or t
  misc_feature (325)..(325): n is a, c, g, or t
caaccaagaaaaaaaaaaaagaaaaaaaaaaaaaaaaaaaaaaacnggggttctgcatagtcctagtaatcgttaacgtgcacggatcccctctcccttatcagcctgtgtgtttgggtcatctgcaaaaatgtggttttgaagaggagcgaatagactcctanctgaagctgagagtaatgagccatggggacacctaaatgctgtttaggattagtctgagtatattagccaggttccaggaagggctgataaggagagggctgataagggagaggggatccgtgcacgttaacgattactaggactatgcatattttgggtn

SEQ ID NO: 654343 - DNA, 172 bp, Homo sapiens
taagaatataagcgattagcaacacacacacacacacacacggagatgtgctcatgatacgttagatataatataaggaaaataaagtacaagtgatttagaaagaagcgctaagtgggatcagtaatacaacacatgatccccacacagtggggaactaaagggggccccg

SEQ ID NO: 654344 - DNA, 688 bp, Homo sapiens
ggagagttggtggctggacctcctgcgacttccgatgttgcgatgctgtacttctcttggtggtgggcggctcggccatctgcagagatgtgggcagcatggatcaggatggccattgcgggctcatgcacagacgagacgcagcccgagactcagactggggaagcaaacaggggctggacaggccaggagagcctgtcggacagtgatcctgagatgtgggagtggctgcagagggagaaggacaggcagtgtcgctggccgtggaggcgtcattgccgtcagagaactgtctggcagccgagcgtgcgcgtgggaggcccgtggggtcctgtctgaacaacaagtactcggagggtgatcctggcaagagatactatgggggagcagaggtggtggatgaaattgagcatgctgtgccagcgccgggccttggaagcctttgacctggatccgtgcacagtggggagtcaatgtccgagcctaatccgggtccccagccaagctggacgtctacacagcaccttctgcaacctcacgaacggatcatggaggctggacctggccgatgggggccagtctcaaccaaggctacatgtctgaacgtcgagcggatatcagcacgtccatctatctacgagtctatgccctataagctcaaccccaaaaactgggctcattggagtac

SEQ ID NO: 654345 - DNA, 115 bp, Homo sapiens
  misc_feature (6)..(6): n is a, c, g, or t
actctngacgactccctgacgacgaccgtgttgatgtacggggaagttggtggctgcagctcagcgtggttttctcctggtgtccagcagaaacggcggcggcgcagtgttgtgg

SEQ ID NO: 654346 - DNA, 259 bp, Homo sapiens
  misc_feature (71)..(71): n is a, c, g, or t
  misc_feature (104)..(104): n is a, c, g, or t
  misc_feature (126)..(126): n is a, c, g, or t
  misc_feature (149)..(149): n is a, c, g, or t
  misc_feature (201)..(201): n is a, c, g, or t
  misc_feature (211)..(211): n is a, c, g, or t
  misc_feature (227)..(227): n is a, c, g, or t
agagagagagagagagagagagagagagaggagaacctcggcgctccggcggcgcgggcaccacgagcggnctcgcagcggctcagaggaggcaggcgagtgancgagtccgaggggtggccgggnaggtggtggcgcgcgaagatggnccgcaagcaaaggatcgtatggcaacgagaagcacacaagaacataccagcncggaacgtcncaagactcgagaaatnccccgagagaggcgtctgtagacctggttatt

SEQ ID NO: 654347 - DNA, 161 bp, Homo sapiens
gatggcgactgtatacacgtacatgtactacacatcatgcactcgatgtttagactatcggtctagccatatatatccagcacttcctccttaaaatggcatccgtaggccatctcgcataccttcctgcgtcactccattccttcaaacgttaaataagt

SEQ ID NO: 654348 - DNA, 206 bp, Homo sapiens
  misc_feature (88)..(88): n is a, c, g, or t
  misc_feature (201)..(201): n is a, c, g, or t
gccggtaccaagcgactctccacccacgcgtgggctcaacttccttcccggcttttccctccaagctcctattttactggtgtcagcnggaaggaaacctttccctctggggacctctttaccctcggtgaccggtggggttagaccagagagggactctggggtcatgtctggctcggggctggcggccgggcaggactngaacg

SEQ ID NO: 654349 - DNA, 528 bp, Homo sapiens
gagagaactagtctcgagttttcgaggtatatttttctgaggtaggcaaattgttaaatccggcccatttgcccttctgaaaccttgaaacacactccaaaaacagcacgcacttggaccgtgggtggggcaaagtgggcactctcgccggatataggtatacttacagtgttcaatataattccgtgtccatataacggtgtgctgtaatagaaattacacttataagtgtgtttcacaaaaacgtgacgagctccagcgggggctctgcgagagccacaatgcccagggcgggaactgtggggtctcaaaaacacactctccgagggcctgtgccccatatgttctcccaggcgtggcccttggagctcccggaacaattctctaataagctgtgcgccctttgtgtgacactgtgtggggcccccaaagggaatattattctcactggtggagaggggggcgccccgtacagactttgtgagaaccccaccccacacttggtgtctcttatgaggggaaatatcg

SEQ ID NO: 654350 - DNA, 160 bp, Homo sapiens
tagcggaccctaacctaaatggctggtaaccgccggaagaaaccacatagagatgtaagcataaaacctcaggctgacggcccacccgaagcatgaagacaatctaaggcctctaagccagggacaggaatctatggaaggacgtctctaggtctaggca

SEQ ID NO: 654351 - DNA, 335 bp, Homo sapiens
  misc_feature (264)..(264): n is a, c, g, or t
  misc_feature (311)..(311): n is a, c, g, or t
  misc_feature (323)..(323): n is a, c, g, or t
tcaaataaggattttgggtttttttggaaacagggtctcccactgttacccaggctagtgtgcagtggtacaatcacaactcactgcagccttgacttcctgggctcaggtgatcctcctgcctcagcctcctgaggagctgggattataggcgtgtgccaacatgtcaggctaattttttgtattttttgtagagatggggtctcaccatgctgcgcaggctggtctcaaactcctggactcaagcaatcctcccacctcagnctcccaaaatgctgggatttagaggcgtgagccacttgtgccccagncccaagtaaggnaaattttgttaa

SEQ ID NO: 654352 - DNA, 343 bp, Homo sapiens
aaagtagttgtgtctaaaataataaacacattataactacacacacagtcacacacacacacactcacacacacatacacacaaacaggcataccttctagatattgcgagtttgattccagaccactgtgacaaagccaatattgcaataaaacaagttacataaatattttagttttccagtgcatataaaaattatgcttatactatactattgtctattaaatgtgcaatagcattatgtctaaaaataaaatatacaaatctgaattaaaatattttattgctaaaagatgctaatgattattagagccttgaatgagttacagtctttttgctgatg

SEQ ID NO: 654353 - DNA, 376 bp, Homo sapiens
gacagacaggcaggtgcaggagacggggtgagcgcttttgggctctagccccatggcagcatctaggggtgtgttacaattaatgctcttttagcagttgctgtccgcggatggctaagtgttaaaccagctcagtggagagtcagggtggcagccttttacaccctgtcctcttggtacccgggtctttgtctagcatccaggaagaatcaggtcctacagacttgaaggatggtgaatacagagattttattgaatgatggaggaggctttcagcaggatggatggggagctggaaagcggatggagtgagaaggctgggggccgacgcccaagagctggagagaagagcaatcgggaaagcaatgaaaaagag

SEQ ID NO: 654354 - DNA, 155 bp, Homo sapiens
tttagctcatgactagacctgaaacagtaaatttggacaatattaaagactcaaataatcaatctccaaactgctatctaacacttgtcaaatcagattggatgcatggcaaatcaggttcatgtgttgcatctttatgtcctttggccatatcc

SEQ ID NO: 654355 - DNA, 981 bp, Homo sapiens
  misc_feature (809)..(809): n is a, c, g, or t
gggaggagcggtacctacaatgactggaaactattcttagctccgttcactgactgcaaaggttcatcaccctccgtgctttcagatttggttgagatataggctattcttcacaactcagctcttgaagagtatcaccaactgtctcagtgtgtgagttgcaccctatgcatcttgatacgctagtgccagctgaactacattctgagaagatactctcaacaacgatggtttcacccatgtactcgctcttgtactatgcatatacactaggaatggggttgtgtggaatcttcagcacattctcgctattctcatgtattccacagcagctacagtttgagtaaacaatcatggggcctggcaagaatggagtgctttccaagtgttgtaacgatggtcctaaaaggaggtacaacctagcttaatgcccgtggacttggtaattactcaactacattcaaaacaaagagtattcccagctcagtgacaagaaagtccgtgtgtttgcatcatggccatcttcttaatgtatgctaccaggcatgcaggtaagactgaatctggataatcaataccttggaattagtcaacatacgtcccacatgcccataggactgcgatctgcgaactgtcaccgttgttttagacaatcagacttgcaatgttccagaatacttggatggtgtccaccagtgtttggatcgcagaatgattccaacattggcattagtgctaaccattgacctctacactgtgagtactctgagtggttaagaattgtcagggctcaagcataaggagcaggngcacacgtcatttgggcccgaatgatacgagggggggtggtacccgtaaattttccacgaaaggacggtttgaggggaacgtcacggaggagaaggatggtcaaaggaaccggaagtaacgggaacaacactcttgtggaaacggcgcggaaaaggacaaaggaagagggca

SEQ ID NO: 654356 - DNA, 499 bp, Homo sapiens
ctacaggatccttgacagacgccacgtgggccgacagacccgcatgcgactgaccgacgatcaggccgatcaggaagatcgtgacaaacagatcgccaccgatattgcgggcgatttcataggcagccgaatcgacgttgtcgaacacgaacgacggatgagccaactgtacgaagtacgacaccccaacgaagatcaggccgccgatcagggtgatcagcatgatcgcccgcggaatggtccggcgcggatcgcgggtttcttcggtcagggtactcaccgcatcgaagcccaggaatgaataacaggcaatcgccgcgccgctcatgatcaggggcatctgcatatcgccgctgagaaacggtgccatcgtccacaacggcttgctggcgtcaccgccgatgtagtggatcgccaggaggacaaaggccaccagcaccagcatcatgaagccatagacatcatagatcttatatgcccagaaagacgtggcgtctgt

SEQ ID NO: 654357 - DNA, 141 bp, Homo sapiens
taagcatatcaggctttctctcctgctgctgaactggggcaacagcctgcagatcctggaccaggttgagctgcgcgcacggtaccctccatccataccccacaactctcctgcctcccgagccctcaactttgggtaccg

SEQ ID NO: 654358 - DNA, 102 bp, Homo sapiens
ttaaaagctaccgctctgaatgagaagtgacgaaggttatatactctgggatgcaacctatcatgttcaaatgtttgaaatcccacgatgttagaccaatct

SEQ ID NO: 654359 - DNA, 377 bp, Homo sapiens
taaagcgaggtggtcaggatacgaggatgtgaatcgaactactattttaatataatgatgtgagataaggcctctttcctttcctttccacttttgcttcatgcctatcaggacccataacaggcctgatggtcactacgtgtgaaccgtgtgaactgctcgcgtgtacaccgggctcactgtggacaccttcgcaggacacgcatcatctgtgtgatcgatgcgaccacagccattctttccctccctgcagatgagagtcgacagtgagagagagctgacccgggacgtctttcatttccataagcagcgcgcattgtggtggcactagctcctgctccaatatgtcacagatgacagagcaggttggaaattac

SEQ ID NO: 654360 - DNA, 242 bp, Homo sapiens
  misc_feature (149)..(149): n is a, c, g, or t
  misc_feature (190)..(191): n is a, c, g, or t
  misc_feature (241)..(241): n is a, c, g, or t
gcaggatggcatgggatttcattatgctactcagaatcatacacaatttaagattataaatggtttacttctgaaattttccatttaatatttttcggactgcgagttgactgcgagtaactgtgaactacagacaagtgaaaccatgngctaatagtaatacgtactataatcactaataggtagaatnnactatataagcttgttcttttcttctttttttgtttcatccgccccatgng

SEQ ID NO: 654361 - DNA, 174 bp, Homo sapiens
tatctgcaaggcagaccctgagggagacctactccagctagggaaggtgagtgtcccagaggaggagctggacgccatgctgtaagagggcaagggcccataatcttaccgtcttcctcacgctctttgggagacgctcaatggcacaccctcgaggacgcactctgagcgccc

SEQ ID NO: 654362 - DNA, 396 bp, Homo sapiens
ttaaaacttttacgatttggattatttgcattatactggatgagcatattcaatgcaaaaatctgaatactgaaatgctccaatgagcatttcctttgagtatcatgtcagcgctaaaaatgttcctgattttggaggatttctagatttttggattagggatattgaacatgtatgaaaaatgtatactgcttctaaaatattacatttttagcatgtttatttcaagacagaatgagtatttgataggttatgtcctaccagttcaggatatacaatttgaatagaggtcaaatcctgtttcagtaaattccaatgtactaaaaaccttgaaaatttaatgacagcctcaaaactacaatgcttaacattatcacctttagcataggacactca

SEQ ID NO: 654363 - DNA, 510 bp, Homo sapiens
tcagcagcggaaggctaagtgggatgaggcaaggggatcacttgaaaccaggaattcagagcagtcctggcaacagtgagaccctgtctctacaaacgaaaaaaaaaaaaaaaaaaaaaaaccggggcaccgccggtggctccagcttactttactttattcggggaagggctaagggtgggaaacccaaaatctcgcttaactatctggggatgtggcgtggagggcttgccccgggaagccccgggggtctcgcccccactgtgcccacacagcccgtggggaaaccaaaaagaaaaaaaaccccgtgctcaattttaactcaaaaaccaaataaaaattgaaatttgaaattgcaatgtgcccccgtggcttagggaaaaggtgcgttgaacagagggggaatctctctctttaaaagagtataacaaacccgtgtcagggagccctgtgtcaaagagccttgtgcgccccacgggggaccccgtccgcattatatcaaacaaaaag

SEQ ID NO: 654364 - DNA, 120 bp, Homo sapiens
gaactacgggtagtactactagttaagagaaggacataggacaaggtacgagacattcgctgcgcagtggtgcagatgccgctctagtaggagggcagctagtggcttctacggtgcccg

SEQ ID NO: 654365 - DNA, 378 bp, Homo sapiens
atttctcagtaatcatgtaaaccttttttttttccttctccactctaacaaaagtacaagaacaaaactttggctgaggtctgggacctccactactggtagtaatgtgggcctggacagcatggcaggtctgtcggcagttcctcaagtcgggtacaaaggaacgatcatcatctctggcccctcccttggtcacagctgtggtcgtgacacgatcagatatgtctgaatgcacgtcactatacactttaacaacctaggcaaagtgtaagctatcgtggcccaccgaattgcgaggtagcacacaaaacaaacacaacattgctcggttcactttagcacagacgtggaaaaggctatccaggacactccctggag

SEQ ID NO: 654366 - DNA, 332 bp, Homo sapiens
acacatcaagtgtacgattgaaatagcttaaagtaggaacagacatctaatctccatatatacctataatcaggagaaatataattgagcaccatttcacagacagttctgaaacacagaggttaagtcacttgcctggggatacacaggggcaggcacggtggtttacacctataatcccaacactttgggacgccgaggtgggtggatcatcacctgaggtcaggagttcgagaccagcctggccaacatgatgaaaccccgtctctactaaaaatacaaaaaattagccggtgaggtggcgggcacttgtaatcccagctacttgggag

SEQ ID NO: 654367 - DNA, 352 bp, Homo sapiens
catcagctcgctaccgttaaggttgtgctgggtcccagcgtctgtaggaagcactttgggaggcccaggcaggaggatctcttgagcccaggagcttgagaccagcctaggcaggatggggcaacctcttctctttagagaataataattttacaaattagccaggcgtgatggcgggtgtctgtcgtcccagctactccggaggctgaggtgggaggatcgcttgagcccaggagattaaggctgcagtgagccatggtcatcccactgcactccatcctgggtgacggagcgagaccctgtctcaaaaataatagcaatcatcatcagtagcagcagcagcacaacctgg

SEQ ID NO: 654368 - DNA, 173 bp, Homo sapiens
cgtggttagacgtggtcttgccaacaatatagtttggtgtttcggagccaagaggtctctttattactatccacgatcgagggcatattgcttcagttctcaatgcatggccagaagatgtcatcaaggccattgtggtgacttgatggagagcgtattcgtggcttgtgggt

SEQ ID NO: 654369 - DNA, 1109 bp, Homo sapiens
  misc_feature (257)..(257): n is a, c, g, or t
  misc_feature (799)..(799): n is a, c, g, or t
  misc_feature (801)..(801): n is a, c, g, or t
  misc_feature (803)..(805): n is a, c, g, or t
aggcaagatttcaatagcagatacagtgcactgaatgtccaacatcagatgttgaaaagccaacacgaggagctaaagaaacagcacagtgacttggaagaggaacatcgcaaacaaggggaagacttcagtagaacatttaatgaccataagcaaaaatacttgcagctccagcaagaaaaagaacaagaactttctaagctaaaagagactgtatacaatttgagagaagagaatagacaactaaggaaagcacnccaagacatacatacacagcttcaagatgtcaaggtaaaagaaaaccaaacgtttcactatttagtgtttgcctgctttatttggtagaatgactttaaaaagtcattccctaattggcctgctttacaaatccacgttgttattgtgggctttgcattaactagagtgtacctaatatttttaccacttcagcattgtaagctaaaagatggtctgaaaatctgaatattctcattagtactgaaattattctcatgctagttacatattaataagcttttatttataaaagtttactaataatgagaaatttgtttctttggttttgatttcattgtaaataaatgattatgatatttgggtagcacgttttagattttggaatactacataaagcgtagtgttctctctacgatgatttttaaacttaacacatgctgctacaacaacaaataaacaagcaagtaacatttgggtagccatatcacgatcagccaaagaagaatttgtcgtagaatgttaaagctcaacatgtaaaatncntnnntgtgtcaagcaacagcataagaatttactctccgagcatgaacaacttgtagtgactttggaagaccacaagagtgcactagctgctgcacaggttagaagggtagcagcctctgtgggttcttttacaagtctgcttaacatttctcaattcctttatgcatgtagtctcttacaagccaatcttcagtgagttccttaggacagagctatcctaatcctgaggatcatgcatgctttccaaattcaatcagtaagatattaacttttgattattttttgccctggtgtgcggtacataatat

SEQ ID NO: 654370 - DNA, 121 bp, Homo sapiens
cccaggggtttaaaaccaaaccaaaaccaaaaaaacccccaggggggttttccaggtggttgcccccaaccctttggaaagaaaaggggggaaataaaaaaaaattttttttccctgggga

SEQ ID NO: 654371 - DNA, 165 bp, Homo sapiens
  misc_feature (75)..(75): n is a, c, g, or t
gcttctgtggccatgcttcactagtctagctctcagcagaaggggcaaacctgtatgttgacatccaggtttggnctcccctgctacccatggaatattttatctgggacctttgttgtacacagaaaacagttacatgtgagcagtgggggcattgttacaaga

SEQ ID NO: 654372 - DNA, 280 bp, Homo sapiens
  misc_feature (9)..(9): n is a, c, g, or t
  misc_feature (12)..(12): n is a, c, g, or t
  misc_feature (14)..(14): n is a, c, g, or t
  misc_feature (16)..(16): n is a, c, g, or t
  misc_feature (20)..(20): n is a, c, g, or t
  misc_feature (90)..(90): n is a, c, g, or t
gatagaatngancngntacnctcgcgacgtgtatccctcgcgaacgtgttatccctcgcgaacgtgttatccctcgcgaacgtgttatcnctcgcgaacgtgttatccctcgcgaacgtgttatccctcgcgaacgtgttatccctcgcgaacgtgttatccctcgcgaacgtgttatccctcgcgaacgtgttatctctcgcgaacgtgttatcctctaacaaacttgcacatgtactcctgaatcgaacaacaacgtcaagaagaacacaactgcttg

SEQ ID NO: 654373 - DNA, 1150 bp, Homo sapiens
gattgcagaattgaagagaagcttatgcactataagacaaagatggtgatggaactataaacaagcgacaggaattggtgtaacctgtaaatgacgatctcttgaggcaggaatcccatgatgataggcagagttacaggacatgacttaatgaagtagatgctgatggtaatggcacaagttgaactttccctgaatttctgacaatgagtggcaacgcaaaagatgaacatcgacacagacaggtgcgcgaacgaaacttacgacgaacgcacttgccgtcgctgtttgactaacgcgatggcccacgtggggcctactacttacgtgctggcacacaccttcgcccatgttgactgaccgaaacccttggacgagaaggttaagcagattgaaggaagttgaatgaacatgatcagcggaaggcagatattggaatgggtgcatggtcacagtaaacctatgaaggagtgtggtaccaacttgctggacaggccaaagtgacaggaccctggtacccgacctggtggtaacaatttactgggtacaaaacactgggtcaatccggcccacatatccttggctcgtaacgtcatctggtcacacaggttacctccgctaacgggtccacaacacatatgccatgcatacgtacctaagggcactcccaattccccccatggtgacccaccccttactcttatggccactggtcccttaaacacctaattgacgacaacgtgcgaccagcgtacgctgttgcactgtggcgctacaccggagtaactccaaggccctctgggacattctacacctcagacggcacgtgcccaagcacggcgcaaccacgcgggcgaaccccatacaaccagccaccccaccccaagagaacgcccaacatcagaccgccgacacaccgccctaaccagcggggccatacccaaacacacccgtccaacgcggcagcacaccggcactacaacaccccacaacatacaggccgcacaacagctcccagcgcgccagcacacgaccaacacagccgacaccacagctggtcaacgaaaacaaacaccccacagccgcccgccggccccccgccctggccccacagcacccacacccacacccagaccgcggatacagcaca

SEQ ID NO: 654374 - DNA, 445 bp, Homo sapiens
  misc_feature (9)..(10): n is a, c, g, or t
  misc_feature (25)..(26): n is a, c, g, or t
  misc_feature (28)..(28): n is a, c, g, or t
  misc_feature (44)..(44): n is a, c, g, or t
  misc_feature (55)..(55): n is a, c, g, or t
  misc_feature (58)..(58): n is a, c, g, or t
  misc_feature (74)..(74): n is a, c, g, or t
  misc_feature (78)..(79): n is a, c, g, or t
  misc_feature (91)..(91): n is a, c, g, or t
  misc_feature (97)..(97): n is a, c, g, or t
  misc_feature (109)..(109): n is a, c, g, or t
  misc_feature (120)..(120): n is a, c, g, or t
  misc_feature (125)..(125): n is a, c, g, or t
  misc_feature (141)..(141): n is a, c, g, or t
  misc_feature (146)..(147): n is a, c, g, or t
  misc_feature (150)..(150): n is a, c, g, or t
  misc_feature (152)..(152): n is a, c, g, or t
  misc_feature (154)..(160): n is a, c, g, or t
  misc_feature (167)..(167): n is a, c, g, or t
  misc_feature (172)..(172): n is a, c, g, or t
  misc_feature (175)..(175): n is a, c, g, or t
  misc_feature (178)..(179): n is a, c, g, or t
  misc_feature (181)..(183): n is a, c, g, or t
  misc_feature (186)..(186): n is a, c, g, or t
  misc_feature (189)..(190): n is a, c, g, or t
  misc_feature (195)..(195): n is a, c, g, or t
  misc_feature (202)..(203): n is a, c, g, or t
  misc_feature (207)..(207): n is a, c, g, or t
  misc_feature (209)..(210): n is a, c, g, or t
  misc_feature (217)..(217): n is a, c, g, or t
  misc_feature (220)..(220): n is a, c, g, or t
  misc_feature (228)..(228): n is a, c, g, or t
  misc_feature (242)..(242): n is a, c, g, or t
  misc_feature (255)..(256): n is a, c, g, or t
  misc_feature (258)..(258): n is a, c, g, or t
  misc_feature (260)..(262): n is a, c, g, or t
  misc_feature (265)..(265): n is a, c, g, or t
  misc_feature (272)..(273): n is a, c, g, or t
  misc_feature (277)..(277): n is a, c, g, or t
  misc_feature (280)..(281): n is a, c, g, or t
  misc_feature (283)..(284): n is a, c, g, or t
  misc_feature (286)..(287): n is a, c, g, or t
  misc_feature (289)..(291): n is a, c, g, or t
  misc_feature (294)..(294): n is a, c, g, or t
  misc_feature (297)..(297): n is a, c, g, or t
  misc_feature (309)..(309): n is a, c, g, or t
  misc_feature (313)..(314): n is a, c, g, or t
  misc_feature (320)..(320): n is a, c, g, or t
  misc_feature (322)..(323): n is a, c, g, or t
  misc_feature (328)..(328): n is a, c, g, or t
  misc_feature (335)..(336): n is a, c, g, or t
  misc_feature (348)..(348): n is a, c, g, or t
  misc_feature (355)..(355): n is a, c, g, or t
  misc_feature (357)..(358): n is a, c, g, or t
  misc_feature (360)..(360): n is a, c, g, or t
  misc_feature (373)..(374): n is a, c, g, or t
  misc_feature (385)..(387): n is a, c, g, or t
  misc_feature (389)..(389): n is a, c, g, or t
  misc_feature (391)..(394): n is a, c, g, or t
  misc_feature (397)..(398): n is a, c, g, or t
  misc_feature (402)..(403): n is a, c, g, or t
  misc_feature (407)..(407): n is a, c, g, or t
  misc_feature (412)..(412): n is a, c, g, or t
  misc_feature (418)..(418): n is a, c, g, or t
  misc_feature (438)..(438): n is a, c, g, or t
  misc_feature (444)..(445): n is a, c, g, or t
catgcctgnnggtcgactctagagnnanccccagtggtgttggnggtgatggaanagngagcgaggaggaatgngacnngggcggcggganaaacgngcccggggcaanagtgagagttngcgcngagtggggtgggtagnggganntgngngnnnnnnnaagagtnttccncgnganntnnntgnagnntaggnagagttnnaatnanngtagatnggnggtgttgngaggattatgcgtnttatgtgctttanngnannntgngtacgtnngtgncgnntnngnncnnnttnctngccaccccaganttcnngtcttncnnggtgntgctgcnnctgccgcgattnagagatnanngngtgagcgtgtgcnncgtctccgccnnncntnnnnagnntgcnncgtnttgtnccgtcntcgtgcgtctcccccgtgantggtgnn

SEQ ID NO: 654375 - DNA, 690 bp, Homo sapiens
  misc_feature (2)..(2): n is a, c, g, or t
  misc_feature (71)..(71): n is a, c, g, or t
  misc_feature (95)..(95): n is a, c, g, or t
  misc_feature (114)..(114): n is a, c, g, or t
  misc_feature (118)..(118): n is a, c, g, or t
  misc_feature (121)..(121): n is a, c, g, or t
  misc_feature (132)..(132): n is a, c, g, or t
  misc_feature (150)..(152): n is a, c, g, or t
  misc_feature (154)..(154): n is a, c, g, or t
  misc_feature (160)..(160): n is a, c, g, or t
  misc_feature (163)..(163): n is a, c, g, or t
  misc_feature (165)..(165): n is a, c, g, or t
  misc_feature (169)..(169): n is a, c, g, or t
  misc_feature (172)..(172): n is a, c, g, or t
  misc_feature (175)..(176): n is a, c, g, or t
  misc_feature (184)..(185): n is a, c, g, or t
  misc_feature (187)..(187): n is a, c, g, or t
  misc_feature (197)..(197): n is a, c, g, or t
  misc_feature (199)..(199): n is a, c, g, or t
  misc_feature (208)..(208): n is a, c, g, or t
  misc_feature (226)..(226): n is a, c, g, or t
  misc_feature (231)..(231): n is a, c, g, or t
  misc_feature (236)..(236): n is a, c, g, or t
  misc_feature (241)..(241): n is a, c, g, or t
  misc_feature (252)..(252): n is a, c, g, or t
  misc_feature (261)..(261): n is a, c, g, or t
  misc_feature (264)..(264): n is a, c, g, or t
  misc_feature (267)..(267): n is a, c, g, or t
  misc_feature (272)..(272): n is a, c, g, or t
  misc_feature (293)..(293): n is a, c, g, or t
  misc_feature (296)..(297): n is a, c, g, or t
  misc_feature (304)..(305): n is a, c, g, or t
  misc_feature (310)..(310): n is a, c, g, or t
  misc_feature (319)..(319): n is a, c, g, or t
  misc_feature (325)..(325): n is a, c, g, or t
  misc_feature (328)..(328): n is a, c, g, or t
  misc_feature (333)..(334): n is a, c, g, or t
  misc_feature (346)..(346): n is a, c, g, or t
  misc_feature (348)..(348): n is a, c, g, or t
  misc_feature (350)..(350): n is a, c, g, or t
  misc_feature (361)..(361): n is a, c, g, or t
  misc_feature (365)..(365): n is a, c, g, or t
  misc_feature (397)..(397): n is a, c, g, or t
  misc_feature (399)..(399): n is a, c, g, or t
  misc_feature (410)..(413): n is a, c, g, or t
  misc_feature (415)..(415): n is a, c, g, or t
  misc_feature (418)..(418): n is a, c, g, or t
  misc_feature (459)..(459): n is a, c, g, or t
  misc_feature (463)..(464): n is a, c, g, or t
  misc_feature (467)..(467): n is a, c, g, or t
  misc_feature (488)..(488): n is a, c, g, or t
  misc_feature (504)..(504): n is a, c, g, or t
  misc_feature (520)..(520): n is a, c, g, or t
  misc_feature (534)..(534): n is a, c, g, or t
  misc_feature (576)..(576): n is a, c, g, or t
  misc_feature (578)..(578): n is a, c, g, or t
  misc_feature (581)..(581): n is a, c, g, or t
  misc_feature (610)..(610): n is a, c, g, or t
  misc_feature (686)..(686): n is a, c, g, or t
tngggtgggggggggggccccataggggcagagaggcctccctgggactttaggaggatgctgtgcggccnggcccatccccagcactcgaggcntaggaggagaggtgggctntggnagngggtgtggggngggagtgagaagaaaggnnntnaggtgnagntnaggnatntgnngctggggnntnatagttgagnangtagtagtngtggacgtaaatgagganggctnttggntgtcngatgatgagcnacaccacanagntgngttgnaatagttgaaatggaaaaagnggnnaaagaannaggcnagtgggatntgagcnatnatgcnngtgaacgcccanangngaacattcccncccncaagataaaaaggtaatagtggaagaaggccnangccaggaaaannnntnttntggcaataaaattgatgatgcaaagttgaagaatgggcttnttgnngtntttgttgcacaatttgtgcanaggggtgttccagttntgcaagaagtaggtgncagacttggagttnaaaaagtaaaggtagaaataaaggtataaaaaatgcatgagntnagnaaaggcattaaggcaggagtggaagagcnagtagaagaagatgagccagatgaggtgattggggacgccagcttcaggaggcgctcgatgatgcgtgagttgtcnatgt

SEQ ID NO: 654376 - DNA, 105 bp, Homo sapiens
cgttatgttggtagctaattcacaatttgacatgggcagcaagtttggtcactagccgttccaggatggccgatcaaagtaggtatgtaaacgtgcctgtaacca

SEQ ID NO: 654377 - DNA, 1026 bp, Homo sapiens
ggttcgtcccaaggggcgtccggcgaagaggcctctggtgccatgggtatgcggtattccgggacgctctgtggcatgggtcccggcactctgtagtcgtcgggatcgtggtccgcagccaacggggcacggggcgtcgccaagggctgttttgcccaggttggttccctggaggccggtctgtagggcctagggacggtcgctgtctcaacggcgatggggcggtgaagcgcggtggagggatggctgcaccgggctcgaggcgccccggcgggtgctatcgcgctgcaccaggtggagcagcgagcgcccgaggccaggcccgtggggcccccgtgctcccgggcaccggcctaccggtgtaacagaccgcctgtgcgtggggcctgagcacttgcggccgggcacatgtccggctcaccgcggtggtgccggggacctggcgcgggtacctggaaggtaccctagcgggccacacccgtggacagccgagctggaagggcgcacccccggctaccccagtggtgcctgcccgagcgcggcgggcctgcggctgaaggccccgacgctttgctcctggctcgtgggaaccggctgcatgagcttgcgcgtcctcacccgcgcccacggctgcgggcccagcgttgcccaggatggcgtgcagccttggcgccgctcgacgacctggactccaagaaggccaggggaggaggtctctctggagcccactctggaacccttgcctggaaccctccgtactctgacccgcgtacagacaaccaagcagctaatcccgttagtaccaagaaaggggagccaggatttagtcatggcccagcccagagactgggacctggagcacgatctgttgacttccctgggtaggacactgccacctctgggctcaggtcctcatgcgtccaaatggcatctagagtattgagcagcgttcttggctgcaggcaggcctagcctgtggcagcgggatagggccagcagagcatttggtgcccctcatgttactgc

SEQ ID NO: 654378 - DNA, 354 bp, Homo sapiens
agaccaggtaggagtgcaatggaatgtcacaagctctctgcatcactgcagccttgatctcccaggctgaagtgatccatcctgcctcagactcctaagcacatgcatagccacacctggctaatataatttatattttatattatttatatatttattataaagagacagggtctgactctattgcacagaaggtcacgaactcctgggttcaggtgatcctctggccccagcctcccaaagtgctaggattacaggcatgggccatcatccccgaccctacattttcaaatgactttctcattctccaaacccctgtaacttactcaggtgccactcaccttcagcaagcaa

SEQ ID NO: 654379 - DNA, 114 bp, Homo sapiens
ggcaggttcccgcccggaagaagcgaccaaagcgtctgaggaccagcaacatggtgcgctcggggaataaggcagactgttgtgctgatgtatggacgtgggcatttaccatga

SEQ ID NO: 654380 - DNA, 226 bp, Homo sapiens
gtaacccgtggaatcaatttttaagttgaccagattgtcttgggctcttttactttcagggggctgctatacctgggccaggctgtgtggcactataccaccctcaggcatgagtacagactggtcaaaatgtatatagcagtcaaggccaaagcctgccctgagcccagacacacctgggtccccatactggggcctggtcccctaaacaatctcttgctcattt

SEQ ID NO: 654381 - DNA, 165 bp, Homo sapiens
ttctaactagctccctctgtgtccttagaacctgtggcaggagcgaacatgctcgctcctgccaatggtgcggtcaggcggattcggcgttgatcgggatccagatttccacggtgcccgtgcctttacccacgtcgaagtcggcgctgtcgcgctcaaaatcgg

SEQ ID NO: 654382 - DNA, 1556 bp, Homo sapiens
  misc_feature (1067)..(1067): n is a, c, g, or t
  misc_feature (1297)..(1297): n is a, c, g, or t
actctggtggatgggtggtcgtgccggcgtgtcgcttgtctgcttgagcttgctgtatttgttgagctctgtgttggttgccgccgtctcgatgtggtcggtttcgttgtgtgagacatcttgtgttgtgtgttccacccgcgcagtgtttgtggttgtagtcgacgcttgcgtgctcgtggtgtttcatcattgtcgtgcttggggtcgttcggccttctttttacacgggttcttgttgtgcgccacagtatctctccgctgctgtggttttttgcccccacccgcgggttgtttttcattcttgggtgagagcctctcctctgttaggagtcccccactattattggagggggtctccccccacttgtgtttgttgggagtagttcgctctggatatggggcctgtgtgcccagaaaaaaggtgcttgtttgttgttttttgtttgcctctgtttgtgaagactcccgctgcataatctctgtgaatggtgggaagatgagccccgttgtggggatgactgtccccagggccccgtccccgtgggaccataagaaggaaggggaagaaagaacactcccagaagacaggggtttcaccaacagaataaggaggaaccgtattgttgatagtggaccccgcccttggtgaaaaaatagctttgggcttgaccggtgcgcccaattctgggggggctcggccccacacgggtggggccccacagctgatactcggggtggcactagattctttgggagcccaggtttaccctcttctgcgtggtgtctcgctctgtgctgccgccctgtggtgaacacccccaccacagaggctcgttgcacataggggcctcatatattgagaagagttgcacataatatcacgcctgctaagagatgtatatgttggaggaagacacacatattggtaaggcgcaccttatatatcacacgagttttttcggaaaatctctcccactctcgagaggtctcactctatatccgctctcggctatatagagatgacattggggttttttttgtgggatattgtagagaagggtggnctcaacccactgctgttctgcacacgtgttttccactctggtgttgagaacaccacaagagaaggtgtatacccccgagagcctctttcctcgtgaggccctcttctcgtagcgaatattctcttttggggagaattgaaggagaagccacggtccccgcgtctgtttcttgagaaccacgtatgcctaagcaccacactcccaagaataatggaacaccaccgggaganccgcctggcacgaaaggggagctctcaccgagaagtggttgtcacatggagatgttttatagccacttgttggctttcccctatcacaaacttgggccctctccctctcttggttttcccaaggcacttttattgtcttgaggttaataatgttcacctgtccccctaataattaagggaggtaaaaccggagtacccaagttgatttagtgtttttacctctgttttggctttcatgttattaaacgtatgcatgtga

SEQ ID NO: 654383 - DNA, 233 bp, Homo sapiens
ggtgctggaggactaatccaggtgatgggctgtagtgattgggactggaatgtacagggtgagactgggagaaccaagtgattgaaactgatatgaagagcctggcatgggggtagaaatgacctgaagatcggcctgagcacagtggctcatgcctgtcatcccagcactttgggaggccgaggcatgtggatcacctgaggttgggagttcacgaccagcctggcaaacat

SEQ ID NO: 654384 - DNA, 142 bp, Homo sapiens
ggttgccatacggtgtcattcgtatgtacatgaacagtgctatgtacatacaaagagtatgttataggggctgagcagacactacagcatttagtcaaagagaccaaagcccatgtcaccatccgactcctcctcgggctcc

SEQ ID NO: 654385 - DNA, 1237 bp, Homo sapiens
tagggagaaaaactttccatgtgtgcggtatcgtctttcagaatgtctcctggcatcctcacaccatgtacatcatgcacacattgggggtggggttgcacacatcagccccataacgcacctgatctatcacacacacttgcattgtcagagcaaaggcttctatatcatcctatttccaatcagcactgccgctggctctatttccatagagaccattccacataccatccatatatctatatctacacacacatattactagagactcattttattcatgtacacagtacacacatctcagccagagcacacgtcagggcttgacatccacgagactgatagacaggttaccagtcagccatcgacccagccattgaggcggtcccaagcagccatcaatattatcattaccactcatccgttaccaagtcccttgggtcagccagcacagggttagccatcagcatctccagattttgatccacaacacaagcacaggcttcagcaattcttcgccagtttccagctcgcaggttttaaactaaacacacacatgttcaccattgggtcaagtgggttaatgaggtcccagaagctcaggctcttctctcatttatgtccttcctgttcggcaatagaaaacattgtcgcattttccttccatcctgttgactggtgccatcagaccaccaggtctcatcagtattgcaacttacagtcatagtttgcaaattacctagataacttgtcaacacctgagcactactccttgctgacagttcaccactgcaacctaccagcagtacctggacctcctacacccaagcgcaatacctcaccaggcgcacaactgccggccgccaccacaggcacatacgccgcaggcgacacccacacaaaacggcaaaagacagccggcacgccacgcagccacaacaggacacacccctgccaggccgggaaagtccagaccgcacacaatggagagccagcgcctccagcgacccccgcgcaagacaccggacacccctttgggaaaccgagaacagtaactacggctggtcacgacatgcaccgtggatcaaggaacagaaacagcgggagatcaccgaccacaaacaaggcacaaaccactctcaccacacaccgagcgggcagaacaccgcacaactaacacaacgagacaacacggaacagcgcacagcggctcccccgacattgctcgtggccgccc

SEQ ID NO: 654386 - DNA, 211 bp, Homo sapiens
cgattaaccattctagggcgctcgttaggaggcgctcgttacggacgttacggaggcgctcgttaggcgctcgttacggaaggcgtccgtcacgaacgcctccgtaacgagcgcctccgtaacagcgcctccgtaacgacgcctccataatgagcgcttccgtaacagccccaccaagaaaagaaaaatcgcgatcccgaggcgctcgtta

SEQ ID NO: 654387 - DNA, 607 bp, Homo sapiens
ctgtcctatgtgcaaacttactatatgaaggcccgtgggactgtgccgaattcgccatgtactgagtaacgtagcattcgactagtggaacggtcgtcaccagaagccaagctggtaccgaagatcagccctcggcgactcgccgggacaactcccttgggcctagagccacttcgaacttcggggatctcgacctcttcctcaggatggggagctcactccgagaaacaggagaaatcaacatagcagtaacaaaagaatggtttatgattgccagtttgggcctcctcagtgccctcacactctgctacatgatcatcagagccacagctagcttgaatgctaatgaggtagaatggtttgacagaagaaaaaacctgctttgctgactgatttcgccttgacggcaagacgaacctattttgtgcatcatagaccaatcatgccacagcaagcatttatatattagtacatcatagtagcagcctaacagtagctaatgccaaaagcttgtagttacacacgaactccataataaaataaaaaaaaacacacagaccaaagagaaacaggggggaagaaataaaaagagaaccaccaaagagaa

SEQ ID NO: 654388 - DNA, 928 bp, Homo sapiens
ggacatgcgccagagattagccagtggggccggtatctacctcccttgtaggagctccgaatggatcatacagacggcactgaaccagggggttgttgaatctagactacacccgctgggaaactgggtttctcttcgaccactggaagccacgcagagttctgctcgaactaccaaggcgagctcacccaggacgtactgtccctcttgctggaggcgtgcaggattccagaaaggaagacgtagcgccgccccggtgctggacagcccggcgtgtgtcttgggctcctaaagctcgtagtccgaaattacatcgtaatgctttgatcgtgcgcgtactcttagaatccatgagtctgataccacagtagcagaaaatgacccaagtatcctcgtgcccactcatgtaagcctcaaaaggtgatgtgtgtgggacactgtacacctagggataaatgaatcgtttaactacaaagaggagcaggtggatgcatgagttggtgtctgaaagtaaaggtgcttgtgtaagggagggtgtagcacgcatgaaatgtgattacctggtagggggatcccggtagtaagatggcaatgggggattataggcccattgatctagatggctcaagttgtgaaatgaactaggggtgttggaaaggaaaccttttgtcttgacgggtgtaggtattccacactatcctgggacaactcacgggggggcaataagttctttcgcaggaggtcatcgtgaaaacccttcttccagtccttcaccccacaccaggaattgcgaatgtcccaaggaaccgtgaaaatagcgatgtagcccacattctaagagagtaagcgggagggataccagaaacccccgaggcttggtcactgtgatagtaatctccagaaattaacccagaggacctgtggtccc

SEQ ID NO: 654389 - DNA, 380 bp, Homo sapiens
tattaagtatttactgtgagtccagtaagccaaaggaccaaacaaaataggttcagggtttcattttatactcacagattctgattcttacccatatgtcatcagttcagtttgggacatgtggtgcagcatgtgtgaagaaaatattccttcaaatgtcaaaataaccactcgaaattgtccacaacactgagcacatattcgtatctaattaggctgccatacctttctgggatatttgtcaggtgctgtcgtttttataacatgatcctgaatctactatactcgttgtccctgatcatgtcacttgtaatcaggatttagaacgaccaaaccctctactacctaaaataaatatttgacacacccggaaaaaaaaa

SEQ ID NO: 654390 - DNA, 428 bp, Homo sapiens
agagagagagagagagagagagagagagagagagagagagagagagagagtgagagagagagactgacagcgccacagttagctccagacatttcactttcttcgctcttcctattcgtcattctcccgtccacctcttgtcctcttatctgtttctctgccttctctattccttgtatccccgacccttctggactctttttcgtcctgcctttttatacccgcttcttctttactttcgatctctctaccctgtcttccatttcctttttagtctcctttctctctcgttcttctcttgctcctcctgtctctccctgtatcctacttttccctcctttccttccgctcctgatttatcttctcttccgtcccctttttccgtcttcctctccttcctgtcctccctttcccttcctcttcccccc

SEQ ID NO: 654391 - DNA, 311 bp, Homo sapiens
  misc_feature (300)..(300): n is a, c, g, or t
atgcctgtagtctcagcctcccaagtagctgggattacaggtgcccgccaccacacctggctaatttttgtgtttttagtagagacagggtttcaccatgttgtccaggctggtcttgaattcccgacctcaggcaatccgcccatctcaacctcccaaagtgctgggattacaggcataagccaccgcgcccagtaggagatgtgatattatttcaagtaaataaaacctggaaacttgggcacatttgcctattttaatgtggcatcagtcatcttgaactagggttgatccgggggnttaattgaaaa

SEQ ID NO: 654392 - DNA, 323 bp, Homo sapiens
tgtttatcgatgccacctctaacccacgggcacaatattcttggacaattaataggtgtgtacagagcatataggacagtttgaggttatcgtctcttagtgaggtgaatagatggggggaggagaaatagggtgaaggagtaggtatgggggcgcacactgatatggaaggattggtgaagagatgtcagaatttctttggtctgctcttaggggaggacgagcttttgatttttgactatccagtccccttgaaaggaggctccttgctgtatagcaaagctttctcggttggcttgggcaggaggtggcatcgataaaca

SEQ ID NO: 654393 - DNA, 138 bp, Homo sapiens
ttgctagaaattctccaaaaagtattagtgggaattaaagtttgaagtccttgagagaggattatgatgcgactgtgagtgcgttcgtagtttgagtttgctaggcagaatagtaatgaggatgtgttcgttccattc

SEQ ID NO: 654394 - DNA, 409 bp, Homo sapiens
  misc_feature (322)..(322): n is a, c, g, or t
  misc_feature (331)..(332): n is a, c, g, or t
  misc_feature (369)..(369): n is a, c, g, or t
  misc_feature (392)..(392): n is a, c, g, or t
gtgccaaagcttcatcactaaccaagtggtcattctagagcacgataatcaaggagtatgggttcgtagggatccaagagtctccagctactaattcggtcaagttgttcctgtgcatgattaccagattagctccacctcgtccacctcacagcagcgaccacagctccagcgaacacagctccaaagagaactaggccagcaatgatgcccacgatggggatggtggtctggaaagacggctcccatctcagggtgaggggcttggggagaccctcatgctgcacatggcaggtgtatctctgctcctgtccagaaggcnccaccacanncgcccacttctggaaggtccatcccctgcaggcctgntctccacgagctccgtgtcctgngtctggtgagggtaccc

SEQ ID NO: 654395 - DNA, 696 bp, Homo sapiens
tatccctccgtaaaaggtgtccagtgcaaggccaagtatatccagtcacttaacgagaaggaatctcatcgcagagaccatctgccattcagctgctgcacggagttgaacttttccaagatatgctggcaaatgttaatcctcatccctacagatgaacgatagactagagcaagaaataacgagattgcagaactaaacgaagtcagcggtaaacctcctttctcaaagacaaaggggtgagggatgacggaaaggatgggggcgtgggactgagagtggacttaacttttatagcgtagattaagctggcaagtgtgaagtattttaagtctccatattagggctatagttggctacaatgtcggtaccgtggctagttgtagtaaggcctttaccagagcgttgttacagactgctcgagaggtgccccaagtcgtgccgtgtccttccggttcgtgccccacaagctcgtgttcctggatgaccctagcgtaaattattaatcatattgcctagtctctgtaaatctaaaacacttggacgctcatcgctcagatgtatagtctccatttacaggtctgtggaccgtcgtgtcatggtcttcctctagaaggtgctaccgcagaacattgatgtgtgctcctggccgtgcccatgccgagccgggctgaagtggtcactggagtggtccgg

SEQ ID NO: 654396 - DNA, 135 bp, Homo sapiens
ccggcgggtctcttccattacagacaaggggaggtcttgggccaggagctcttcttcgacatcatctagggcccacgggggatccggtcagctccaaagcttcccactcggtctggtaagggaagagaacaccca

SEQ ID NO: 654397 - DNA, 890 bp, Homo sapiens
taaaatccctcaaaaacggtttattatacaagtgagtttggagtcacgaggggcttatcggtaggattccgggtagcgagcgcgggcaccagggcctccaaatcttttgggactcgcagcgacgagggtcagctaccagcagggtccgggtcatactggggatggaggatgtcttggatctccttctgggaagcctcatccacatatttctgggtaataggccaccagggcttgggagatgggactggacggatagcataaatctgggggccacgtgaccaccaccctttacacggacacggatgtctacaccagcaaatcgctcctggccgagaagcagaacgggctccagcagcttgtactggtagcgtgggcgcggttcaatcatctccagggggccgcccgttcacctggatgaagaccatggccgcgtttggcagtggcgccacagtgggtcgctggtcttctggcgtccagaaaacctgaccgattggcagcggaccctgggacgggcatgggctccgaggcggtggactaagactaaatattatactagcatttaccatctcacttctaggaatactagtatatcggtcacacctaatatgctccctatatgctagaagggataatcactatcgctgcattatacgtactctcataaccctgaaacaattccttttagcaattttgtgcctgtggcgaataatttgggcgctggaaagacggggccaaggctatagtttattttcaaacatatgggctaatacgtgatactaaccatccaggtaataatggcccccatatttttcctgtgtggtcccaaacacattggttccccccgggtgttgctcccccttttgcctgaacattttcgcctttgccagaca

SEQ ID NO: 654398 - DNA, 143 bp, Homo sapiens
gggagacgatgtactggtaacggatcagcagtgatgatgcagatatttacattcttgcatgtgtgtgcgtgtgtgtgccgtgcgttgtgtgctgtgtgtgcatgtgtgtgcgtgtgtgtgctgtgtatttgtgtgtgtgctgc

SEQ ID NO: 654399 - DNA, 166 bp, Homo sapiens
agctctttctgcccctctgtttcctgctgcatcatgcctggctcccaggaggcctctcagcattttctgacaacaaagccggggctgcagatccctggtgagattccaggctagcatcagcactcctctcccgcacgcaccacagctaaagcacacaagggcaccg

SEQ ID NO: 654400 - DNA, 193 bp, Homo sapiens
gtgggtaccgcgtgttgaagggtgagaagcgattcaaagtactagtaactaggcgagcagcttctgatgctgcgtctgagggcttgagtcctgagcctccgctgctgcccttgccccagctcactcgaccctccaggtgcaaagagctggttgttagaatcgatggagcccaggcttggtgatctaggtgagt

SEQ ID NO: 654401 - DNA, 146 bp, Homo sapiens
tgttctagaggataccgcactgttgttcatacctgcactgttgttcatacttgcactgttgttcatacctgcgctgttgttcatacctgcactgctgttcatacttggtcgctgtatcggggggtcatggggtatgaacaacagtg

SEQ ID NO: 654402 - DNA, 154 bp, Homo sapiens
agccggagaaggaagctcgcccctaagcctgaggagacctgggtagaggagatgctgtgtgggctcaagatgaagctgaagcaaccgcgagtgtcatccatcctccctgagcaaccacaaggacctaaacagtcagcttggtatgaggaacacc

SEQ ID NO: 654403 - DNA, 447 bp, Homo sapiens
atccagtgatgttcaccctctagaatcaccacgatcaagagggacgatgcatcaagcatcgcaggactgtcagctcaaaacgcttagcctagcctcaccgcccacgggaaacagctgtgattaacctttaggcaatagacgaaagtttaactaaagctatactaaccccagggttggttcatttcgtgccagtcaccgcggtcacgcgattgaccccagtcaatagaagccggcgtaaagagtgtcttaagattaccccctcccctattgagctaagactcacctgagttgttcaacgactccagttgacacagaatagactacgagagtggctttgacatatctgaacacacaatagcttagaccccgactgggattagataccccactatgcttagccctgaacctctacagttttaatcaacaaaactgctcgccagaaggtac

SEQ ID NO: 654404 - DNA, 150 bp, Homo sapiens
gctcccacgtgcaggtgcagggcctctgcgggaacttcaacggcctggaagtgacgacttcaagacgggcagcgtgctggtggaggcacgggtgccggcgttttgtccaaccaccctgtgaatggcacagtcaagctagcatgacaagct

SEQ ID NO: 654405 - DNA, 376 bp, Homo sapiens
gttccagtacagggacacagtcccgatgggagcatccaaaatggaatctaaattagccaggcatggtggtgcatgcctgtaatcctagcttctcaggaggctgaggcaggagaattggttgaaccaaggaggaggaggtcgcagtaagccacgatcgcgccactgcactccagcctgggagacacagcaagactccgtctcaacaataaataaataaataaacacataaataaaaaatacaaaattagctgggtgtggtggctcacaccggtaatcccagctgctcaggaggctgagtcaggagattggcttgaacctaggaggcggaggttgcagtgaggagagtttctcccactgccctccagcctgggtcaca

SEQ ID NO: 654406 - DNA, 250 bp, Homo sapiens
caggatacaagaaaactgtgtagtatacaaagtgctctcagatttttatggtgaggtttataccatcacaagtaatgatacaaactggcttgaccattgcgcccattttacgcaaagctattcccactcctagctccttcatgtattcatcaaagcctttgctgtccaccaggcgccatcttccttccagctgctgaactgtggccatggtgggtgcgggcgggctggcgtgcagagagggtccaggcga

SEQ ID NO: 654407 - DNA, 166 bp, Homo sapiens
gtaggtcgatcactgtactaaacgtgctgggattacagcatgagcaccacgcccggcccttgattctttttaacagcaaaagtttgcctatttaaaatcatttttttcttttttttgaaacaggagctcactctgtcacccagactgtagtacagtgatcgaccaa

SEQ ID NO: 654408 - DNA, 280 bp, Homo sapiens
gggagaagaccacggttagcaatttcatatatatccttctacacttttacatacattttcttatatatccccatattttttacacaaaatatatagaagcaaagatacgtaccgtttcatttaacaacaacaaaagggggagagggagatcagacggggtccgggcctcgtttaacagggatagggggtcaggggggttccaggccagggcgggccctttaatggaggggggagaaatcggagatccagaggagagaaataactggccatttctgtgtag

SEQ ID NO: 654409 - DNA, 643 bp, Homo sapiens
ataatttcatgaagtacatatatattgttcccatagtcttcagctttaaaactataaatatgcccaaacttttggttatttcgccctactttaaggtacggtttattggtagttatagtatttttccacgggtacttgttttttctctggataaggaactcagggaattctggaaacatgggtgaaattggttctcaaattccgtttgtgcgttcattattgattaaagaccatatgaaaaaattcaagagaatgtggtctaaagttttataaggtcttaatacgttaagaccaaaccttttttaagtttgtaaaacttttaaagttttacggcaaaaatgtttaagttttaaaaacttctcttgtggggggccccaaaactttaactttggggaaatatttctttcccccaaaattttgaaacctttgtttaagacgccacaaggttttcaatcttgggggcttttaagatttactttccccggggacatcaattatgctaagctcacaacattttctcttactcttacctctcttccaacaagaagaacaacttttcaaacggctccttaacttaatattacaacattcttcacccaaaataaaatcaccaccgtttttttcccaaacacaacttttagga

SEQ ID NO: 654410 - DNA, 102 bp, Homo sapiens
ttacacctaatttctccttaatgcctaaacttccattgatttaaaatcttgcttttaaatccattgtcttgttcctcaaatctggggagaatatgagcgaag

SEQ ID NO: 654411 - DNA, 209 bp, Homo sapiens
caggtggaaccgtggcccaagagtgtagaatgggagagagctagggctggacccgagagcggtctacctctaaagctcatcctgtctctcctgatgcctcacctctctctccttacattcattccctccaaacatacccacaccgctggatacgtcccttacatgtcatttgaccatgagcctgggggaccttggttaggtctacctgg

SEQ ID NO: 654412 - DNA, 657 bp, Homo sapiens
ttacagctttgagactaagggatttagtgcttgaatgccttgactgtcaggaaaccgctgaacagctacgtctgggctacatgtttgggtttctcgccctgccttcttcctggccctttgattttgccaccgtcaagcgtgtccagcgctagactgtggaggaaagaatcagacttggaaagtatgagtatccaaggactcctccatcagatgggtcccacgaagtcccctgcccatgggacagccattcctctccgtgagcccctgcactggcaccagttcctccgagggacgcagcaggccgcctcccgcagcggccgtagggtctagcacaagcccaagcaccaagccccaaggcaccgacaggatgctagggactgcttgctaacacaacgctagtggaaacgcatgtgtcaccttctccgaccgtgcccagatagcccccatccccacagtgctcaggagacccgtggggacacggaacaggagggataaggaccggtgtggcccagccaaaggctaccagacagccacaaccaagcccagccacatccagatgcctagagggcctggcaactggctcgtcacagcctggacccgagcacctcggggtggcagagggacagcccaacggccaagcagacatgcgagcttcct

SEQ ID NO: 654413 - DNA, 212 bp, Homo sapiens
gtcgcgcagatgaagggagagggtccagggcgtcctaaatgctgccgctgtcactgtccatctcgctgcgtttcagagacagtggaagctgctctttacctctaaagcgccccgcagacttggcgtcttcacttgtctcaagagctcctagatcctttggtctcgtgtccctttggcaccccgtagctggcttggtgaacgagggcttggtt

SEQ ID NO: 654414 - DNA, 1123 bp, Homo sapiens
ccaaaaggaaaattcggtgtatattgcgcccaccaaaggcaagaaacagggaagggcgccccgcgcccgggaatggggcttccaccaggggttacactgtgcaaccgggacccaaaaaggggtaaaggaaccacagaaatctggggtaaaaaaacccacgattccgtgcctttcaaggaacacagggggtctcaggttggtcacattgcctccgcgagaacccacgcccctcgcgggcctgcacaaaatataaaaagggtgaaaaaagatgaggagacctggggagaattttgggcacactgggtggctcggagatttatacaggttggagtgggccccgctcgagaagaatccccctggggagaaaccccacctacccagacaatggtacgtccttaatggtcaccacgaagggaggcctttctccccccaacgctcactaaagatgcccacaacatttttcccacgcgtgggagatctccccacacaggagtgtcttaaatattttgggccacacctccacatgggagggctcacatggaagcttctgaatctcgttgcctttgagaaaaaatccctgtggaaaatagccaaaatcttgtgttcaagcacattgtgcctcccacatttgcaaaccccccgttagactcctgggttccccgggggcacacaaaagcccctcttatggtggaataattttgggaacacacgagatcacacaagtataaatggagagggccttatatgaatgcctaaacccccccttgttgaaaattcctaatccacggagttctcacaggctggaacaataactaaattgaatacaaaggggagaaagaatgagccacgttttttctttaagagatggagcacgttatactctccctcgagaaaactttcaaataagctgcctgtacagagaaagagaaatccccgcttgtttttcgagttgcacgaagggttaagagtcaatagctactaacttcacttgccacccttaattaactgagccaccactcacgaacactcacatgctaaaaacctgaaagcatgaaaaaactcccaataagagaatctcttcaggattataaaagttgtaaaaagcaactgtattgctgagcca

SEQ ID NO: 654415 - DNA, 118 bp, Homo sapiens
aagtcatatgcatctgtgaaatcttccaggctctgattgcatgctctatagcacataaccttggcttcacatttctgactttactgtcaagctctttctgtttgtctaacatcactgt

SEQ ID NO: 654416 - DNA, 149 bp, Homo sapiens
ccagggcttatgaatacacagcgatgggtgcgaaggagtatgtcaggcaaggttattactcctttacacatctggagcaagtggtgaacgtggtccccctggtcccatgggcccccctggattggctggaccccgctggtgtattcctg

SEQ ID NO: 654417 - DNA, 424 bp, Homo sapiens
tagatacagacaaattgggtcatatgctatctatgataatggaatatatatctctatacaacaaatatgcaacaatcaagacctggtgagctatctcccagccttacatctttgggcttttagcacatcatcttcctgtccagaatgtctaactctcttcttggggttagcataaaaccctataatgtctagcagaaatttcatctcctccttggagtgccctatcctgaaatcctttctgcccactactttactcctctgaggagtgtctctgcaattcatttggtgaccaaccacatgccaaatcatttgtaccttattttaaatttccatttcgtatttttcttatgtcttacttttccagctatcagctcctgccttcaccagttcttcttggcccctgtttctgaagccatgttcctat

SEQ ID NO: 654418 - DNA, 491 bp, Homo sapiens
atagtgaatgatggtgaagtagtggtagctttccttcttttcttctttttgtgatgtccactgaaaaataacagtatgggactatgtagccccataattttttttccttttaaacacttcataatctggactcctctgtcaggcactggtgccagcctcaagctcccatctccactccagattttacagctgcctgagtactttacctcctatcagaagtttctcagctccccaggctctaagcaaatgtagctcctgggggtactttcttcctctgctgaaggaataaattgctccttgacattgtagagcttctggcacttggagacttgtatgaaagatggctgtgcctctgcctgtctcccccaccgggctgggagctctgcagagcaggacacatgactcgtatatgtctcaggtccctgcagggccagcacctagcctcctcttggaggactcacgaatgatgctgtatattagggtgaagtacc

SEQ ID NO: 654419 - DNA, 332 bp, Homo sapiens
acagtgctgacgagcacggggctgggagagagggaaaggagagccccaccctgggggccagaccttctcccttcagtttccaagaccacaggccactgcactggcaggagggaggaggaggagaggtacagggtacttttatggtaccaggagcagaaagacgtgggcagaggtacgttgcaggggatgatgccttctgctcagccggcgacaatgtcttataccgtgacggggtcactgccacctacgggtcatcatggcgggcccctggcaggtcgtggggcttcggggtctggaagccatacttgggccaccttgtccacccctcagtc

SEQ ID NO: 654420 - DNA, 450 bp, Homo sapiens
ctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatgcgccatggtctggcagtgtgtttagcgctcaccaccatgtgcaccagcttgttgctagtgtacagcagcctcggcggccagaaggagcggcccccgcagcagcagcagcagcagcagcaacagcagcagcaggcgtcggccaccggcagctcgcagccggcggcggagagcagcacccagcagcgccccggggtccccgcgggaccgcggccactggacggatacctcggagtggcggaccacaagcccctgaaatgcactg

SEQ ID NO: 654421 - DNA, 696 bp, Homo sapiens
ggaattcggcacgagcggcacgagacacgtgtggatttgactttctacaccctgtctcccagctggtcctttctgtctcctggagagtggccaagctccggtgacctcctgggaggcctcggcccggctccttgtggtggccatcttcagaggcggccccaccacgatagagacgcagaacccatgagcgccatccccctttcgagagcagctcataccagaccctcacccccaaggggacccagcccaggatcctgacggggtggagcacgctggagctacgaccgtctgcatggcaacgcggaactcctcccagagaaagcccagagaggccccgctctaagtcagcgaacacggcttcacgtaagccctttccaagcccctaacgcaactggcacaacggtgtatgtgaagcaagccaagccccgctggtcaccacggattcaactggctctggcacttctatttgcagatattatctctgccttaaaaaaatctgtaaataagtaaggcctgtccctcgtgggtgcaactttctcttaagaccccaagactgtgccctctttgagcttgcagaactctgtgggttattgagaacaaaaaaatcaccaagtgtggtctataacaagatttcccctcgcagtggcttcaacaccggaacactgactgttcccgcgtggccacaccttggttggc

SEQ ID NO: 654422 - DNA, 182 bp, Homo sapiens
tcaggtctgcggttgatgaagacagccgttgttaccaagaagcaaaacctggcagattgtcctagcgtcaggattagttggtcattctctgcgtcttctccatgactggtgacacagggtggtcttataagattcctattccagcctctggctccccgatatttcctctggtgcatggggca

SEQ ID NO: 654423 - DNA, 954 bp, Homo sapiens
gattcctgaaactgacaaggattcgggccgagatgtctcgctccgtagtgccttagtctgtgctcgcgctactgctctctttctggcctgagaaggcttatccaacgtactccaaagattcaggttcactcacgtgatccagcagtagaatggaccgtcaaattctccttgatattgctatgtgtctagggtttcagtccatccggaaatttgaatctcgacttactgtagaatggaaagagaattgaaatagtggcgcattcaggactttgtcttaacatcgaaggactggtctttctatctcttttaactacactgaagtttcacccccactgaaagagatgagtatgcctagccgtagttagtaaccatgctgacttttgtcgatccaagcgccaaaaggataggtggagagctcggggcatccagatacagtgtccatgccaagctagtcatggacggtttgtggagaaatgccgttatgtgggcatctgggatgccattcccaatgtcctggttgtcttgcggtacaatatttgaatatgcggtatacacttatcacttttatgcccataatgttaggggtttatcaactaatggttaacttggaacttgatcttctgattaacttcttactgtgcgtgctgtctccgtgttggtgtctcctgagccggtagatcccaggtagctcaaggaagggtgggcatttacagtgggcgagaagagagtccccttttcccgcatccagctgttggggccgatttgatcttcaggtcgctgcttccaggtgttagaattaacggcgtagtgctccacgactatcgttaagtggggcatatcacttttgcgatggaggttccaggacgcgtaaaaaataccttcaaagaggggggcgggttccggaccgacagaaaatgcggggtcggcgaggagatatcgataaacgtcgactca

SEQ ID NO: 654424 - DNA, 214 bp, Homo sapiens
agtgtaagtatgtgcctgcgttcagcgcgttctggctggttgcctcatctgggtgatgatagccaatggtggggataacgtgtggtttcgcacgaagctataaaatatgattagttctgtggctgtgactgtcatcattcaggcgatttgtcgggagatacgtatagagaggtagagattttaccgcgatagatggttcctgacaacgggggta

SEQ ID NO: 654425 - DNA, 422 bp, Homo sapiens
cggatcgtagatagcccccgctgcagccaaactgcgtgctttgcagcatgtactgtgctgatcgtgtggatttgcatccctgcagaagcctcagaagctgaagcacctatttgagcagtatggggaggttgggcgcatctattgcactcctgaaggtatgctcaaaacaggcagccactacagtggttgtgcaagtgctggcatggtcatatatgtttggtaaaagggagcgtggtaaaaggagcatgaattgtgccatgcgagattgcctgaaacggggtgctgctttgcatggatactccggcatgtgtcagcagtcactagggcagcagccacacgaacccacatagacaagcaggtttgcaaacagggcagtggtgaagcatggggtacacctgaagtcgacgggccgcggtcgacgc

SEQ ID NO: 654426 - DNA, 349 bp, Homo sapiens
gatcgactgttggtattaacctcatgctcattgctggtggtgctgttggtgctgttgcttgtgctcgtgggtattggttgtttgagaagccggcgatgataatggttgctacggcttatctggttcaccttgtgtgggtgctgtttgaccttgatggtgatggcatcgtggagcaaggaaaattcgtgcgcatccttatagtcctggtgttcttgtacacacgcttcgaacgtattagaggttctctggtagacccacagaaaggctaggtgacgggcatgagtgagcaggatattctgtctatcattgtggctttgtttggtactggtggtgttggcttcacagcggt

SEQ ID NO: 654427 - DNA, 2197 bp, Homo sapiens
gagacggagcagggggagcagcagcggcagctgctggaggaggagctggcccggctgcagcgtgaggcggctgcagcacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggccgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaacgtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcaggcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcagaagaattgcttgaacccaggaggcgaagtttgcagtgagccgagatggtgccactgcactccagcctgggtgacagagtgagactctgtgtcagataaaatgaaataaattaaaaattaaaaaatccaaatctggtaaaaacttggaggtactttaagatagactactttgatatgtgcttaaagaaatactcagggtttatggcaggtttgaaaaactgaagtataaaacttccctgagatatccaatagcagagacacaacccatgtctctacggactctctgccaatgccatctgtcaaagccacggtgacagtttaatgtgtcagaggaacacaccctggggccaaaaagatgagacacctgggtt

SEQ ID NO: 654428 - DNA, 1334 bp, Homo sapiens
gagacggagcagggggagcagcagcggcagctgctggaggaggagctggcccggctgcagcgtgaggcggctgcagcacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggccgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaacgtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcaggcccggcggcaggtggaagaggccgagcggctgaagcagtcggcagaggagcaggcacaggcccgggctcaggcacaggcggctgcagagaagctgcgcaaggaggccgagcaagagcacccgcgagggatgaggcacccgcgagggatagcaccccaggataagcacccgcgagga

SEQ ID NO: 654429 - DNA, 188 bp, Homo sapiens
  misc_feature (105)..(105): n is a, c, g, or t
ttagtagagacggggtttcaccgtgttagccaggatggtctcgatctcctgacctcgtgatccacccgcctcggcctcccaaagtgctgggattacaagcgtgancaccgcgcccggccaaatttggattttcttaatgctcatcagcgaaggggtgatgcctagctggacctagattgaaagagtaa

SEQ ID NO: 654430 - DNA, 111 bp, Homo sapiens
cggaccctttgttgccagatcctccaattaataatcctccttctaggaaattacaaacattttcatctgtcttagataccaaatggaaagtctccctgacaattggctgtt

SEQ ID NO: 654431 - DNA, 174 bp, Homo sapiens
cgaggacctttcctcaggatcaaggatttcttttctttgtgccggatttgctactgcttgctcttcttactttaattatttctgtgactaccttatggcttaactcaattaaatcttcccaaggttatctctaaggaggaggaggaaaggattggaaaggccaaaacctttgtg

SEQ ID NO: 654432 - DNA, 398 bp, Homo sapiens
tcccttctataggctccattcttatgtaagtcatgtacttagcaatctcagcacgtcctgtgcaagtcatgtagtctgagtgtgctcttgtagtgattcacaaagtcactgtaggccttgtatctgcacctttgaggtccatacagatgtccacagtgcaatctatctggctagcagatgcgatccacatgatttgaccggtcagtctcgttgtcattcttcgacatcgatgcaattcaacatggggagtcacgggtgtttttccggtatctttggtagcgatggatcttgcgcctggacttcgtgagagtcatgtcccccgaggataccgccgatcggtgaatcttcatcaggatcgtatgccacggactgccccaacccatacggcagcacctggt

SEQ ID NO: 654433 - DNA, 1165 bp, Homo sapiens
  misc_feature (670)..(670): n is a, c, g, or t
gagacttccttataagtataaatacttctgctctataaagacatatgtcaagaggaatgagaagtagaatccatcacgtctcgggagataaatacttgccatattgagacacctgataaagtaactgtttgacacacaatatgcaagaggaactcttaatggacgtcaacagctacatggaacaactaagcctgagttataagacacgtagggcaaatagagtcgtgagcaagtcgagctcgctcttgatatattttgctaatgaatccctttaaaatggtcagactagttacaggaagacgaatcttgatctatagaaacgtgggcttaaaagtctgaacgagtcacgcttcgccatccgagatgaatattaccaaattgagacattgtatatctacgcagtcgatcgattgttcatcataaggagagattcatactatctagcacatcgaagaatcgatgatacgcacatacaaccaatctattttaccagcgtaagccacatagatagcaacagacgttaaacatccacgcaaacatggcctgggccgacagggacttgtagacctcgatagctatggagaccttccattgtgtactcgacttggtgggaaaaattgcgatcaagagagtgcggcggacggaattttgggaaaagacctcgtggtcntacatactagtctaggtcaagttgtactatgagcgattgaaaacttataaatctatcacctcctttaaagacaattggttgaatcccaggcgagttctattaacccccttgggtgagtagttacccttacccttgtacattttggggccttgtttcctcgttcacatctgtcaccagattctctgggcgttacacgattgcgttaatccgggcggaaggttgacttctttggaactctggcccaggaagttgggtcaaccctagcattaagaattgtgccgtcgaaaggtaacacatggaggtgggctgacactttcaaacacggcccctggggaattctcgggacacactggcagaattctttcacgagcgtacaggacaggaatatttgcgcgtaccacgggcagggaggaacgaaccactgggaggggacattgtgaacacgcatattactttaatcggaagaaacccaacttcgaaagaagggctgtcacc

SEQ ID NO: 654434 - DNA, 175 bp, Homo sapiens
tggtatgaaatagaatttggtacagaaacagggtggtgtacctcgattgtcccacattggctcctaggagtaagacccgtggaccaacagccccagcaagagcataagaggaagagagagaccctcactgctggggagtccctgccatactcagtcccccaccacactgaatctc

SEQ ID NO: 654435 - DNA, 126 bp, Homo sapiens
gcctggtttggtgactgctggctctgtcacctcgatccaactggctgtgacccatgccggctcgttggattgtcggcaatgttgacagagactgtactgtccgtttttgtcccttttttatttttt

SEQ ID NO: 654436 - DNA, 114 bp, Homo sapiens
cacagtgtgaccagaacaggtgttggttgatatacgaccgcaggacaggccactggagttggggcctctggagttggacaggcctctggagttggacaggcctctggagttggg

SEQ ID NO: 654437 - DNA, 837 bp, Homo sapiens
agcgggggtgtgtgtgcgttcgccctctgctccgcttctggcgggtgctcactgtgcctcctacggtccagcatggagcctgctgcactccggccggcgtcctcccgcgggatcgccggcgacttgcacccgggcctcgccgtcgtcgtgcgctctgccctggagtccagtgcctggtggcatccagtgtggaaatgggacgctccaggatcccattctgggacgtcacgtgaagacctgttacatgagggacaccaactagtcaacagaacgatgagtctgggagcttgtgtgtcgctaccgggatgactcacggcaacagccttaccctgctggctaggcgtccggcaagggcaggaggccgcagattgccgcgaagaaaatttggacaacggaatacctgcccattggagggacctaggtgaatttctgcaacggcatctggcaggaactagccctgaggtgagaacagcgacagtcttgaatgagctggccggtctgtcactagtgcgagaccatttcgtgcgaactgggcacgccgttacaggcatcgcggaggcccagtattgactggcgagagggatctttgtaacgttcgaagccggagattgtctgttcgtggccctgagacgaagctgggggagaaacgaatgaccattttccaggggatgctggcaattgccgggttacgaaggtcaatccggggattcatgtaccgccaatgacttgccgggttttgcctttcccaggccgcttgaggaacgatagtttcgcacatgtaactcgaaccacagagtgtgctagtgctggtttgcttctgtccagataccacgggga

SEQ ID NO: 654438 - DNA, 892 bp, Homo sapiens
  misc_feature (114)..(114): n is a, c, g, or t
acgagtaaggattgtaatatatcacggaacaaattttggggagtgcaccagacacgcatagggggttgtcaatattagccgccccaatgtacgcccctgcaccaaaggtgtgcnaactattgttgagccagacaggtgtaagtgacggcagctttgtcgtgtgtaacaacagtacatggagcaaaaggggttctcctccaccttgtgaggcaaatatatacgccgcctccgttcagtaattcagcgggtgtccagtgttcgcccacacaaggtgtcctgcccccacttgatcacggtcaggctgtgcgcttcgaacaccttgttttttcaggacagcttgcttcccacagagaacaatgcagcgacggccacgggcgtttataccctggcaaataaattattaggcccctgtgccagaccacattatgcaaacaatcacggaagtgctgtcctccaaaaagggcggaacattcttctggtgcttacaccctttttataaagagattggttattcattagggcacggctaccaccacacagttgtgctttatgaacgcgggaccatgacaaacatccgacgcggtgcaactaagtccaccgtcccccaacatcgtggctttctaaagtacgcgctgttccgcgagatgggcgggttacaagcccgcggagtcctgtccccacgtattataaggttgtcaatcacgcgtgcccgtgtaccacagaagacaacaattttgcttttctttgtacgtactgctgtatcatagatcttgcggtcacgccagcgtcaaaccattggcttgctaagccgcccaacgggtgctgcccgagaccgccgcacccccacgtggggcaattgtcttcccccaaacaaaaagacccccccccaaac

SEQ ID NO: 654439 - DNA, 300 bp, Homo sapiens
  misc_feature (220)..(220): n is a, c, g, or t
tcggtcggtactccatgggtgaaggtctaacacggcctgtaaaaaccctctcagaggcttgatggtggatgaggtggccaacaatgggagaatttggggagatccttagggtctttagcaggttcgggaaggggaggtggctgggtaagggatggtaggagagagagagagagaatcctctaaggacgcccagccagagcctttccccttcctgggttgnggcaccaaaatgaaggttagccaagagaaaggatgagagtacaatctgccggtggagtacaacctgccggtggagtacaa

SEQ ID NO: 654440 - DNA, 143 bp, Homo sapiens
actttcttgcgcgatggctgtcttccacgctgcgctcacttgccgatggattgctccggcaaaaaacccttatctggatagggttagtcgagccggcgcagtccaatggtgggaaaattccgcagcctgactcgacaaaaggg

SEQ ID NO: 654441 - DNA, 1123 bp, Homo sapiens
gatgactcgttgtctggcacgtgtgcggtgatcacctgccgtcctccgactatcacggtcctacacggcacactgaatcgccctgtatccaccggcgacacttatgtcgcgctgctcgcaagaggtccggagcatctgtcatgcggccggacggccatcaccgccacttggggtctgcgcatcagtgccacctctcaaatcgggtttagatgctaaagagatggcgtgtagttacacgagcaagacaatttcagggccacgctgtatcggcaaggttgaaaaaccgcatgcaagtacgctaccatgtcgtacattacacctagcataacgccttcgtatgccgaatcgaatactggaacgtgcaaacactgtacgcgtacaagatgaatcgttccatgaatccacagtacgtctgtcggttgggggaactgttacgtgagtttgtgctccatcgactgaagcctgggcatcgggggtctgctcttgtaattccgtgctggcggcaagactgattcccctgcgaaggaagatctcgtcatggcaataacgtcggcatttggttctatccctcagagacatactcgacttgacgtgtcatcggaagccaatgggtgggcccaataggtcttgtgtttgggatagacttgggttatacttcatggagaggcagtacagtttcgatgtcttccttgcagcactattagcactccaggctggaaccacaggaccattggcccttaaggaaagcgaggaatgcaagtggtgctagctccgacggttccttgccctccttccgtggtcgagtggcgcatgttccttccgttagatccgcaacgacagggcgaatgaccagctctaggaccagccattgtccaactattccaacatatcaatgtcacttggaccaatagcccagtgatgtgaccacctttgagcagacaaatgtggaacaatggatgagaccctcagcgaatctgacgccatgtgcattgcatcaaatgagactggtccaacattggcattcctgtgtaacaaagggtgcagtacttgggttccctcttttcccacaattgtatctagactcgttccctctcgaggcgtaaccgacaccagactctcctgc

SEQ ID NO: 654442 - DNA, 191 bp, Homo sapiens
aagcgacatgcggcaagctaacatgcggggtctttgcctcccaccctgtctcacagctttattgcccatgccattcgccactgctaccagcctgtgggaggaggaggaagcccgtccgacttctacctgtgctccctgctggccagcggcacagcggccctggcctgcgtcttcctgggggtcaccgtgga

SEQ ID NO: 654443 - DNA, 693 bp, Homo sapiens
  misc_feature (53)..(53): n is a, c, g, or t
  misc_feature (457)..(457): n is a, c, g, or t
  misc_feature (681)..(681): n is a, c, g, or t
tgtgatctccgtgctggcacaaggatctcaggtgctagagtccacgccacccncacatgtgatgagaggtgaaaatgaccacatttcatcatttatctaccaaaaagccaaaagaacatttggttcatttttgactaaaaacctggaaaaatcctcaaccctgtttttgggcccaaaattaggaattggaggcaacggcaaactttttgggggccaaaaaaacccacaatgggaaacataaaccctttttttgggaaaagggggttttttttcaaagggggaacctaaaaagggaaagcggtgggggacaatccccgggcacagggtttagaaaatttttttttttggggccaccaaggtaaataaacaaataaagggggggacctttttgaaaaaaaaaaagagggctttcaccccccgctaaaaagaagctttttttttgtttatttaaaagggnggggaaaaaaaaacccccccatggggtttttttggagacataaacacccccaaaaaaagtttttcttaaagaccgccggttataggcgcgtttttcgggcacaacaaatatccttttttaaggaaacccaggagcgcccttaaaacccaccccattatgtagggggggttctatcatcaccaggtctacgacacagcgatttgtgttggacggacttcctgttngttggccacgtg

SEQ ID NO: 654444 - DNA, 210 bp, Homo sapiens
tcatgctcaggtctacttagagggtttatttttatttgagacaggctcttgctctgttgcccaggctgtatgtagtccaatagcacaatcaggtctcactgcagcctccaataaactcctggcctcaaatgatctgcttgccttggcctcccaaagtgctgggattacaggtgtgagccattgcacttagggagacctgagcaagccagg

SEQ ID NO: 654445 - DNA, 129 bp, Homo sapiens
aggatctttggaacggcggttctggcacatgaactcattggtcgtacaagtgctgttgtacaacgcaaccagctgcgatgctctcgtatgcaccatcagcacagtcttatgtcgccgtcccaaagcaca

SEQ ID NO: 654446 - DNA, 673 bp, Homo sapiens
  misc_feature (62)..(62): n is a, c, g, or t
tgcaggaattcggcacgaggggaaatctaaaatgtctctgaaagagattgtggatcatctanaaaagttatattgttcctcttatggggtacaatacacacatattccatctaagcaaaagtgtgattggttaagagagagaattgagattcctgaaccttaccaatatacagtggaccaaaagagacaaatcttagatagattaacatgggccacttcttttgagtcattcttatctacaaaatttccaaatgataagaggttcggtttagaaggtttggaaagtgttgttccaggtattaaaactttggttgatcgttctgttgaattgggtgtagaagatattgttttgggtatggctcaccgtggtagattgaacgttttatccaatgtggtccgtaaaccaaatgaatctattttttctgaatttaagggttcgagcgctcgcgatgatattgaaggatcgggtgatgtcaagtaccatttgggtatgaactaccaaagaccaactacgtctggtaagtacgtcaatttatcgctggtggcaaatccttctcatttagaatcccaagatccagttgttcttggtagaactagagctttattgcatgccaagaacgatttgaaggaaaaaacaaaggccttaggtgtgttattacatggtgatgctgct

SEQ ID NO: 654447 - DNA, 322 bp, Homo sapiens
caacccatccctttctaaaccttacagtagcatttacccaagaccgtgttctccttaactaaatgactcatttatccagtttcatgtacactttgcaacgcaattcacaattgtcatagacacatgaaatctacatttaccttttaaagtttaatcaggtaaacccaatattttcttggtaataaccgtgtgtgatatatagtaagcccaaggccagtgtagagaaaaagctataggcaaaattacgtgttttttaaaaacactttcctactcaggaatatatttagcattttgtacactcggtgatatgttatatgtgtca

SEQ ID NO: 654448 - DNA, 755 bp, Homo sapiens
  misc_feature (50)..(50): n is a, c, g, or t
  misc_feature (81)..(81): n is a, c, g, or t
  misc_feature (87)..(87): n is a, c, g, or t
  misc_feature (91)..(91): n is a, c, g, or t
  misc_feature (98)..(99): n is a, c, g, or t
  misc_feature (102)..(102): n is a, c, g, or t
  misc_feature (106)..(106): n is a, c, g, or t
  misc_feature (120)..(121): n is a, c, g, or t
  misc_feature (125)..(125): n is a, c, g, or t
  misc_feature (128)..(128): n is a, c, g, or t
  misc_feature (140)..(140): n is a, c, g, or t
  misc_feature (145)..(145): n is a, c, g, or t
  misc_feature (148)..(148): n is a, c, g, or t
  misc_feature (159)..(159): n is a, c, g, or t
  misc_feature (166)..(166): n is a, c, g, or t
  misc_feature (189)..(189): n is a, c, g, or t
  misc_feature (227)..(227): n is a, c, g, or t
  misc_feature (238)..(238): n is a, c, g, or t
  misc_feature (249)..(249): n is a, c, g, or t
  misc_feature (252)..(252): n is a, c, g, or t
  misc_feature (255)..(255): n is a, c, g, or t
  misc_feature (273)..(273): n is a, c, g, or t
  misc_feature (329)..(330): n is a, c, g, or t
  misc_feature (365)..(365): n is a, c, g, or t
  misc_feature (380)..(381): n is a, c, g, or t
  misc_feature (383)..(383): n is a, c, g, or t
  misc_feature (385)..(386): n is a, c, g, or t
  misc_feature (424)..(424): n is a, c, g, or t
  misc_feature (455)..(455): n is a, c, g, or t
  misc_feature (503)..(503): n is a, c, g, or t
  misc_feature (505)..(505): n is a, c, g, or t
  misc_feature (542)..(542): n is a, c, g, or t
  misc_feature (635)..(635): n is a, c, g, or t
  misc_feature (638)..(638): n is a, c, g, or t
  misc_feature (683)..(683): n is a, c, g, or t
  misc_feature (687)..(687): n is a, c, g, or t
  misc_feature (692)..(692): n is a, c, g, or t
  misc_feature (727)..(727): n is a, c, g, or t
aaccacaaggggacactctagctaaggttatagatagcggggagaaaagngaggaaccgcagaggaaggaaaaggcaaganatttanaaanaaaaatnnaanaaanaaaaatgaaaattnnaaanaanccgcatacaaanagaantcnagggggtaaancgccggnagcctaaaggggcgatgagtggncccagatgtccacggcacggggcgggcggaggcaaggncggggaaacanacgatgggcantanganactgcgcatgtacaagancaactactgggggcggcggccccgtgcgtatgtgtcaggctgttcgttctggaatnncgaggggtggtctttacataatattctgtggctgncggacccccaaaaannanannttatcgaaaagatgagggcgacgatgagaccgtagtcnccgagcacctcggcgaagatgagaatcaggntcatgcccacgaatagtcggggctgctgggcggtgccccgcacgccancntcccccacgatgccgatggcaaagccggctgccaggncgctcaggcccacgctcaggccggcgcccagctggaggaagctcttgtagaggctgatgtcgtcattcagggagttggcgatgaggactgccnccnccaggccgtagatggcgatgatgccagccatgaccactgggatgntggncttcntgatctgctccggccgcatgacagacatggccgcnatgccggtaccgctcttggctgtgcata

SEQ ID NO: 654449 - DNA, 233 bp, Homo sapiens
aatgggaagaatggtagggattggttcaacattagggtacttcgagcgctaaagcttcgtggtcgtataaatttagatcattaggattgattatatacacatagatcttcaggactttacctttagtaaaagtaaaattccttttagccatctttagttcttgtaatcccaactagattggctttatgctcacatcattgtcccatacccacccaatttctcatcctagggaa

SEQ ID NO: 654450 - DNA, 586 bp, Homo sapiens
ttattattgtacaccgtgaaggtgaggttaattaagtcctgttgtggggtatgagggccagattctaatttttggagttttatttaatgtcgggagcagattgggtaataaagtgtatattgagaataagatggccttttgaccatttagggtctagggctgtaaagtgtctcagggttgctgccgaacgagccatgaactgttctgggtttttatatttgatgaaaaagagcctaaacgcttctgatttgggataaagaaaaaggagcattaaccttgactatgcctttggctccagccacctttttaagagtaaattgctgagcaggtgggggagggctagtcacggaacataactgcaagcaggaccaggtgtgaggaggggaggcgataaaaagattacagggtggaggagcagaggctgaggaagaattgggacctatcttggcctggtgaggaggggagaggtcacatgggtcttgttgaaaaggggagatttgaaagactcagtggacgccctcgttgcccgaaatttctttttgggggggggccccccccttttttctctttaaaaaaaggggggggg

SEQ ID NO: 654451 - DNA, 92 bp, Homo sapiens
ggggtttccaggccccttttttttgggggcaaaaaaacataaaaccaaattgaaatatttaaataaaacaaaaaaaaaccaattaatttgga

SEQ ID NO: 654452 - DNA, 102 bp, Homo sapiens
  misc_feature (28)..(28): n is a, c, g, or t
tttcttgcatcatgtcagaaattcaggnaagtcaatagtgccattaccatcagcatctacttcataaatcatgtcctgtaactccccgttctgtcgtcttct

SEQ ID NO: 654453 - DNA, 303 bp, Homo sapiens
  misc_feature (4)..(4): n is a, c, g, or t
  misc_feature (35)..(35): n is a, c, g, or t
aatntttaagtagagatggggtttcacgatgttgncccaggctggtgtcgaactcctgacctcgtgattcgcccgcctcgtcctccctaagtgctggaattataggcgtgagccacgtgcccggccacagttattttattttataactttaaaatagagatgaggtcttgctatgttgtctgggctgttctccagctggcttcaggcgatcctcctgcctcagcctcccagaatgcttggattataggcgtgaacaaccatttccaccaaaggctgtttttttaaatttttgcaccattctct

SEQ ID NO: 654454 - DNA, 146 bp, Homo sapiens
  misc_feature (4)..(4): n is a, c, g, or t
  misc_feature (95)..(95): n is a, c, g, or t
gagntgcagctgataagagcagacgatgatagcgtgttagaaccatcacacgtcaagaccacttggctcaaataagggatgaggaaatctacaangaaatggaaatcagaaaaaagcaggagtcacaatcctagtttttgacaaaa

SEQ ID NO: 654455 - DNA, 447 bp, Homo sapiens
tgagcgggccgggccatgtggactgttggctgattggcgcctctccccgtatctaatgatttgtgccttgtgcttccctgggtgacgtgcctttgcttgggtgtggaacggtgatatttgggtgttttggaaaccttgttcggggttgttcctctccttcttgagcatcatcgtgactttctgtgtgcttggtgtatttcacactgaggactaatctgctatcttcattccagtccctacccctcagggcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtctggccagcgtcctcctccacaggctgtcactgccccctccccagcctgtgtcca

SEQ ID NO: 654456 - DNA, 1019 bp, Homo sapiens
tgttgcatgcacggcctcctttggttggaggtgagagaagcacattctcccgcgggtggtccttcactggggaattttctctctgggtgcgaatttgctccgctgtttttcttcgtagctgtgttgttgccgccgcaaacacttggggggtggctttctcgtctctctcttgttgtgtttgtttcgttctcgtcctttgttttgccccacgcaccagcagtggttgtcgctcccccacatcacatgtttgtctggcgcgcgcgctcctgttctagtttatacacaagtccgctccctctcttatttttcttgcgtgtgccggcgcggcaccaggaaatcttttttcaactctgtacagaaaacggaaggactgtcgtgtaagtgttactagatcatgggttggactgacaaagacacacttcatcgtttgtttggggatagtcactccacagagtagtactttctcccccgccgatcaaagcgattgttgtggggggtgccgctccatcactggatctgtcctctctcttggcggagctttttctttttctattgatattggatagtctcgttgttggtttttttcttcaccacaacggacacacaaacagcagggtggtgtctctcacaaccccggctattgttggagcagcacccctcgctacagatagttttgccctcgtgccttattatctggggtcgcgttgttaaatagaacagaaaatctgctgcggcgggtggtggttgcgcccaccatatgcctctagctaacacaccggcgtcttttataatgaggccatggtgggggggttttctaaaccatacaggggcgttttataccacacctcctcggggggtcatcactgcccccccccctccttgtcccaaaaggggcgcccccctttttttttttttttttttttttttttttttttttttttttttttttttttttttgtgtgtgcccattttgttatcacatccctatgaagttgaaaaattaagttaattttgaccca

SEQ ID NO: 654457 - DNA, 242 bp, Homo sapiens
ctttcccgtatacagataggaaccatcatgcagcgtgtcagcctcttcctcccctgacatgctgggagagggcatacaagcccatctccctgacgacattgaacaggggtcccaccctgccggccggggaaggggactatgttatcatctgcccatgagtccaaattctttgattctacattatccctcaactttcttcatatcattcctattcctcttaacttctaaaacagtcgttttgt

SEQ ID NO: 654458 - DNA, 473 bp, Homo sapiens
ttttttaggaacttctatactgttctccatagtggctatattaatttatattcccaccaacagtgttcagagattcctctttgttcccatccttgctagttattgcctgtcttttttgatataagccattttaactagggcaagatgatatttcattgtagttttctctgattagtgatgatcattttttcatatgcctgtttgtcatttgcacgtcttcttttgagaaatgtctattcagatctctggtgcattttacaatagaattttttttttttttttgctattgatttgttgaagcttcttatatattctaattattaattcctgtcagatggatactttgcaaatatttctcccattctgtggtttgttcattttgttgattgtttcctgtgcagttttttagcttgctgtaatcccatttgtctatttttgtagctaatattgcctgtggtttagaggtattaccc

SEQ ID NO: 654459 - DNA, 217 bp, Homo sapiens
cgactctccaggattccggctatcacattatctacagcaaataggctggggtagtatctgaaggaaaggccaacttttaaaaaccatttagtatgtgggggggtgctaatcataaatatttgcacggtaaccagaaacaaacaaccagcttatacaaacaaggcaccaaaatatgctactgctaataatcctttattcaatttagctcaacacacaa

SEQ ID NO: 654460 - DNA, 395 bp, Homo sapiens
acaaatcaagataatcaaaccaccacaagtaaaaagataataagaaacataaagcagttatcacgtacaaggtcagtggaaaagatgtccaatgaagaaatgactggtagtatactcttattatccccccacccccttaatcagacattaaaagtgcttaaccccttaacacttgttattaaatacttgcaagcatttagagatggtcttaacagggaagagagagggtgggggaacaaaatgtattatacataaagattttccacagatgctatagtactattgacaaactgggttagagaaggagtgtaccgctgtgctgtaggcacaaacaccttcagggactggagctgctttaatccttggaagagtattcccagttgaagctgaaaagt

SEQ ID NO: 654461 - DNA, 166 bp, Homo sapiens
gaatgaatatcccagtgctctgtgaaacaaccccgattaatatcagtgtcttaatttgtacacccccagaacagagtgtgtaggtgtgagaacaagtacttcagttcaagagtgtatttaggaggtaatccaggaagcagaaatgggaatgagcaaaaaaggaaga

SEQ ID NO: 654462 - DNA, 146 bp, Homo sapiens
  misc_feature (5)..(5): n is a, c, g, or t
ggtantaaagagtgagttgcctgcaagtaaagaattgagagtgtgtcgcaaagcttattttcttttatctgggcaagaattaaaacacattccttggaacagagctattacttgtcctgttctgtggcagaaacttttctttttga

SEQ ID NO: 654463 - DNA, 405 bp, Homo sapiens
ccgccccgcccaacccctcctcccagtgctgaagtcccaaggagccgccctgcaggccgaaagaatgagggtcgtgatcaactcagtatgccactggaggctatatgagtaaacagcaaaccgtttctcatgaaagcaggatgttggcaaactgacaaactgcgtctgccacccagaaggaatgctgaaggcagtcacgacccaggcacaagtgtttcttgtgattaggcataattgaagcctgttaacaataatgtgaacttgtgatcaattaagcagctgaccagtcgttacctcctcctccctttcatcctacccaataaatgtggagggctgtggaagctcaggggctgcctttgctcactagaagcagggagctctcttcttccccagttcgccttcttt

SEQ ID NO: 654464 - DNA, 206 bp, Homo sapiens
  misc_feature (54)..(54): n is a, c, g, or t
gtagatggcctgtcccactctgggaaggaggtggaaggagacaggagagaggtnagacagagaacgaggggctgggagacctggaagcctgagagaccctcactccctaacacacacacacacaggacacacacacacacacacacacacacacacacactcagaatatatgtctggagacttgcgcacatatacacagcgagcgt

SEQ ID NO: 654465 - DNA, 159 bp, Homo sapiens
tggtaataatataacttgttgggaccgacttacggttttagcactggagtaggcttaggttatgtacgtagtctaggccatatgtgttggagattgagactagtagggctaggcccaccgcgtgcttcgcaggcggcaaaagactagtatggcaatagg

SEQ ID NO: 654466 - DNA, 235 bp, Homo sapiens
gggcaaggggtgagggcaggtgaaatcaacaaaatatgtttatattttgtgtattttatttggctacctttccagaaggcctcccttactgaactttccctccgttcctttgggttaatttgcccatcctgggtccttgagatgtgtgcttacctaatttaatttcaattggtttcctaatatattcagggctatatgtattcttctaaatagtcctttgactgttccccacttt

SEQ ID NO: 654467 - DNA, 269 bp, Homo sapiens
ggggattttgcagttggtggggtctcaataaaagttattttccactgaaaaaaaaaaaaaaaaaaaaaaaaaaaaaaaaaaaaaaaaaaaaaaaaaaaaaaaaaaaaaccaaaaaaaaaaaaaaaaaaaaaccatgccgcccccctcgccccaaccaactctaaacccaaccaacctaatccatccgccccaaatccaaccccactggcccaatccccccaaaaggaagccgaataccaatcaacggcccgccgttaaacaacgccgga

SEQ ID NO: 654468 - DNA, 441 bp, Homo sapiens
tgagagtctcactttgtcattgaggctggagtgtagtggcacaatctcctcactgaaacctccacctcctgggctcaagcaattctcccacctcagcctcttaagtagctgggaccacaggcgtctcaccacgcccagctaattgttctatgttttatagagatggggtttcgccatgatgcgcagtctggtcttgaactcctggcctcaagtgatccgcccacctcggcctcccaaaacgagattacaggcgtgacatctcgtgcccagcctcagacataccactttttatactgtattttcactttttttttttttttttgagacggagtctcgctctgtcgcccaggctggagtgcaacgatgcgatctcggctcactgaaagctccgcctccaggtttcacaccattctcctgcctcagcctcctgagtagctgggt

SEQ ID NO: 654469 - DNA, 190 bp, Homo sapiens
cccccccgggggggaatttgggccccccccccgggggccaagggatttttttggggttttttttcccccggggggggtgggcccccccctttcccccccccccctttggggccggggtccccccctttcgggttttggggggccccccccctgttccttccccccccccccctccccccccccttgggga

SEQ ID NO: 654470 - DNA, 235 bp, Homo sapiens
tggacgaggcttgccgtgcttgatttgtgccgttggagcggggcttgggctggtcccgaggccggctggatcgggcttcttgggtgttgctgtgcggcgccgtggggaactgtggctggtgatatgggcgcctagcctgttgctgggttgcctgtgtggcctccgtgccatgttccgctggggctagcgtgacctgtggctgtgccgaacggcgaggacctcaattgatgaccct

SEQ ID NO: 654471 - DNA, 451 bp, Homo sapiens
cttgctgaatcctatcacggtcccggttgagcagccatacttgggccgtgtggcccaggggggtctatggtccagatggggtggtcctgagagcagggtctacacagcatctgactcactatgtggccggggcacgtccctgggcatctctgtgcctcagcttcccagttgtacaaggaggtggggtaagataagatcagtattttttctttcttcttctttttaatatctaaggagagggggtctcggccaggcacagtagctcaggcttgtaatcccagcgattgggaatgtgggggcgggaagatcacttgaggtcaggtgtccgagaccagccgggccaagatggtgaaacctcatttccattagaaatacaaaaaattagcggggtgtggtggcgcatgcttgaagtcccagctactcgggaggcaagggcatgagaatggcttga

SEQ ID NO: 654472 - DNA, 133 bp, Homo sapiens
ccgccctcgcccctgtgacgattcccgtctggcgtccctaacagggacaggtgtcagacatttcttgtggcgcttctcgaacggttgcttgcggatgttgcaatagtctcggcggatgacaatggtcctctgc

SEQ ID NO: 654473 - DNA, 954 bp, Homo sapiens
  misc_feature (188)..(188): n is a, c, g, or t
  misc_feature (190)..(190): n is a, c, g, or t
  misc_feature (199)..(200): n is a, c, g, or t
  misc_feature (275)..(276): n is a, c, g, or t
  misc_feature (298)..(298): n is a, c, g, or t
  misc_feature (301)..(301): n is a, c, g, or t
  misc_feature (382)..(382): n is a, c, g, or t
  misc_feature (442)..(442): n is a, c, g, or t
gagccgagcggagtggactcgaggcctgtagcctggactgggcccctcgccccctcctccagcggctgcgggccttggcagcgccgccctgcccacactgaccccgtgtggcggggccgctccgcgcccccgggccgctctgtaatggtagggcagcctcagccccgagatgacgtcgggtctccgcngncccgggttnnttgtagtgaaccatcctggccccgcgtaatcgtaggaactatcctggccccgcgtaatcgtagtggtcttgcgcnngtgccctggcccccaccagacnggnactcccctgccccaatttggcggccgaagagtctcctcgccccagagtcatcttcgggacgcccagggcccgggtgatttntgggctctgccgcggccccgggtgattgtttcatctccgtggcccgcggtggtcgtagcngtctccgagacctgcggactcccgtagggtccccgtggccccgagatttgtagtcgggacaccccgtgccgcgtagtgatcgtcgggtctagcatgcagcccggggtcgcatgacgcggatccggccttacgggcctaacttcagggaacgccctgcaatgtgccgtcaggtctagcattaacaattcatggcacccgatgcggaaggatcggcggtcatggacggaagcatgccccgaggtgcctcaggggaagagaccgccgagtatagacaatggtgtaacaaatgtaccttccagacaccgagtatcacctgtctcacctggccaatgtaattctcccggtgaccatgggcaacccggtgcgagataggggacattaaccggatgtgggacaagagaaaaggcgaaacaaaactgccatttggcaatccaactcaaagggaatacaaaggaacatacatagccagtcaatcaatggcataacaagccttgcaatgaatgttggactac

SEQ ID NO: 654474 - DNA, 476 bp, Homo sapiens
  misc_feature (68)..(68): n is a, c, g, or t
  misc_feature (136)..(136): n is a, c, g, or t
atgtcaaatcctggtttagatcaaatatatttcaagctatattagcaggaggttatctgtgcaggggnctggcatcatgtatttaggggcaagtaataatggaatgctactaagatactccatattcttccccgantcacacagacagtttctgacaggcgcaactcctccattttcctcccgcaggtgagaaccctgtggagatgagtcagtgccatgactgagaaggaaccgacccctagttgagagcaccttgcagttccccgagaactttctgaatcacagtctcattttgacagcatggaatgtgcctcttgaagcatagctttttaaatatctttttccttctactcctacctctgactctaagaaatctcttttttgggatcgcttgaaccccggaggcggagggtgcagtaaaccaaggtcaagcccctgcactctagcctgggtgacagagcgagactccatctcca

SEQ ID NO: 654475 - DNA, 109 bp, Homo sapiens
caggtggtgggcatccactatagtcactccaggtcatggagaggttcttctgactattagagactttgcgcttcgaagcgaatgtttctcaaatcatgaaaattattaa

SEQ ID NO: 654476 - DNA, 547 bp, Homo sapiens
  misc_feature (135)..(135): n is a, c, g, or t
  misc_feature (208)..(208): n is a, c, g, or t
attatgcgtaacaccttcggccaggtcctggagcgtggtgtgaagctgcccgacctgcaccagcgtttagccccactcctggatattagctcaaccttccacaagactacccagaccctggcccaaaaaaagtgntgggagaacatccgttcccggatttgcgtggggctggtggtggttggtgtcccgctcatcatcctgattgtgntgctggttgtctttcccccccagagcagtgacaccagtagtgccccacggacccaggatgcaggcattgcctcagggcctgggaactgaccccgctggtcctgaaggaaaagcccaatggctgcattggccgattttggtttccagaggaccctggtgtttgctctcccttgaccccccccagtgagtgccaaagggcagccccaacatgtgcccccctgcttttcctgtcatgccccagactggcccttgagggcaccccgctgtactggccatgttgggccccccccccctggagctcagtaaaaactgctgtttgattaaaagctggtttctgtga

SEQ ID NO: 654477 - DNA, 119 bp, Homo sapiens
tggttgctccaggcggaaattaggagagtgggctgttctaagtggtccacatgaaggcaggtcagtgcgggactccccgtggcaatgcacttctgtacgcggaaatgagtgagagtggg

SEQ ID NO: 654478 - DNA, 212 bp, Homo sapiens
aagtatttcccaatttggcattaagagatataaatctgtgggtctagtattttttaattgagttttctcactctctctcatatatgtgtatatatatatgtgcacacctgcccaattttctattcagttgttgacaattaaaattctccatttacacaggtaatatgtgttccttcccaaattctgttaaccaccccttctgtcgtcttctc

SEQ ID NO: 654479 - DNA, 100 bp, Homo sapiens
ataaatatatttctggtggcatcagaaaaaatcaagaagcttccttgtagaagtggccagcacagaatttgaatgcagactctagtacttagaatccagg

SEQ ID NO: 654480 - DNA, 346 bp, Homo sapiens
tgtcgctggtggtctggcatccattcttcctttactcctgcagccggtttatcaagttgtaaatcttcacttgttgaattcacaagttcatgtctgtagtcccagctactagggaggctgaggcggcaggatcgcttaaacctgagaggtggaggttgcagtgagccatgatcacgctgctgcactccagcctgggtgacaaagcaagactctgcgcgtggtggtgcacacctgtagtcctagctactctggaggttgaggcaggagaatcgcttgaacctgggaggcggaggttgcggtgagccgagattgcgccattgcactccagccagaaccacaaatatcg

SEQ ID NO: 654481 - DNA, 389 bp, Homo sapiens
  misc_feature (9)..(9): n is a, c, g, or t
  misc_feature (17)..(17): n is a, c, g, or t
  misc_feature (67)..(67): n is a, c, g, or t
  misc_feature (260)..(260): n is a, c, g, or t
  misc_feature (385)..(385): n is a, c, g, or t
actggtcancaatccancatgtcccaggtcctaaatgacccccggggtactccccccgacaccccanggcaattgccccttttggggccttggcaattagaagttcccttctatgtgctggtctctttccccagatgccttgaattgctcttttaaatgtatgctcaatgaacctttcacaatatgccatgactttacataattgaaaatttcttgatttatttttgttttaaatgtatgtgttttgcctctatggatgnatacgcctctgtgtatgtatatatgtgcacaacacgggtgcttggtgctcttagaggtcaaaggaacgtatctgatctgctgaaattagtggttaattattgattgatatgaatgattgtgacancacc

SEQ ID NO: 654482 - DNA, 394 bp, Homo sapiens
  misc_feature (154)..(154): n is a, c, g, or t
acaaattgatgaattttccaggtgcaagccagtctgagaggctatgttccttataaatggttaacttaaggaggtaccagtgaggccagcatttgagaaccacaatcctttggcccggtatggtggctcatgcctgtgatcccggcactgtggnaggccaaggcgggtggatcacttgagcccaggagtttgagaccggcccggccggcatggtgaagccctgtctctactgaaaatacagggattatccgggtgtgtggtgcacacctgtggtcccggctactgggaaggccgaggcaggagaatcgcttgaacccgggaggtggaggttgcagtgagcccagattgaaccagtgtactccagcctgggcaacagagtgagactccgtctcaa

SEQ ID NO: 654483 - DNA, 194 bp, Homo sapiens
  misc_feature (71)..(71): n is a, c, g, or t
caagttggtaggactacagatgtgcaccaccatgcccagctaaatttattttttgtagagacggagctcanctatgttgcccaggctggtctttactcctgggctcaagtgatcacctcccttggcctcccaaagtgccgggattacaggcatgagtcaccatgcccagccaataattaagagacttcaaaaac

SEQ ID NO: 654484 - DNA, 846 bp, Homo sapiens
  misc_feature (143)..(143): n is a, c, g, or t
  misc_feature (151)..(151): n is a, c, g, or t
  misc_feature (238)..(238): n is a, c, g, or t
  misc_feature (351)..(351): n is a, c, g, or t
  misc_feature (353)..(353): n is a, c, g, or t
  misc_feature (386)..(387): n is a, c, g, or t
  misc_feature (410)..(410): n is a, c, g, or t
  misc_feature (413)..(413): n is a, c, g, or t
  misc_feature (415)..(415): n is a, c, g, or t
  misc_feature (418)..(418): n is a, c, g, or t
  misc_feature (420)..(420): n is a, c, g, or t
  misc_feature (455)..(455): n is a, c, g, or t
  misc_feature (457)..(457): n is a, c, g, or t
  misc_feature (472)..(472): n is a, c, g, or t
  misc_feature (475)..(475): n is a, c, g, or t
  misc_feature (494)..(494): n is a, c, g, or t
  misc_feature (498)..(498): n is a, c, g, or t
  misc_feature (511)..(511): n is a, c, g, or t
  misc_feature (538)..(538): n is a, c, g, or t
  misc_feature (543)..(543): n is a, c, g, or t
  misc_feature (553)..(553): n is a, c, g, or t
  misc_feature (567)..(567): n is a, c, g, or t
  misc_feature (571)..(571): n is a, c, g, or t
gaaccccttctttagggtccagaaggaattgtggactgaatcactagccttaggtctttcagcaaacagcctatcagggccatttatcatgtgtgagatttgcattttactttgctgactttgtgtaatagatcccattcatngtcccctntggggtatttccaatacttgaatggcagatggagtttttcagagtatgtgtttcatctgctagtctttctctccttcatagcttttnttttcctggacttgctcctttgagtgctttgcgttctcatgcctaggcaagtgtaatagaaattatgtagctccttatgtggcaaaggagctctatatagtttcacttgtatnanagttaggaccagctgtgttacatgtaatatttnngttcagaacttgacctgaaggcnggnanganangtatgtgatttttaccttttttaacaaatgtgaanangtcagtttagaaatncgnggtagtaagtcggcattgntacntgtatagagagangactaataatctctatttataactaantcatngagatagaanagattcccattgantgtngactcttcccatttgtctccttctgctgttccccttcaggcttggcctctaggaaccaaagtgattgtcgtgttccaacactgggcttgtgacttggttagtgccactaccttcttcctcctttaccccttcaattggaataagtttctgtatatgtgcatcctaggtaaggtagtctttcttactcattaatctctctcacttcaagatacccctcccatgcaaataattaataccaggaatcttcagaattcaaaattcagcttttccactta

SEQ ID NO: 654485 - DNA, 421 bp, Homo sapiens
gctcgaccctggccgtcgatacccggcgtcgtaatccagttggtattcgaggccgcgaaaacgggtggtctccaggttgttcacatacgccgcattgccaatgttgcgatgcataaccgggtggctgcacccccaaggccatataggagaagtcatcgacgcgagtgttgaagtaggacactttcacgcccacacggtcgtctgcgaacacaggtcttccttgagcacgttgaacccgacctcccacgccgtgacttctcgggcttcaagtaggggttgggcaggatcgattccgaaccaccgccatggggccggccgctgacgagggtttcggtgaccgccggagacgccagcccttgccgtacgtggcaaacagttgcagccagtcgacacccggcttgatcgacaggccgaagtcggc

SEQ ID NO: 654486 - DNA, 234 bp, Homo sapiens
tcgctgccggcgcgggtgctatgatgcatactagtttttgcgcctggaggcggtggtaggctacgcctactagtctcaatctccaacactatatggcctagactatgtacataacctaaacctactccaagtgctaaaactaatcgtcccaacaattatattactaccactgacatgactctccaaaaaacacataatttgaatcaacacaaccacccacagcctaattattca

SEQ ID NO: 654487 - DNA, 230 bp, Homo sapiens
ctgctttaaagcaggtggctggggtggctctgtgaggtgcacatttaagctgcaaatgtgcagggtgggcaaggcgtcagacatggctagatcagcagggagagcatttcaagcagcaggaacagtgcagcatgcgtggctgtttcccagactggcagacagcagtgtgcctaggctagggagccagggaagcgtggccatgttttgcggggtggcagcagggcagcagg

SEQ ID NO: 654488 - DNA, 948 bp, Homo sapiens
  misc_feature (4)..(4): n is a, c, g, or t
ccanaaaataataaaaagatcgaaaagaaacggcaagaacgagaaagggtgagagccacagttgctgtggcgtagaggtgccaccacggtgggactacgtgggcgcctcgactgcgggcgcccttcgttctttttggtggccgcactccctgggcggtgtaaaccctgctgtgctctagccgttccacgttgtgcttcatatgatatccggttatccgactacatacaaccgcttttataagcgcctttgtcgcccacaaattgtaccgcttggtctgtgcgtaaggagcgaaacctggtgaagcgcgggttctacatcaataaacagaaggtaaccttgctgccttgaaatatgcggttttttgaaccgtggccatcatggcgaaagggcccggtttgtcgacaaggcaaagccccacgttttcaagggttgccatggaagcgaacaccacgagtgattggggttgacaagcaggcacgttcaaatatggcgggttgcccacgaccggacgcgtgatatgcccgcttgtcttcacaataggccgctcctttatataggttccccataaaggagccagccgctttggtgcactaaatacgaaataaaaaaatagagtcatggacaagccgcgttgttaaaattagtatgggataggaataggccttcagaacttcttgcccctcttgtgaaagagaacgaaaaaaaagagtagcggaagacaagttgctggtcgtgtttttaagagccaaacaaaaatcgggcttttaatccggcacaacggtatcatagaaagtgggctagattccccgcttgattggtaaaatcttaaacccaccagttaggttggcgggcatagatattttcgtccccccagtcaaattgttctaggagtctgttatttcccagccccaggaaaaaataaaaattcttgcccccaacacatgaca

SEQ ID NO: 654489 - DNA, 903 bp, Homo sapiens
gaaaaaaaaaatatataaaagttagctgggtgtcatggcgggtgcctgtaatcccagctactctggaggctgaggtaggagaatcacttgaatctgggaggcggaggttgcagtgagctgagatttgcaccactgcactccagcctgggtgacagaatgagagtctgtctcaaaaaaaaagaacaaagaaaaaaatttcagacatatttatttgtatctcaaattcctgacctcgtgatccacgtgccttggcctcccaaagtgctgggattacaggcgtgagccaccaagcccggcccaacttctcctaatgtggctatttggatctttttctaaactcatgaatgttctcaatggcatctagaatgttgaatcctttccagtaggtttccaattatttgtgcccagatccatcaaaggaatcactttctagagaagctatagctttatgaatatattttcaagtgataagacttgaaagttgacattattctttgatccaggggcccagactgactgtcgggtcagtaggcatgaaaacaatattcagtctttatacatctctgttaaaagcccttgaagtacccagcgggattcgtcattgagcagtatactttgaaaggaatcttatctcttgagcagtagttctcgaccagtgcgctaagaatattcagtaacccttttttgaaaccatggttgtcatccagcttgttcccttgtagagtcagacgacgtgttactcaaatctcaggcccggattcgaaatacatcttgtccggcactcccatgttgctacacaaactgtctgactaacaggaaaacctgtggaccggagccctaaggggagacagggggagcaaaatatacggcacgtcgatgaggacacacaccactgacacaaga

SEQ ID NO: 654490 - DNA, 965 bp, Homo sapiens
  misc_feature (227)..(227): n is a, c, g, or t
  misc_feature (575)..(575): n is a, c, g, or t
gagcgcccctgatgcctcgttggaatgacactgcctgtaccttgaggccctaaaaacagaccatgagaccttcattcccttcgtgatcccattactgttgttctgtaattccctgcacaatatacctcagtgtctggagagacagggagagatctcatcatagaggatctgagaacttagatgaacaatagtgtaatagtccatatcatcaaggtgccctatcatanagattgtgcgccaatactcacctcgaattcctctctccatatccatatatgcatacgtacatgcttcgtgttggcaatttgtgtcacactagctcacttagtggcattatttatagaggaggaaggtgaactagtaagatcctgatcccatctattgtgatatttctcgtacacgtgacctcagattataatgcgtaaaaagcatgcaagttatcgaaaattgtcttctaacctcgatctatgtgtattcaatcgttatcctcttgtctctggcatcatgaatttacacaactattcaaatcacacgtaatcgtccgcaagtgccatgaaacaattgggctgcactcntgtcccactggaggcttgtatccatctcgatgtaatatataatgcaatgggacctaaccaagatgctccccctggtatttcaccatagtatccattcaaaagaagtcagtgaacactaatttattcccatagtctatgcatttcctccatgtcgtattgggatgccgccgtaagctagagatagcatagaatccatcccatgtgtttgaatagaagagtcctagttattgacccgtagtcaaagacgtggaaaggcagggccttgctgaccaatttgggctgacaaatcatactcggccaattggcgcaatgggcccatatacctcctcgaggttggtaaatacatttggggtggaagaaccattggaaaaccagtggggtgccaaaaat

SEQ ID NO: 654491 - DNA, 423 bp, Homo sapiens
  misc_feature (10)..(10): n is a, c, g, or t
  misc_feature (15)..(15): n is a, c, g, or t
  misc_feature (26)..(26): n is a, c, g, or t
  misc_feature (63)..(63): n is a, c, g, or t
  misc_feature (102)..(102): n is a, c, g, or t
  misc_feature (108)..(108): n is a, c, g, or t
  misc_feature (124)..(124): n is a, c, g, or t
  misc_feature (137)..(137): n is a, c, g, or t
  misc_feature (148)..(148): n is a, c, g, or t
  misc_feature (156)..(157): n is a, c, g, or t
  misc_feature (177)..(178): n is a, c, g, or t
  misc_feature (196)..(196): n is a, c, g, or t
  misc_feature (268)..(270): n is a, c, g, or t
  misc_feature (282)..(283): n is a, c, g, or t
  misc_feature (285)..(285): n is a, c, g, or t
  misc_feature (287)..(289): n is a, c, g, or t
  misc_feature (296)..(296): n is a, c, g, or t
  misc_feature (298)..(298): n is a, c, g, or t
  misc_feature (303)..(304): n is a, c, g, or t
  misc_feature (309)..(311): n is a, c, g, or t
  misc_feature (315)..(316): n is a, c, g, or t
  misc_feature (318)..(318): n is a, c, g, or t
  misc_feature (325)..(325): n is a, c, g, or t
  misc_feature (414)..(414): n is a, c, g, or t
cgccgccgcnagganccgcgcctgcncaggcccggggagggaggaggcgggcgtcagggtgcngcgccccgctcggcgtccgagcttccaggccgggctgtnccccgnagcggatcttaagcangggataaagagcncctgagagganacgacctnngagagagacatggacgagannatcgacgtggggagcganaacaattactcggggcaaagtactagctctgtgattagattgaattctccaacaacaacatctcagattatnnnaagaaataaaannanannnattatananaaaanncgtcnnnatcnnanaaataanagtttatctgagttgagaagacttgtgccaactgcttttgaaaaacaaggatctgcaaagttagaaaaagctgaaatattgcaaatganagtggatca

SEQ ID NO: 654492 - DNA, 87 bp, Homo sapiens
cagagcccgggtccctgcgccccacaagccttggcttcctgctagggccggcaaggccgggtgcagggcgcggctccagggaggaag

SEQ ID NO: 654493 - DNA, 644 bp, Homo sapiens
  misc_feature (1)..(1): n is a, c, g, or t
  misc_feature (4)..(4): n is a, c, g, or t
  misc_feature (10)..(10): n is a, c, g, or t
  misc_feature (17)..(17): n is a, c, g, or t
  misc_feature (32)..(32): n is a, c, g, or t
  misc_feature (34)..(34): n is a, c, g, or t
  misc_feature (36)..(37): n is a, c, g, or t
  misc_feature (53)..(53): n is a, c, g, or t
  misc_feature (94)..(94): n is a, c, g, or t
  misc_feature (104)..(104): n is a, c, g, or t
  misc_feature (128)..(128): n is a, c, g, or t
  misc_feature (620)..(620): n is a, c, g, or t
nacngagaangaagaancggcccgttctttcntngnnggtttggttctttccngtggtgaccgggttgggctcttttgagatcacaactttccnttgacacaancctaaacgccccatttagagtggngggggcgggcctctcccccggcctctttcttggggggaggggcgccccttcccccccccttttttttaaaaacccccccttttttgtgtggcccccccttttttttttcccccagttttttcaccccctctgagaaccccccccccccccccccccccgtttatttttttttttttcccgcgcggttttttttctttttttttttccccccaaaaaaggcccaaaaactcccccccggggggggaaaaaaaaacccccgccccccctccccctaaaaaatatttttggggggtgggggagggaaaaaaacagggggcggtgttttattaaaaaaaaaaaaaattatctctttaaaaaatatttttttttttcgcccccccccccccccccagaggggggttttttttttttttttggaaaagaaaattttttcctctttgggggggggggggggagaaaaaaaattttttttttattttttctgggggaggngggtgtttgtttttattttttttt

SEQ ID NO: 654494 - DNA, 132 bp, Homo sapiens
gaaggcatcggaagatactttactgggtacggagtacaaatctatgcaagcggtggacatgttataggaactaaagtcgtggttctacaacattgcaaatgcactcgatgccactgacactgttcactttac

SEQ ID NO: 654495 - DNA, 138 bp, Homo sapiens
tggagtagggctggaccatccttaaatagggcaaatagcgaggctgtggattggttatgtatttctggtgaggagaagcaaggggatgaaatgtgtcttgaactcatgttgtcaagaatgagtgagtctacaggtgag

SEQ ID NO: 654496 - DNA, 146 bp, Homo sapiens
tcgtgctgcgttgttctcttcatgtacagctgcacctgtgtatcatgcccgaggatggtgtggcccagggtagctcagaatagtatgcccgtagatattacccgcatgaatggcgggccgctatcagaagctcgccccataagtat

SEQ ID NO: 654497 - DNA, 137 bp, Homo sapiens
  misc_feature (26)..(26): n is a, c, g, or t
  misc_feature (121)..(121): n is a, c, g, or t
gtcttcgtcgacgcgaagcacgtagncatgctcgcgcacgtttccgggccagacgtggcggcgcaacgccatgcggccggcctcggtaagagggttggggcgccctttcgttggcgccggngcgggcctgccagttg

SEQ ID NO: 654498 - DNA, 571 bp, Homo sapiens
  misc_feature (426)..(426): n is a, c, g, or t
tccctgacgcaccgccgtgatgcccagggaagacagggcgacctggaagtccaactacttcctcaagatcatccaacttttggatgattatccaaaatgcttcattgtgggagcagacaacgtgggctccaagcagatgcagcagatccgcatgtcgctccgagggaaggccgtggtgctgatgggcaagaacaccatgatgcgcaaggctatcaggggccacctggagaacaacccagctctggagaaactgctgcctcacatccgggggaacgtgggcttcgtgttcaccaaggaggacctcactgagattcgggatatgctgttggccaataaggtgccagctgctgctcgggctggtgccatcgccccgtgtgaggtcactgtgccagctcagaacactggtctaggacccgagaagacctncttcttccaggctttgggcatcaccacgaaaatctccagaggcaccattgaaattctgagtgatgtgcagctgataaagactggagacaaggtgggagccagcgaagccacactgctgaacatgctgaacatcttccccttctcc

SEQ ID NO: 654499 - DNA, 381 bp, Homo sapiens
gatgttatgggatgcgtacgaggtgatgcagtattcttgggttgtgagactcagcgaagtgtgctacaaagtgtgataggttaatcctgaactgcatgtataggggattgtttggtagaaaagaaaaaaaagaattttgaatcaataaatgaacagtgaatcacttgcgtggatcttcttgctgtaaatggtgactaagaggttgggacagaaatcttgacaactagtggaaaacttggataatctccaaggaccatggagccttctgtttccttctgtttgcagaaaagcaacactgcctgggttgtgatcctttacaagtgactacttcagacacaattggccacctctttgtatcactggatgactgaatgtatcgct

SEQ ID NO: 654500 - DNA, 504 bp, Homo sapiens
cctcagaggcccaaaaatttggcacgaggcaaggttgtttacttcgcgccgcgctcccccggcccgggagccagcctgggcacaggctacgaccccaaggactacgtttaagggacagacgcagggagaccccaccaccaccaaccccccccaacaccccccccccccccgcgagttggagggcgcaccaggccatccagggtgcagccttgcctcggaggccagcccacccccaaaaaccaggaagcccccgcgctggattggggcagcttccccaacaacccccggcttttcgggccgggcagttgacttcggggcccagggaccaacctgcatggactgttaaacctcccccttttggagcacggggcctgggtgacccccaatacttgacccccccgtcgagccccatcgggcccctgcccccatgctcgcgctgggcaggggccggcagccctggaaggggccctttatatttttcaataaaagcctttcgttttgcca

SEQ ID NO: 654501 - DNA, 1066 bp, Homo sapiens
gcgccaacatggagccgcgttcgcatccaaaaccgtgtaagaaggcggccctgcggtcatcgatataaaagttactagcacgcgcctgggcaacgacttccacacgaacaatgcgcgtgtgcgaggatgatcgtccattacttccccgagtgccaaacacagctccgaccgcacgatagccaggttatgctcaccgcactctgtatgaggcgaattcagagagtgtcccagataagatggtatcctccgatccactgctgcaggacgcacgacagagaaaggcagagtcaccaattatgttcctgagggtcgtcagtccttggcatcacgaaccagttactcgagagatagcatccctgactggtgacggtaacatgctgcaatgcttatttgaaccttcgtgcaggtctgatgcatcttggtcagggtctacctcaagcccgtaagccaattcgggactggagatcttcaagaatacggccgttcgggggaccctcgttgttggaactttgttttcttgtaacgtgcctgctaattgatttttcctgtagattatcttggggacaaatcacgttaagaactaatactagccaagttacaagacacaagctaagaacacactgccaatggacccttgtatgttgtaaagggtttctccgggaaatgaaatgtgggttctctaggtatatgtcgaggtcccagaattgttcgtcgtagataggctgtatcattcctgtgcccaccagtccttgtggtgtatatctaaaacactgtgggtagacattttcacctgcgggcattcacccgttattcggcagaaggcaatgtattaggatcgccgtaaggaaggctcccgtatgtcccccgtggatttattgaagcaccaggggcaaaacatgttatctgacgcaccatcctactgtaggtcctcccccaacagggctgaatctccacctttggaacacggggtcgttgcccacaacgatgtacgtgcaccccaaatccatgatgaactgccgaaccaccatattcacaatagcgactgagattaccactctttatacac

SEQ ID NO: 654502 - DNA, 421 bp, Homo sapiens
aaaaaaaaaaaaaaaattggaacgcaggcaagaactcgtatttgggaaggagatgggggaaaggagcggtattataccttaagttggtattttgcaggcaaattgagaatggagcccttcttctgtgttaaagaaagagctcattgtgtgcaagttagacggggctctggtgggttgcaggccctgtggaggggcacacaattggcctgtggaaggctttctgtggtgaagaactcgggaagaagggcaggagaaggcagctcttcttggaacaacaattaaagttatttttatattctcattgtgggtattttatttaaattgaaaaaacaaatccccagtgggtgttcccgtgttgggtgttgggtggaaaccttaagtgacgtggttgaaattaaaggttcgtgggtttttccctgtg

SEQ ID NO: 654503 - DNA, 437 bp, Homo sapiens
  misc_feature (220)..(220): n is a, c, g, or t
  misc_feature (230)..(230): n is a, c, g, or t
  misc_feature (247)..(247): n is a, c, g, or t
  misc_feature (287)..(287): n is a, c, g, or t
  misc_feature (326)..(326): n is a, c, g, or t
  misc_feature (352)..(352): n is a, c, g, or t
  misc_feature (361)..(361): n is a, c, g, or t
  misc_feature (394)..(394): n is a, c, g, or t
  misc_feature (414)..(414): n is a, c, g, or t
ggcacagggttcaagaaattctcctgcctcagccttctgagtggctgggattactggcgtgcaccaccacatccagctagtttttgtatttttagtacagatggggcttcaccatgttggccaggctggtctcgagttcctgacctcaagtgatccgcccgccctggcctcccaaagtgctgggattacaggcatgagtctcactctgtcgcccaggctngagggcagtngcacacacagttcactncaggcttgacctcccctggctcaggtgatcctcccacctnagtctcctgagtagccgggaccacagacacagtctcctnacttagttgagaccacaggcgcactnccaccacanccagctaattttttgtatgttttgttagagatnaggttttccctggtgtttgnccaaggctgggtattcaaactct

SEQ ID NO: 654504 - DNA, 358 bp, Homo sapiens
  misc_feature (15)..(15): n is a, c, g, or t
  misc_feature (357)..(357): n is a, c, g, or t
tgtcccgtgtcctanattggaactggctattggcacagttcccagcttaagaataataaaattggccccagcatgggagctccttccccgtaatccccagcattttgggaggccaaggcgagtgaattacttaaggccgggagtttgagaccagccctggccaacataaggaaaccccatctctactaaaaatataaaaaattagctgagcctggtggtgcatgcttgtaatcccagctactcggcaggctgaggcacaagaatcacttgaacctgggaggcaaaggttgcagtgaactaagattatgccactgcactccagcctaggcgacagagtgagactctgtctcattcttng

SEQ ID NO: 654505 - DNA, 138 bp, Homo sapiens
  misc_feature (83)..(83): n is a, c, g, or t
cgagtatagtaaataggtctctgcacatgaaactggtaccaacacatatactaattataaaacgtctgtatagtccactatgngcaattatgaacggcagagtataatatggtgagcctgacaaagctatactacaag

SEQ ID NO: 654506 - DNA, 318 bp, Homo sapiens
atgataaaatatgatccatgaaaacatactaagtgaaacaagcagatacaaaagggcaaacatatgattccacttatacgagatacacagaataggcaaatttcatagagacagaatgtaggatagaggttaccaggggctggggggaaggagagttatttcatgagtacagagttctgtttgggatgatggaaaagttctggaaatgaatagaggtggtggttgcacaacacagtgaatatacttaataccactgaattgtatgcttaaaggtggttcccaaaacaaattttatgggatgtgtaaataaccccaatt

SEQ ID NO: 654507 - DNA, 211 bp, Homo sapiens
  misc_feature (26)..(26): n is a, c, g, or t
  misc_feature (34)..(34): n is a, c, g, or t
  misc_feature (42)..(42): n is a, c, g, or t
  misc_feature (44)..(44): n is a, c, g, or t
  misc_feature (49)..(49): n is a, c, g, or t
  misc_feature (53)..(53): n is a, c, g, or t
  misc_feature (62)..(62): n is a, c, g, or t
  misc_feature (72)..(72): n is a, c, g, or t
  misc_feature (74)..(74): n is a, c, g, or t
  misc_feature (88)..(88): n is a, c, g, or t
  misc_feature (91)..(91): n is a, c, g, or t
  misc_feature (95)..(95): n is a, c, g, or t
  misc_feature (107)..(107): n is a, c, g, or t
  misc_feature (115)..(115): n is a, c, g, or t
  misc_feature (117)..(117): n is a, c, g, or t
  misc_feature (124)..(124): n is a, c, g, or t
  misc_feature (133)..(133): n is a, c, g, or t
  misc_feature (135)..(135): n is a, c, g, or t
  misc_feature (151)..(151): n is a, c, g, or t
atgacctccggctagcatgtgatttnacttccantccataangntcctnatantaggcctantaaccaacanantaaccatataccantgntggngcgatgtaacangggaaagnanataccanggccaccananaccacctgtccaaaanggccttcgataggggataatcctatttattacctcagaagtttttttcttcgcaggtttt

SEQ ID NO: 654508 - DNA, 233 bp, Homo sapiens
  misc_feature (166)..(166): n is a, c, g, or t
acttctctctcccacctcagtctctgaggtagctgggactacagacacgtgcaccactccggcccattatgtctgtttttgtagagatgacgtctcactatgttgcctagggtggtctcaaactcctaggctcaagtgatcatcccacctcagtatgactctttantctcagttttcatggatagtctctaaattctttacttttatgtgattgtgaggtgggaggagaggaa

SEQ ID NO: 654509 - DNA, 212 bp, Homo sapiens
acacggatatacggactgaatttagtccatcacaaaggatattacaacactgttgctggatctgagtgtttgtccctcacacaggattccagaacactgcttcgatggtctgaatgtttgtccctcacaaaggattctaaaacactgctgctggtttcttagtgtttgtcactcacataggattccagaacactgctgctgggtcctgagtg

SEQ ID NO: 654510 - DNA, 182 bp, Homo sapiens
gttgtggttcctgtaaggggtcctccctgctgccacaaggccgtcggccatggtgaagctgagccaaggaggccaagcagagcttcaagcaagctctttcaaggggagccagtttgccattcgcttggggctttatccctcttgtgatttacctcgggatttaagaggggtgcagatgcccg

SEQ ID NO: 654511 - DNA, 293 bp, Homo sapiens
  misc_feature (17)..(17): n is a, c, g, or t
  misc_feature (68)..(68): n is a, c, g, or t
  misc_feature (85)..(85): n is a, c, g, or t
  misc_feature (104)..(104): n is a, c, g, or t
  misc_feature (119)..(119): n is a, c, g, or t
  misc_feature (143)..(143): n is a, c, g, or t
  misc_feature (153)..(153): n is a, c, g, or t
  misc_feature (157)..(158): n is a, c, g, or t
  misc_feature (161)..(161): n is a, c, g, or t
  misc_feature (173)..(173): n is a, c, g, or t
  misc_feature (181)..(181): n is a, c, g, or t
  misc_feature (208)..(208): n is a, c, g, or t
  misc_feature (215)..(215): n is a, c, g, or t
  misc_feature (236)..(236): n is a, c, g, or t
  misc_feature (243)..(243): n is a, c, g, or t
  misc_feature (251)..(251): n is a, c, g, or t
  misc_feature (261)..(261): n is a, c, g, or t
  misc_feature (265)..(265): n is a, c, g, or t
  misc_feature (275)..(275): n is a, c, g, or t
ccccggatatttaagtnagtcttcctgaaagtactcagggtagcaagtaacaaaatggaaaagagtanataaagaaagtgcagtnaaaaaggaaactatgtggnaagtgccactctttnccttcccaccccccaattaaaggnaaacaatggnactnngancatgcgtaaccnagagaganttcaaaaactattaaaatgtaaaaganttaacanaaaaacaaaaagacggttaanagatgtnaaaaagcnccttagtgtntganaataaatgcntaaacaaaagacaacaga

SEQ ID NO: 654512 - DNA, 908 bp, Homo sapiens
  misc_feature (73)..(73): n is a, c, g, or t
  misc_feature (119)..(119): n is a, c, g, or t
  misc_feature (160)..(160): n is a, c, g, or t
ggtccctttggtaatacttgatagtgtctatgaggccgggcgtggtggctcacgcctgtaatcccagcacttngggggaccgaggcaggtgaaatcccatctctactaaaaataaaaangattggccgggcgtggtggcgggcgcctgtggtcccagctnctcgggaggctgaggcaggagaatggcatgaacccgggaggtggagcttgcagtgagccaagatcgtgccactgcactccagcctgggtgacagagcaagactccgtcttaaaaaataaataaataaataaatagacagatagatagatagatagtgtctatgaaggctgcccaagaacttgaccattagggaaacatggctgtttctgtggattaactagtcaagcccatacaggaagagtgaggtcagctcccaggtggggcaggatgtagtggacgcttggaagaatttgggaccacacacgaattgctaccatggtgagccagtgaaacttgaggaaggcaggactggattgtgattacaactgagtaagtaggcagagaattggagtgtgggcaacataaagatgatgtgaatcaaagaagaatggtcaattaagaccctaaaaaaaggacgttcaaaaatgcagaggttaaaaaaaaaaaaagcagagattgccagatgctccatttggtaggagtctgcttagcacagtggtgcttcgccagactttaccgtggcccagggaaatggtcctaaagacggactccatgtttaccaagctacttgctaatgatttctttgccctccaggacagggaaggggcttttctggatgggatacattgatattttatggccttgaaacactatcctgattataaattaataaattgctatgcaaataattgcattagtttcatcaatc

SEQ ID NO: 654513 - DNA, 852 bp, Homo sapiens
gatcgagtcccgtataatataaggtaacaaaccgccactcagaaaaactggcccaatgatgtgtgtggaggaagcattaaaggactgactgaaggcctgcatggattctatgttcatgagtttggagataatacagcaggctgtaccagtgcaggtcctcactttaatcctctatccagaaaacacggtgggccaaaggatgaagataggcatgttggagacttgggcaatgtgactgctgacaaagatggcgtggccgaagtgtctattgaagattcggggatctcactataaggaaaccattgcattattggcctgatactggtggaccatgaaaaagcagatgacttgggcaaaggtggaaatgcagaaggtacaaacacaggaaacgctgcaagttgtatggattgtggagatattccgatccccacataaacaccccctaggatggcagatgtgggacccttaaacaatctgacatacattctacatggataaaagctcccttgagaacagtctcgcactgaatccttcaaagagcaacgcggagaaacttcccgaagtgcatctaagtatccacagaccaaaactccaaatagatcactttacaaatttgacctcgctttaacataattacatcgcatgcccccttctcttcgcctgcaatagttgccgacacatacgaacgaccattttctaagattcaaacacatctctcattcatcttctgcgcagacaatgacatgcctcctcacacacatcatactcaaagacaacaattgacacccgcagcgacacaaccatagaaacagtgtctctcgatcaccactaccactacacccgataactaag

SEQ ID NO: 654514 - DNA, 829 bp, Homo sapiens
gatctggtatggggcgggtggggacagagagaaaagagatctcacctataaccaaattctggcagtgggaggaaggtagaggaggtgctatctgtagcagcagagatggacgtgatagttgccaagagacagaacctgggccacagcaattgctgctgatgtttctggttctcaaagccacactccgtcttaaaaaataaataaataaataaatagacagatagatagatagatagtgtctatgaaggctgcccaagaacttgaccattagggaaacatggctgtttctgtggattaactagtcaagcccatacaggaagagtgaggtcagctcccaggtggggcaggatgtagtggacgcttggaagaatttgggaccacacacgaattgctaccatggtgagccagtgaaacttgaggaaggcaggactggattgtgattacaactgagtaagtaggcagagaattggagtgtgggcaacataaagatgatgtgaatcaaagaagaatggtcaattaagaccctaaaaaaaggacgttcaaaaatgcagaggttaaaaaaaaaaaaagcagagattgccagatgctccatttggtaggagtctgcttagcacagtggtgcttcgccagactttaccgtggcccagggaaatggtcctaaagacggactccatgtttaccaagctacttgctaatgatttctttgccctccaggacagggaaggggcttttctggatgggatacattgatattttatggccttgaaacactatcctgattataaattaataaattgctatgcaaataattgcattagtttcatcaatc

SEQ ID NO: 654515 - DNA, 506 bp, Homo sapiens
  misc_feature (5)..(5): n is a, c, g, or t
  misc_feature (9)..(9): n is a, c, g, or t
  misc_feature (11)..(11): n is a, c, g, or t
  misc_feature (15)..(15): n is a, c, g, or t
  misc_feature (19)..(19): n is a, c, g, or t
  misc_feature (21)..(22): n is a, c, g, or t
  misc_feature (34)..(34): n is a, c, g, or t
  misc_feature (45)..(45): n is a, c, g, or t
  misc_feature (78)..(78): n is a, c, g, or t
  misc_feature (358)..(358): n is a, c, g, or t
  misc_feature (416)..(416): n is a, c, g, or t
gggantcangntcanggcncnntccgggtggccncggcgttgganacggcttgggcccttggccgctttaaacggatnctggcggcgcaggggggtggattccggtttggcccgagccctgtgcttgggaagtcccgcagaacgccggcagctgttgccttgcgcccgggagcaggaggagctgctggcgcccgcaaatggcaccgtggagctggtccgggcgcttccgctggcgctggttctgcacgagcttggggccgggcgcaaccgcgctggggaaccgctccgcctgggggtgggcgcaaaacttctggttaacgtgggtcaaaggttgccccgtgggaccccctggctccgngtgcaccgggacggccccgcgctcaacggcccgcagaaccgcgccctgcaggaggggnttgtactttccgaccgggggccatttgccgccccctcgccctttgcagagcttgttttgccgccgcagcaataaagctcctttgccgcga

SEQ ID NO: 654516 - DNA, 796 bp, Homo sapiens
gattaggcccctgtctccacaccgatatcgactctaatatctctgtaggaactattcatcaatggcgcagtggctcacactggtttattacctgagatagagccgtatgagaatgatatgtgcatacgacattggctatgtccagattgcatgggacagaaaaagaaatagaaacacctggggtcctcgacacgaatagtcctgctcagtcaaatgtattttgcatcaatcgacaatgataaaggcgttactcacagttaagtctctttctaattaggcttaatccgtacatgtcatacaaagtaatatctcgtcgcggggacccaagggggacatcgattgaaacccatataagcatatacacatttaagattaactcatgcgatttaccataactacatcatatggggctatatggcggtagaacacctacggaatacggcaccccggcttctcaggctttcttgacgatcccccactgaagtgtttaacccaaggacatccccctgcatgaccaatcccggactcttggattctttccgtcaccattgaccatgaaaactcttaggaccccgaaatactcaagtcggttataacacgacaaatatgtacatcccttctactttaacaaggttaaaggccctgtacattccgtgcgagcatgcgtctgccaaggtctttattacttgcagtgggccagggcgagcgacggttgggagtacagaaccaaaatgccagggtaacggacaaaaaatttttaagccattactgcctccaattaaccacaaatagggag

SEQ ID NO: 654517 - DNA, 519 bp, Homo sapiens
ggcagattcggttgctaatcaggcaagaaggtcgagggggtcccgaaccagggcaagaaggccgaggggaccccgaaccaggacaagaaggcgaggggaccccgaaccaggcaagaaggccgagggggcccagaacaggcaagaaggccgagggggcccagaaccaggcaagaaggccgagggggccccgaaccaggcaagaaggccgagggggcccagaaccaggcaagaaggccgagggggccagaaccaggacaagaaggtcgagggggcccagaaccaggtcaagaaggccgagggtgctcagaacaggcgaaaagagtagaaggggcccagaaccaggcaagaaggctgagggggcccagaaccaggccaagaaggccgagggggctcagaaccaggcaaaaaggccgagggagcccagaaccagggccaaaaaggagagggagcccagaatcaggtacaaagacagaaggggctcagggcaaaaaggcagacaggagtcccaaccaacgcaaa

SEQ ID NO: 654518 - DNA, 365 bp, Homo sapiens
  misc_feature (5)..(5): n is a, c, g, or t
  misc_feature (9)..(9): n is a, c, g, or t
  misc_feature (11)..(11): n is a, c, g, or t
  misc_feature (15)..(15): n is a, c, g, or t
  misc_feature (19)..(19): n is a, c, g, or t
  misc_feature (21)..(22): n is a, c, g, or t
  misc_feature (34)..(34): n is a, c, g, or t
  misc_feature (45)..(45): n is a, c, g, or t
  misc_feature (78)..(78): n is a, c, g, or t
  misc_feature (275)..(275): n is a, c, g, or t
gggantcangntcanggcncnntccgggtggccncggcgttgganacggcttgggcccttggccgctttaaacggatnctggcggcgcaggggggtggattccggtttggcccgagccctgtgcttgggaagtcccgcagaacgccggcagctgttgccttgcgcccgggagcaggaggaaattttggggcccccaaatgggaccccctgggtccgggtgccccgggggggccccgcgcttaacgggccccaaaaccgcgccctgcaggaggggnttgtactttccgaccgggggccatttgccgccccctcgccctttgcagagcttgttttgccgccgcagcaataaagctcctttgccgcga

SEQ ID NO: 654519 - DNA, 478 bp, Homo sapiens
  misc_feature (5)..(5): n is a, c, g, or t
  misc_feature (9)..(9): n is a, c, g, or t
  misc_feature (11)..(11): n is a, c, g, or t
  misc_feature (15)..(15): n is a, c, g, or t
  misc_feature (19)..(19): n is a, c, g, or t
  misc_feature (21)..(22): n is a, c, g, or t
  misc_feature (34)..(34): n is a, c, g, or t
  misc_feature (45)..(45): n is a, c, g, or t
  misc_feature (78)..(78): n is a, c, g, or t
  misc_feature (358)..(358): n is a, c, g, or t
  misc_feature (388)..(388): n is a, c, g, or t
gggantcangntcanggcncnntccgggtggccncggcgttgganacggcttgggcccttggccgctttaaacggatnctggcggcgcaggggggtggattccggtttggcccgagccctgtgcttgggaagtcccgcagaacgccggcagctgttgccttgcgcccgggagcaggaggagctgctggcgcccgcaaatggcaccgtggagctggtccgggcgcttccgctggcgctggttctgcacgagcttggggccgggcgcaaccgcgctggggaaccgctccgcctgggggtgggcgcaaaacttctggttaacgtgggtcaaaggttgccccgtgggaccccctggctccgngtgcaccgggccgcgccctgcaggaggggnttgtactttccgaccgggggccatttgccgccccctcgccctttgcagagcttgttttgccgccgcagcaataaagctcctttgccgcga

SEQ ID NO: 654520 - DNA, 899 bp, Homo sapiens
tcaacagagacaggtttatttggggaataaacctgaaaggggcttctggccgatttcggtcagggacattctcttacagactaggggcatttaagggtttaggaagggggagcctaccgcaggctgcgaatgttcctgtgtgaaggagagttttatatggcagagtgggaattatctctgtggcgtggaggggaggttatcctcaggatgggcatgttcccttggtcagagtgggggttcaatctcagtggttgaacagtgttctctgctcatactgacattgagccattaggctgatgtttggggcgttggttttaaattcacggagaacttaaaagggccagtgttgtgtccaagatggcaatgctccggcggtcacacccacccacccacagggatacgggggtcgctgcaaaaccgggccgccttcgacagacacgttccactgtgcccggggcacccccatgcaccccagggagcgatgccgcgttgtggtagccaaggccctgccgcgctgtgggccaggcccacccgatgctcggaggcatctgtgcgaaggtgcaagctagcggagacccaggtagtcccgcccggcaaccatggcaagctgcttgcaaggcctctggctggctaagggtggagcactggctgaacccagggatgaccggtgtcagggcagtcacgtggacggagccctgaagaaaccggggggtcagtggcccggcaaccgttcggaaaaaacagtggtgccggcactccaaggggatggttccgatcacgtcacggcgaacaagccaaaacaaaggcggttggtggaggccgggtaaacgacggttgacaacgcgggggaaaggcaagaaaggagacaagacacgaacagcgggagcgcaccggacaag

SEQ ID NO: 654521 - DNA, 158 bp, Homo sapiens
tgagttgtttggctatcatttgttttgaggttagtttgattagtcattgttgggcggtgattaggcggtctgttcatgcattgcggaagccagatctgttctattggagtggtggggtactgaactccattctcttgtcctggtctttgctctgtgct

SEQ ID NO: 654522 - DNA, 505 bp, Homo sapiens
  misc_feature (183)..(183): n is a, c, g, or t
  misc_feature (186)..(187): n is a, c, g, or t
  misc_feature (190)..(194): n is a, c, g, or t
  misc_feature (201)..(201): n is a, c, g, or t
  misc_feature (205)..(205): n is a, c, g, or t
  misc_feature (207)..(212): n is a, c, g, or t
  misc_feature (214)..(214): n is a, c, g, or t
  misc_feature (216)..(218): n is a, c, g, or t
  misc_feature (266)..(266): n is a, c, g, or t
  misc_feature (329)..(331): n is a, c, g, or t
  misc_feature (333)..(333): n is a, c, g, or t
  misc_feature (335)..(341): n is a, c, g, or t
  misc_feature (343)..(343): n is a, c, g, or t
  misc_feature (345)..(346): n is a, c, g, or t
  misc_feature (349)..(349): n is a, c, g, or t
  misc_feature (355)..(355): n is a, c, g, or t
  misc_feature (359)..(362): n is a, c, g, or t
  misc_feature (368)..(368): n is a, c, g, or t
  misc_feature (409)..(409): n is a, c, g, or t
  misc_feature (455)..(455): n is a, c, g, or t
  misc_feature (485)..(485): n is a, c, g, or t
ttcccttctggccaacaattggtatgttttggccacaatttcttgctgtccccatttcactgaactaaatagcttaagatatgcttttgggtgcttaaggctttcgtatctaaaatgccagagcaattctttgtcctctgctgtgagagggttaagtggatcagtggctatgatcgcctccanttnnttnnnnngctggtngggnannnnnncncnnncccggtcccctttccgggttcaggggtgggctgatgctcaggcagggntatcgggtggcagtaattgtccagaagaatggagatggacattgagttctccttgtctggggnnngntnnnnnnntnannatntcagcnttgnnnnttcctnggtcttctcccttcccagatatttgccacatgtggaggacntattttccacggcgcaggaggaaacggtggtttatcagcagcaggntcacataatagagaagttgaactatgcccntggactcagaactgggggac

SEQ ID NO: 654523 - DNA, 210 bp, Homo sapiens
catcaacataccagacatattgacagaaccgacgggcacaaacgaatccctgcaaacacaggtagtcaacttattcgaacactcttgaggaggtgagagagttggctcgtcgcgataaccaggacagtgcaaagctgaaatcggccaggaagcaggagctgcaagcccaggtagggctgagcccaagggcgggaggcaccgggcctgcca

SEQ ID NO: 654524 - DNA, 689 bp, Homo sapiens
caacatcatcggacgggccctcagcacgagagggacatgaccccgcttcagcatccccatcactgtcggcaactggagccattgtgcgcatccggaagccctccgccagatgaactgcagcccttcgccccagagcaaattggaggaggccctcggctcttccacagtgtccccgttggaagctgccctgtccggtaccctgtcaggggtggagggcttcacccagcccggaggacccggagatgctgagccgcctcgagaagccagctccagcccgctttgcccttggctccccggtgtctgagccaccagccatcatcaaggacttcccccagccaggaatacccggagcacgccatccacaaggtgctgcagctcatctgcggcgcggcgagatccagcatcgcatcagcgcaaggttctctaccgcctcaagtgagtcgcgccgcctcactggactcatggactcgcccacgcctcgcccctcctgccgctgcctgcccttgaccatgttgctgggacctctgcctccccactgcagccctcgaacttccccggcaccctcctttctgccccacgaggaaggagctgtagtgtcctgctgccttctgggcgcccgcctctagcgcggtttctgggaagtgtgcttttggcatccgttaataataaagccccggtgtgttcaggta

SEQ ID NO: 654525 - DNA, 938 bp, Homo sapiens
gaggcgcagacgcgcgggcgggaagatggcgggcatggggttcgaaagaccgtggaaccttctggagtattacaggagatttcgtgagaagagaactggccgtcctggatggaatgagaacttggtgacacttcagaaccaccaactgtcaacgagtcggttcaattagtaccgcagcatggtctctgctgttacgtgaagtgtgcggaaatactacacgtagatctgtgggatgattacatatgcagaagttctgcagactaccaatcaaacagatgtccctctgatagaagggagtatcgttgtgtccgtaagtgtggagtctacactacccctgatgttcatcgagattccggtctggatctccggggagaagaggcccaaggtggctagccgaattcattgcatgatgtcattgaaaattcactagataattcatgaaagaggacttatgcatttctccaggaaagctgtctgggttctatactgtgatctcatttgcctcgactacgatggctacactatttggatgtcctgcatcatttggtgtaggtagcgagtttagaaagtgtacagtctggctgaagtttctatacagtgcagaactggttagccaggagtaatttagagacgaacagtttttgcattttgaaccccggtcagtggattcctgcgggttggggaccttggtttattgccaccggcgagaggtactgccgggctcaggtactcaaacgaggcaggggggggcagaatcctgtgcggccaccagggaagggcgagcagtactcattgagacgagccgcacgtagtacaccggtggagagacaacacctttttgatacgacgtctcttacccacgctcaattaccagcagcgccggaataaaatcaaaaaacagacaataggacaacaaacaacacaggacacacacgaga

SEQ ID NO: 654526 - DNA, 307 bp, Homo sapiens
  misc_feature (171)..(171): n is a, c, g, or t
aagggtctctggaggaaagggtctttggctgttccaagtctctcattccaccttacgagaaacacccacaggtgtggaggggcaacccagcccttcatatgcaaagtgtaatatcccagaagcttctctgtgcagttttaggctgcaagtgggtgaaggaaagttatatcnttcattccgttggtcaagaaatttactggagtgcctggggcactcgacagtgctgtaatccctagcactgtggggaggctagaggcgaggaggatggctctgaacccatggagttcaaggaccagcctgggacagg

SEQ ID NO: 654527 - DNA, 447 bp, Homo sapiens
gcatctttcctagttgtgtccatttcccctccctggcttctcctcctgcagcatctttccctgtagttgtgtccattccccctccctggcttctcctgtagcatctttcctagttgtgtccatttcccctccctggcttctcctgtagcatctttcctagttgtgtccatttcccctccctggcttctcctgcagcatctttccctgtagttgtgtccatttcccctccctggcttctcctgcagcatctttccctgtagttatgtccatttcccctccctggcttctcctgcagcatctttccctgtagttgtgtccatttcccctccctggcttttcctgtagcatctttccctgtagttgtgtccatttcccctccctggcttctcctcctgcagcatttttccctgtagttgtgtcctttccccctccctggctactgctgaa

SEQ ID NO: 654528 - DNA, 1874 bp, Homo sapiens
  misc_feature (692)..(692): n is a, c, g, or t
  misc_feature (945)..(945): n is a, c, g, or t
  misc_feature (1196)..(1196): n is a, c, g, or t
ttgagttccttcgctactacactgggatatggagtgtagtaatgacaataagtcggcaaggttacgtgtgagcgaactatcgcgagagacagttcactatctaggcgaggtcatagtacgctcgatgtctcgcacttgtgcaagccattgccgcacggacttgttacgtaagtcagagctgcgcgtgacggcgcgctggtcagtgggcacccatccgagtcatctgaccctggtcccttattcattgtaggtcagtctcgacaccactgtgataccccgcggtgagaacgcccagggtgggaccggtccacactggcttgtggtacttagtcgctagccccagtagcgtgtcacctcggtcaccaccacagaggtcgctggttgcatgtgacattaacgcatagtaaaaggcatacgggcgaatcgtcagtagcaccagtattggctgggcaaacctaacgttgagtcctgtaacgcgttaaccatgcgactcagtaattggatggtctccatcagcatttggcgtgctcaatacatcggaccacgtttggaacgggccacgaccccgaatgagaacaacaggccgtgagggtccctcccgtgagcaaaatgttgccctctatggtgatgacgccgatcggtaccacgtttaacgtcggagcagcagagaaagtcctgtggtgacccccctncgccggttgcgaaaaaagcgggaccgccgtcgaacggaactgcgactgtgggttggggcgcctattccaagaatctggtgacgggcgaggttgaaaccccaggatgtgtgtactatacagtgagccaatgtgccctctacactgtgtttccttgcgcgtggagatacggacattgggcccggctaaaaagaggctaggagtatgtgggaacgccactaggttataatgtacggacccatatggtccaaatganctatgcgctggcgcgataggataggtcagcagtaggactggcagggagagtagatacacgaggtgtggtcgagttacggacgttcgatacttgggagtggggtattgatagtttagttaaatttggttaaccggaacccatggttatgacaaacatatattaacggtgggtggaggagagtcacaaaagaagaaaagcagtttgagaccaaggataagagatacgggaggtagctaaggtatggaaaccanatggggttgcatatgagacaagaagccggacaggagagtggtacgtggacgggtgacctcaagcatcagtacatgataacaataacgaagttactaattgagcagatcggtgcgtgaaccccggaagcaggtgcgagaagacgtattctgatgttgggacctgcccggaaggtgaatttggcaaagatgggaagaattgaccggacacgtaagaaggttacggtgtggggagtctagagagacacattctcggtgttggatgccattggccacatatgacgtgcggaacagtcaggatcagcacttttgtagagcggtacgagggtggggcgaaaaagcaaggacaacgtggggacatataggtggtgaaccccacttgtgggagaaatgaacgaggctgcacaggaggcaagcaacacctggtgttgaagtagttaccgtgaaatggagcaatagtcgctgaaatgcaatgagataataattagacgattgttgcccacttgtgaccaaagttattgtagcgcgagaatgagcaatctcacaacgcagaaatgacgttgggagaccagaatagcgatcgatagagatgtatgtgtataccaatgatatgacaaaagtaggtcactaatcaagatgtgtcacacaatctaaacactcgacgtagaagtctaagttcac

SEQ ID NO: 654529 - DNA, 332 bp, Homo sapiens
tgagtcggtcctgtgtgtagcacaataaggaagggtccccaggtcggggagagccccaagttgagaacaataatgaacaattatcgtatgaacaatagttagaaacagctaatcacaaacaacctgcgggcacaatgacctcattccacacgtagcacccttcagcaggaccctataaaactttcctccagcccttgcctctttgcaggtagccccttctctgctgagctgcccaatgcaacatattttcacaatttctctaataaatctgcccttctttacctacaactatcttggtaaatggctttaccacctgcaaaactgaccctagg

SEQ ID NO: 654530 - DNA, 642 bp, Homo sapiens
  misc_feature (39)..(39): n is a, c, g, or t
  misc_feature (81)..(81): n is a, c, g, or t
  misc_feature (243)..(243): n is a, c, g, or t
ccgggatcagaaatataacacatttttttgcatgcatgncaaatgagctctgaaatcttcccatttgcattctggtcaagnggcttgtcctattgcactataagctcatctattaagtgcaaggcagcgtgtcttaagtatgtttgatgctctgaagtgtttttattttgtgaatgcatatttgtattgatatttttttctgggatagtggattcagaacacacttgaaccttttttatcgtnttgtattttcatgaaaataccatttagtagaataccacatcaataagaatatgctacaattttaagagggagggaagggaagtttttttttattattttttctaaaattttgtatgttaaagagaatgagtccttgatttcaaagtttgttgtacttaaatggtaataagcactgtaaacttctgcaacaagcatgcagtttgcaaacccattaaggggaagaatgaaagctgtccttggcctaggtagaagacaactgcttcccttactttgctgagggtttgaataaacctaggacttcgagctatgtcagtactattcaggtaacctaggggcttgtgaatcctgtacgtgtctcatggatttggcctagcaaaggagaccttatgcttactcctc

SEQ ID NO: 654531 - DNA, 359 bp, Homo sapiens
gaaatgaaaaattgatatattggacttaatcaaaattaaaaacttgtactatcaagaaagtgaaaagatgtccgggcatcggctgtcacgcctgtaatcccaacactttgggaggccgaggcgggtgaactgcctgagctccagagttcaagaccagtctggccaacatggtgaaaccctgtctccactaaaaaaaaaaaatacaaaaaattacccaaacatggtggtacatgcctataatcctagctacttgggtggctaaggcaggagaatcgcttgaaccctggaggcggaagttgcagtgagcggaaatcgcaccactgcactacaacctgggtgacagagcgagactctgattc

SEQ ID NO: 654532 - DNA, 342 bp, Homo sapiens
tgagagctttgagagggtgttgccagttttaacgctgagatggcccatttggagccttacagaactagaccagaagacattgtggataaatctgaactcacttcctgtgtgtaacttctaacttcactggttcctcccatctgaattggcccacatgcttgctgaagagacttgtgatcttcttctaagacagtggttgtgtatttgggtttttttacaaaagaaaaaaatgaaaagcacacaaagaaatatgacttattgctatggttggagaaaattcagggtttcgtcatggatctctatattttctccacatattacaaatgtaactacttaatgaaa

SEQ ID NO: 654533 - DNA, 162 bp, Homo sapiens
gcacacacacaacctccccccacccccttcttcatcagccccaagatgtgaaaatgacaggaagtccaggattggctctggcactatatagctctagacatacacttcagcccagcagaacgcactggatgaccaggctcatctacaccaagatccctgata

SEQ ID NO: 654534 - DNA, 1113 bp, Homo sapiens
cagagcccaggtctgctgagaggccccagtgggactctgtgctacacaggacttcatcccctggcaacacccttagcctgctgcaggctccttgtgccttgccgttagataaatgtagacagggaattgtgtgcaacggtgccctagagactgaaaacaaggcctcagaacagcctgcagggtttgacacccttcagaagtaccccacacccaatgggcattgtgccaattgggaggctgggaggagcaaggactcactgagccaccagctgtctgccacaagctgtagctctgctcacttgtactcgaggaacttgcaccacaagtggctgaatagccactcagggaggccatccactaccagcagccctgaccagccttcccgcagccacctggatgacgatggcatgcctgtgtacacggacacaatccaacagcgcctgcgacagatagagtctggtcaccagcaggaagtggagaccttgaagaaacaagtccaggagttgaagagtcgcctggagagccagtacctgaccagctctctgcgcttcaatggagactttggagatgaagtgacttcaatccccgactcggaaagcaatctggatcagaactgtgtgtctcgctgcagcacagagattttctctgaagccagctgggagcaggtggataaaccagggacacagagatgactcgttgggtaactggaccacctgtgttggccactggtatgccctgtgacaggggccttcggtccgccagttggaagcccctggcggactggggggaggttttctggcccctgttgtaccccagggtccggtccctacccgtcttgaaacccaccgacggggaagcctggtcaataagaaggcctcctcctaaaagagcccccttggaccgtcaatggagaaaaccctgtcgtagcgcaaaagaagaccagaacagggtggagggaaaagacggtgctacagacacacacacgtggagtgagacacaatcatggcgcgacggaacattgaatacggcaagaacataagccacccccctcaataaaaagaggggcgagagtgaccaacagtcaagacggaaatcctgacgacagctatcact

SEQ ID NO: 654535 - DNA, 146 bp, Homo sapiens
ttggaaagtcctctcaaaaaggatggctaaaaacaagcctatactgtgaagactgggataaatacctaactctttaatgcccaggtatcaacaaatgtctaccagcatcaaggacatccaagattacattacctcaccatatagac

SEQ ID NO: 654536 - DNA, 194 bp, Homo sapiens
ccggcttcgtgtactgcgctggtgagtgggcgacaaattcatccgctccggcgagtgcaagcactgtgctggtgatctggcactgaaacgttgagccgcatggtcgactggaacgatcgcaccacctgcgtgctgttcggcgatggcgccggcgctgtcgtgctcaaggctgacgaagacaccggcatcctcag

SEQ ID NO: 654537 - DNA, 145 bp, Homo sapiens
gtaactatgcactcaacaatcctcaacagagggtcgtagtcgatatctcaacgtttggtcagggtagtgatcaaaacgcttactacgacattgacaacctcgctggtagtgacggcgattcggccttcatgccggcgctgtacgc

SEQ ID NO: 654538 - DNA, 395 bp, Homo sapiens
aaacccagaggaagatcatatttatatatttattcaacattcatgtatgatatttagatttacaaaatgctttatagtgtaacagaatgggcagaaatttttacttgggcttataattgtcttttctttcatattcatttattcctttgatttatataatgtgttctctgcttggtcttctgagattacgtacaatggtaacaaatcgaaaataatattaataaaagattattttgtatcactcacagggaaaactgactggggccatgcgcctctctgttctttagaaacgttatgcgagagaacataatattgtccccagaatactgtctgtaatgccggctatgcttattcgtggtgctttaaaaataaatttaactcctgttcttcattta

SEQ ID NO: 654539 - DNA, 226 bp, Homo sapiens
tgtgaaccgctcgcgcgggtagttttgtcaggtctcctctgaaaacggtgaacacagcccctccttcatcagattctgcatcttctgtgactggcctttctccaggacactaggtcccatgtcatttagcccaacattgtcttgcgtctttcataggatggcgggcaagcagttaagggtcatcatcccagagccacatactaaccccagactgggcccctgggtt

SEQ ID NO: 654540 - DNA, 679 bp, Homo sapiens
cgggggggtgttattggggccctcttgtttcaaaaaaaaattcccccaccccgcgggggggggcagagggctctttttttttttacaaagtggggggtccccaaaggggggggggggaaaaaaaatgtccccccccctcttttaaaaaaaggttgttttttaccaaaagtttcggccaccggggggggggccccctccaccaaaaaaaaaaattgttttctccatgccggggccaaaaagccccccccacccaaggggaacccctctggggggggcgggccgcataattttgtttgggggggggggaaaaagccccgccccaccaaacaaaagtgtttttttttttgaaagggcgccaaaacaagtttttaaataatgaggtcccagatggtgtggaaaattttgagggggatcaaaagaaaaaggcgaccttattggggggacttctctttatataacttgaagaagttccccggcgctggtattttatataaaaaaaacgcccctaagaagtttttgttcccgcctcagataaaatatagttcccaaagggttctttcacaaaaaacttaaacataaaaggcctcaggccgtttttgcctttcacaattcattctttgcagctaattaagccgaagtagtgaaagtgtcaagctgtcgcaaattttcataaagttct

SEQ ID NO: 654541 - DNA, 422 bp, Homo sapiens
  misc_feature (287)..(287): n is a, c, g, or t
taggtttttcacttagttaactatttattgagtactcagaacgcactcggtgccagggctaggcactgtggatgagtagggagtgggcgagacagggacgagatgagcagggtcaaggccagggggtcccggggcgccgcgctcaggctcggggtgatccgcacggtgggagcggggcacggtgatcgcggcggctctggggaccccggcctgagggaggctgcctgtcccaaggagacgcccatcgggccggacccgaacgcctcggagaagactcccagcgggangacgcccatcgggccgagacccgaacgcctcggagaagactcccagcgggagagggctcctcggccgtcgcagggcccagccgctaatcccgccggccgcaagaagcggagaactcaccggacaccagcactcgc

SEQ ID NO: 654542 - DNA, 138 bp, Homo sapiens
atctctaccgggctcgggagtagcatcctcaggagtagtgtagcgagcaaatactggaaagatagtccatcaatcttcgattatcccagacaaggcactttctcatgcgagacagatacttgcttgtaagagagaaca

SEQ ID NO: 654543 - DNA, 1218 bp, Homo sapiens
gtgcaggctgtggagactcccttcccggtggtgagtggggcccccactgaccgcaggtgccccctctgcctccaccccggttcctggccaagaagctggagggggcttgggcaaaaagagggagaaacacactcagcgtgttcttctctagctctgaaatagaaaatgtctgctagacggacgcgagtgcctatccagtgacacccatggactagatggcagactagcccccgagaggttcccatatcgtggacatcctcatcaggaacatgccttctaagctggggcgaggcggtaccttcctgggcgaacgctacacgagatggtcacctgcgaacattagacgatagggatgccccgcagaggatgcgcacagctccgcatgagcgcgcgcatctgccagtgtagcgcactggcgcgctcaaaggtagccctgcgtggcctggcgccacgcccctaatgctcaccgtggctcctagagcgcagaatagcctcctctgtgccgtgcccttgcgcgagtagcccctcaccgcgtccccctccgggatccccgcggtggcgtatatcccccgtaggcagggcgcagtgcaccccgcaggcaccgtgcactactgcggccttgcccagcccgctccatccacctggccgccctggccttcccccccacgccagttgccccccgctcggcagcttcttgcccgcacggccattgctgtcgcccctctgctttcaccccctctttccccccctggccagagccacctgcgctcgccccgggccctcggcggccccacccagcggccggctgccacgccacagccttgtccctaccacaggcgcgctgcgtccccctgtggcacgaacccatagcagaaacctcggcgggccttggctcacgccttggcgacccctctccccccctctccatagtcccagctgcccctctctgcttgggcggcccccccttccaatcgccgtcgccgtcgcccccgcggcgccttcccgcgcccttgcccgccgtcgtcccccagacccccgggtccggctccccccgctctcacttcaagcgcacgggcacgtggcccgcacgccccccccgcgtcccaccatctgcaagcccgctcctctctcgctcgcagcccacaactctgccccccccctgtgcctccgcctgccctcagctcgccttgcccccgttccctcgcctgctccacctca

SEQ ID NO: 654544 - DNA, 384 bp, Homo sapiens
aacgctttgccgagcaattcgcagaacggcatccggcagttgcaaataggatttttaacgacttagggttgcttgcggatttacttgccttagcctctttcagcccgtggcgcgatcaacgcttctcaggtatccggattacgctgtctggttaaaacgccatagaaccggcgagggaatccgcggtaaagacgagctgctggaatcgcttgcccggttttcattgactaattcgactttggatccgtcggttctgctttcccgtttcaaacatcgggaatatctgcgtatttttctgaatgaccttcggggcagaactacaattgccgaaactacggaagagctttcgaatcttgcagatgcaattctcgaatacgcgttccg

SEQ ID NO: 654545 - DNA, 763 bp, Homo sapiens
cggacgcgtgggattcacctttaaatgaaggaaataactgagtatacaacagacatgcatgtgacctggaggacactatgctagtgaaataagccatgatctcgacttggatatggaatcacaatcttgaactcacaagcagagtgtagataggtggtttgcatggagtggagggaggggataaatggagagatgttggtcattcggtacagcagtttcatgcttaacaccaggagatagtacgtttctggagacctgtttgtgcagcagggtgactatgattaagatgtatacttgaaattcggtaggagtagagtctaaccaggagaaatgaatatgtgaggtgatggatgtaattagaacttgattgtgcgtaaatcagtcttacgcaatgtgtacattatatcataactatcaacattgtacaatagagttactcataacagtattttaagtcaacttgaaaagatatcggaattctagaaaatatgataagagtcgtgttttgcaagcatagtaacagatctgatatacttaatgacgcgaatggaactggtacatttggaacccaaatgttggcatacctactattcgaaaacctgccacataaatacgttgctcatggaaataacaactggtctgaataaacaaaaccatcacttgagggacgaaaacacagaagtgtaaaaaggaatcaatgagttagggacagaattgttagattggcaatccaacagttctaaaaatgacaatttcacagaaa

SEQ ID NO: 654546 - DNA, 481 bp, Homo sapiens
  misc_feature (52)..(52): n is a, c, g, or t
  misc_feature (221)..(221): n is a, c, g, or t
aagttggaatgaagttttgaattaaataatagaccttcaatgtaagcccatnagtcgaaatcaaaaataaacaaaatgtctcctatcaacccctggcttaaagtttgcctgttccttaaactttctgcaactggaagcctacaagtagatgcactttggggtctggctttttcctttttttctgagatggaatctcgctctgtcaccccaggctggagtgnagtgacaggatctcggctcactgcaacctgttcctcccagggtcaagtgattctcctgcctcagtctcccaaacagctgggattataggtgcccaccactattcccagctaatttttgtacttttagtagagacagggtttcaccatgttggccagactggtttcgaactcctgacctcaggtgatccacccgccttggcctcccaaagtgccaggattacaggcatgggccactgagccatgccaggtctggctttatt

SEQ ID NO: 654547 - DNA, 186 bp, Homo sapiens
gtatgtgatcttattaaaaatccttccccttcttcttttctgccattccactggcttttcctgataccctcactcttcccgggtgacggctcagtgtgcttgaaagagcatgactccgtgcacgagaagggcctagggtaaaatccgtaattctaatgtttacttgcttaatgatcttcgagcaag

SEQ ID NO: 654548 - DNA, 840 bp, Homo sapiens
gattgatggtcttgccggcgcgtggatcatcgaaaagatggactaggagatgtgagagaccattctgctcgttgacctggtgtctcagggtggatgcatgaggtgtgctggttcccgatcgcgtttacaagtactttgatttaattcggaattaggtgcatccccgcacgagagctgtgcctccgtcgctgggcactccgcgtgcgtcttgcttggcctttgacgtccggtcagatcccttcctcggtgtcgttgtgcgattgttagccgtcgtcacgtatttggttgtctttgcatgccctgctggttcgcgcaactaggcaggcacgtgtttgcgcacgacagtgacgtcggatgctcgacgtaccgtgtggtggcggcgcaagggggggcggccgttggaggttgcggtccagattcgttggggctggcgcgctgcagtcgtacatctagttgcatgtgcatgctggaggcccaccttgagggcgttcgtcccactgcggttgagaatcgcgaggattgggactgctgtggtgcgcctgggccgcgtgtgtgcgtcgaggatgcgtagcgaacaaatgtggttgtccccttagaaatggggaggcagcagacgccgatagttgagaccgtggtggctaccgaatgtggtagcacgccctatgcggggccaagcgtcgtgcagcgccccaggcgatgagcacgtctgtactgttttgtagcggctaggaatggaagagccgtcccgtaccggggaactttccttttctttccgaggaactcggccctgtgtaatttaaattcgagaagtattaaacatttgggagtagcgcgtagtgc

SEQ ID NO: 654549 - DNA, 159 bp, Homo sapiens
cgggggggggaaaaatttttttcaaggggccaaaaggttttggggccaagggaaagttttttttggaaaaaattttgggcccccttttgggccaaattttttccccctggggcattttttacccgggtttagggccaaaaagtttttttatttttttca

SEQ ID NO: 654550 - DNA, 282 bp, Homo sapiens
cccagggctcgagagaggaaaacaagacccctgcgtgggtccgaggccctcccctcagggcgggcaccaggcctagaggcgagtggaagctcgaacccgaaacgccggattggaacggcgagaaacagggcccacaccaccacgacatgcaaccgtcccagtaaaatgcagcagacccagtgtgtgggaagatcctggtggcccaggcggatcatttatcccatggaatgtggattatgatgtaacccaaaaggaagggaaaagaactagtgttctcgctga

SEQ ID NO: 654551 - DNA, 1008 bp, Homo sapiens
tggtgggtcggccttcaaggacgataggtgaccccctgggtatcgctacacattctcccttcgcccatgtctctaggttggccctgcgttctaatttggtgcctcttggcgtctcctaacgttccgcagggtgccccaaagttgcaagcctcccccgctgcccttcatctaaccaactggccaacttcccgtttcgtcctttcaaaggtccaacgcggctcacgtagtggccttcaccggctcttccccgggtctcttgtctgatcagccttgacaagtcccgggggatcatgaatggtccagcctgcggattctgcctcgacgggaccagacgaagcatgcgctctgccgtatcatgggtccctcgccgtccctaggcccggcaccctcagcaaagccagagtaccttcttgcagctatttgtaatcgtgcccctcatcgccaatcgccagggaggcactgtagtcatctctaggcatcagaggctgcgcacccagccaggccagcccagcaccgcacgcccatgcacacgctcacactgggagccatcatggccgcgacatgaccgagaggaccaaggcacataaagggttaccacgatgtagcggcaatgtcaccagcgcccatggatggcacaggcctcccccgttgctggagacacagcatgcgcacgttgtcagcctcatgttgtggaccatgatgggcgcaccacgcacagtgctgcactgctgagaactcaaggtcatgcgcagcctcgcgaccagtctcgctttctctgctaatctgcgctcaatcgcgaagaactcggactgataactcgggtgacgtttctactggcgctcagtgcacacagttacacatctccgcctcaccccgtgtggatccagatgaagcctccaggaccccaggctctagctctgacctgacctgcacccccctcgtcagaagtacatgaggggcgcagagatgagcacacagctttatacacggtcggggggcaaaactgaa

SEQ ID NO: 654552 - DNA, 152 bp, Homo sapiens
ccaaatgtaattacattatcttggtaaattaattagaactatgaaatgtataataaggctttcagtaaggcaactcataattattattcaggaagctgtctgcatcattagtgatgctgtcttgtaaatgaacacccttctgtcgtcttctc

SEQ ID NO: 654553 - DNA, 350 bp, Homo sapiens
cccctttttttttagggggcccccaaaaaggggggggttccccttttgtttcaggaaaggcccttttcccccggggggcggtttttaactttttccccccaaggtttttttttttcccccccccccaatagggccccgggggggggggggtggcccaaggcccggggaaattaaggccccccggtttggggtgggccttccttcccctttcagggaacccccccgggggggcctcccccccctccccggggggccccccccttgggggggggggtttggggcctttttttccccggggggggggcggccccccccggccctttggccaatgggggttttcttttttttta

SEQ ID NO: 654554 - DNA, 399 bp, Homo sapiens
gcccccccccaaaccccccccgggggccagggggccatttggggagccccccaggggccttagcaaaaaaggggcgggcgggcccccggccccaccaaaaccaaaacccggggattaacaagggggcccccctgggggggtggggggaaatttccccccccttttggggggcccgggaaggccctgtaacctttaaaaaagggggatcccccccggccccccacccccccaaagggttttttttgtccccgggggttttggggcccaaagggggaatttttgccttccccccgggggggttttttttttttttttttttttttttttaggcccaggaaaaggtacttttggaagccgaaaaaaactttccccccaaaaaaaaaaaagggggtgggtgga

SEQ ID NO: 654555 - DNA, 880 bp, Homo sapiens
atagacgctgctgcctttaatcggccttggtcctcagcagggtccaaaaagaaacaggatctcgataagctctatgagctgacagtccaaagactcggcgagattatgaaccagttgggccccatcaggccgtaatcaacctcttccaagtttctcatccatagaaacgcggtagaccagtcagcacccctccacaaggctccatggccaatagtactgcagtggtaagagataccaggcactcctggggcaggaggtcgtcttagccctgaaaacaatcaggtattgaccaagaagaagttacaggacttagtaagagaagtggatcctaatgagcagtgggatgaagatgtggaggacgatgctgctgcgagattgctgaatgacttgtatcgagagtgtggtgacagcaggctgtcagcttgcgcggcgatcgcagtactagcaccctggaggtgcaacgatgtccagctgcatttagagcgcagtggaacatgtggatccaggatttggctctgaagaaatccgacctagaaaaaaggttgccacagaggcgcacaaacagagaatggcatgatccggaggacaacccagaagtacacaccggacaagggcccgtcatggcaggcactgatttggagatactgagcagagaccagccagtcatcccggaatcactaagaggatacagaaaggcaatattaataacgggcacaacattcatatgaggaggtgcaagagaaggcgacccacggccttcaggcccaaaagagaggactcagcaaaaagggcaacacagaacgcacgcatgcggaacaacacaaacagaggcccacaacgaaacacaaatggaaaacacaaagcgaacgagacaccagcg

SEQ ID NO: 654556 - DNA, 136 bp, Homo sapiens
tctctggatctgaaagtgcttgaggtcgccgaagaacgcatatgatttgtgactcaagagttgacactggcgcgcattcctgtactcgttaccatccatgtgcttacgccttatcgatgcaagtatcccatgtggc

SEQ ID NO: 654557 - DNA, 375 bp, Homo sapiens
  misc_feature (105)..(105): n is a, c, g, or t
  misc_feature (108)..(108): n is a, c, g, or t
  misc_feature (238)..(238): n is a, c, g, or t
  misc_feature (317)..(317): n is a, c, g, or t
  misc_feature (337)..(337): n is a, c, g, or t
  misc_feature (365)..(365): n is a, c, g, or t
agtagagatggggtttcaccatgttagccaggatggtctcgatctcctgacctcgtgatccgcctgtctcggcctcccaaagtgctgggattacaggcgtgagcncgnctcccagcctaatttttgtatttttaatagggacagggtttcaccatcttggctaggctggtcttgaactcctgaccttgtgatctgcccgcctcagcctcccaaagtgctggggattacagggcgtganaacccgcggcccagccggttttgttcctcttttaatttgtctagtgtattcttaggccttcaaagggcccatggcaaantgtttggttccattaaattnattttaaacatatttatggaggggtttnaatgttcctt

SEQ ID NO: 654558 - DNA, 357 bp, Homo sapiens
tggagattgggtttcgctctgttgcccaggctggagtgtagtggcgccatctcagctcactgcaacctctgcctcccaggctcaagccatcctctcacctcagcctcccgagtagctgggaccacaggcatgtgccaccacacccagctcatttttgtatggtttgtaaagatggtgcggggggtctcactttcctgcctaggctcgtctcgaactcccgatctcaagcgatctgcccacattggcctcctaaagtgctgggattacaggtgagagctacagcacccagcctacaacttctttattatttatttcttttttcagaaaaatgtagtggagacgtaggagatgatgaaa

SEQ ID NO: 654559 - DNA, 187 bp, Homo sapiens
ggtgttgagtggatgacaagcagaagcagttatgatgacaggtgatagatccaaaataatgccacattgttaacatgttccatttctaaaccatccttaaagaagaatcatatatggaggtcacaccactcctcacgtgtagtccaaatagcagcaaccattgccactcgtggattcatagttttca

SEQ ID NO: 654560 - DNA, 364 bp, Homo sapiens
aagttataacaagatgttggatatatatgagtattccgatcgcgaaaacagaaatgccctgcctactacaaggacagactgatgggacattatgcacctggtcaacattagcttataagcagacgatgctgtaaaaactaacggatactctgatatttatagtaagttttagtactgatctccttttccagtgccgaacactcctggataggaactttaatagcgtagcaacgaaatcctatatccagtaacctgtaatataatagaagaaaaatacatccaaataaagactttattattaacagaccagatagcatcagacatcctgtgactgttctgattatcagaatgtcttaactttata

SEQ ID NO: 654561 - DNA, 160 bp, Homo sapiens
gggaagaatagctaatagatgctgggcttaatacattggtgatgggatgatctgtgcagcaaaccaccatggcacacatttaactatgtaacaaacctgcacatcctgcacatgtaccctgaacctcaaaatgggaggcagaaaatgtatttttaaaaag

SEQ ID NO: 654562 - DNA, 440 bp, Homo sapiens
  misc_feature (44)..(44): n is a, c, g, or t
  misc_feature (146)..(146): n is a, c, g, or t
  misc_feature (366)..(366): n is a, c, g, or t
  misc_feature (374)..(374): n is a, c, g, or t
  misc_feature (430)..(430): n is a, c, g, or t
  misc_feature (438)..(438): n is a, c, g, or t
ggccttggagtgcttcaagtagtgtgtgtctggcatatttaatntagcataatggcctctgggatcatccattttgtggcaaatggtgggatttatttatatattagggctgaataatattccattgtaagaatatacactatttncgttatttactcatccataaatgatggacattaatgttgtctccatgtcttggctatagtgaataataccataatgaacataggagtatagatatctttccaagatcctgatttaaattcctttggatatatactgagaagtgggattgctagatcatgtagtagatctatttttaattttttgactgatctccatgctttttcctagtgactacaccgntttacatncccatcaatagtgtacaaatgtttcctgttctccatgatccttgccaacactcatngtcttttnaa

SEQ ID NO: 654563 - DNA, 212 bp, Homo sapiens
tactcttgcggaagtcggtcgaaagttagctgatcatattcttagggttcatctccacctgtccatttcaatattcatctcttctgtatcagcagctcgggacaagaattctgccatcagtgcttcttccagatctcatggcgtaccttgctgtactcgcctcctatccctggttaccctgatgtcttcactctgtgacaactaacaagcct

SEQ ID NO: 654564 - DNA, 308 bp, Homo sapiens
tcctgccgggctttgtgctcctcaccacctcttgctcagcctatatacctgcatcttcagcaaaccctgatgacggctacacagtacgcgcagtacccacgtaaagacgttaggtccatggtgtagcccatgaggtggcaagacaatgggctacattttctaccccagaaaactacgatagcccttatgccacttaagggtcgacggttggctttacgcacgtacacctgcggacgttacagtgcttaagttgaacacgggccctggagcgcaaccacgggtaccgacgctcgcatacggtcctcatg

SEQ ID NO: 654565 - DNA, 202 bp, Homo sapiens
ggatttgaatagacggggttcaccgtgttgcctaggctggtctcaaacccctgagctcaagcaatctgccctccttggcctcccaaagtgttggatttacaggcgtgagccactgtgcctggatatgaaaaaagaaagaaaggaaagaaggaaagaaagaaaagaaagaaagaaagaaaaagaaaagaaagaaagaaagaaa

SEQ ID NO: 654566 - DNA, 287 bp, Homo sapiens
ccgcgagaaatcatatattgtagagtttgcctaacccccaccttattatctaagttacagtaggtgggccaccccttaaggagttttccattattcctttcaaataggggaaggaagatttgtacttgagaacaatctcttagcttcctcaattcgacagactcattattctccgctatacattaaaccatggggacaacaactcgaggcagggcccaggcccatgtttcccctatctggagccgcttgactatacactggccgtcgtataacgacaacgtgactgg

SEQ ID NO: 654567 - DNA, 116 bp, Homo sapiens
cccttcttccaaacgagatgctgctggtcctgctctcagtggtccttctggctctgagctcagctcagagcacagattatgatgtgaactatgaagactttactttcaccatacca

SEQ ID NO: 654568 - DNA, 1048 bp, Homo sapiens
  misc_feature (144)..(144): n is a, c, g, or t
aaaagatacgtctaggtacgaggcctggtgttaatcggccgaggctctgtcctcgttctccgcggctccacgccctcgggcgccccgacatgctgcgcctccgcggcggccgcggctgcggccgctctgctgtacggcacctgngggcgccgatggacctgctggcgccggggtgccccgtgcgcggcctgctcgtcggcctcgtgcgccaacaacgccttcgccttcggtccggagctcagcagcctcatcacgccgctcgccatccagacccacaactttgcctgcctgtggccgcctgccgcctactaccgcagtcagcagcatgcatgcagcagcatgggcctggctgccccccgctgcagcctgccggcgcctgcccagcgcgaccctccccgccggggccgccgcagctccctcgccgcccttcagcttccatgcctgccgcgccgccctgtcccgactcgcccgtgttctgacggcgccccccaaggccccccggactccctgtcggcaccgcgacgatgctacctaaggcggctcccttgagctcctggccgccctcacgcggcctctgagtctccccagcctcgaccctggcctgcctgctgccaattcttccagcctgcttctccatctccgagcgactgagtgcaaagatggggccgccatgtagacggaggaaggggacagggcgggctacagaagattgtctggaagggaccacccccgtacggcaatcctctgccctttgcatagaggagtacacagagagagatagagatagttatgaccattggggcccatagtgcagacctgacatagtcaccgagcctgaagcaacttgagcactcgaaacacttgtgcccgagtaaggtaggcaccccaaaaccactaccattagtcagggaaaaccctcagtgatcaaaagcacaaacagtcatcactaagcgcagagcatactccaatacagaaaaaaaaaagcagcaaatattcctgagtaccacataattcacaacaccggggccgtagacacgatatgaaacca

SEQ ID NO: 654569 - DNA, 263 bp, Homo sapiens
  misc_feature (254)..(254): n is a, c, g, or t
tgattgctgtcatgcgtatgatacactaattgagaagctgatcatttagcagtctggtgtcaaaaggagagtataaaacactgatgttcaaagattaccacacaagaatagcttttgctgaacgctgagcagatggcagatttttgggttgtatgtagccaagggccatagagattaatccatttattataatgatatgagtatgcagacgagggtaaatgctgaggtaactgaacaggcagattatcatactngcagattac

SEQ ID NO: 654570 - DNA, 206 bp, Homo sapiens
tcctggacccctggaacctccttgttcagctggccagctgtctccacacaaggacttgcagctatgtggcatcctggaaataaccagtctgtctccacccacagagggcctgcatgcacagggactacaaggggactaactcaggcctgtggatacagctctgaactcagacacctggaggacccagggtcgatgtaggggagcta

SEQ ID NO: 654571 - DNA, 618 bp, Homo sapiens
tcacctacaatcctgagagaccttaaacaatttgccccaagcccgttcctgcgagaaaattgaaatcattgcgacaacgaagaactggagtccaaatatgtctcatctgaggtccaagagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaattagactagaaaatttaaaacattactctgaaattgtaactaaagttagaaagttgattttaagaatccaaacgtaaggaattgttaaaggctatgattgtctttgttcttctacacacccaccagttgaatttcatcatgcttacggccatgattttagcaaatacccatgtctacacagatgttcacccaaccacatcccactcacaagagctggctggaaaagcagccctaggcttccagtactgaagctccagag

SEQ ID NO: 654572 - DNA, 88 bp, Homo sapiens
cggcacgaggcgttccttctgcctacaaataaaaagtgcaggctggaatgatctcagtcacatttggatctttttaaacactgtatag

SEQ ID NO: 654573 - DNA, 1874 bp, Homo sapiens
  misc_feature (279)..(279): n is a, c, g, or t
  misc_feature (440)..(440): n is a, c, g, or t
  misc_feature (570)..(570): n is a, c, g, or t
gcagctaaatgtgtggatgacgccgagtgcatcgagggtgggcccgtgggccctggtggtcctggaattgagggagagctcgctggtggctttcctgcaggagctgcttctcaggctacgttggccctccgtggcggcctcgagggtcgcgcggcgccgatgcgactcgtgagtgccgggcgcctgaggggcggtcgtgaagcttccgctggatcgtcacggcgctgacggactcacggacagtggtattagccggcgtcgagccataggttggtgcgncgcgcgttgcgttcgaacgagcaccgagtgaataggactcgaacgggtcctctgggcaaggggaagacatcgtaatcgtcattttcctacgcacatgggcacgtacattgaatgagcaccaatcgacgcaagaagttccatgtagaactgtatccctgttnccttgggcgctgtgcctcttacctcttgcgaaacgggaattgtaaggaggtgtatgtcgcataggcattaaatcggcacgaaagatgccgaaggaaaaaggcctagggaacgcactgctagcaccggtgncccgagggccaggcaacctaatgggctatccaaaagggggacgagtttatcgctatctgagctgattttaccgcaggggagagactctgtagacaagactcggtgccccaattctgttaccaggggattcctaaggtgacgagtagtgttaaccggttgacgtgtccccacacggaggaagttgctttgtggccgccaaacaacagtgtcaccaattgcctccggtaggcgaagagggcgccaactctctaattactcctttggtggcctaagagaggcgtacttttcgcaacttacaggttgccccccccgggtttcgtcctggccatttgacgtgtggcattcagccatgggtgtagtggggggaaagcctaacagagacagtttcagtgttggcagagaacaagccaccgcacggaacctaggcagtagcttaacttcggccttttcgcccaagagatcggtttgggaaggcgcgagggtgaccaccctgggatttggccgtggtgcgccattcggttggtgtatgtcctctggagggtttaaaccggggcctcgtaactaattgccactcggtatggagagacgcccacaattggggtcgagccaacccgtggagggctaaggttccagggtcgtgcggccggacaaccccgatattggattgtccacgataagaggagacaccagtccaataggcgcgtccaattcgcagcttggggccttcgggttcaaatttgctgaacctttgaaactgtaggcctttacaacaaagaccgatcaatggggcccccgggtgacgggctctatggcaccttatgagcacaaacccccgttggggagtgcacgaacctatttctgtgcgccagaagggtgtccgaacccccgttttgggaattttgcccagattttgccttaacacgaaaaccttcatccaaggggaaaccctttgacacacacgcatgaatcttgcgttggtgcaacagtgacacgcaacttggtccttattcacgccacagagtgctcggcctaatcagagaggaagattaccacagtgggagacgactcttggattacaagaaatggcgacactcccagcgagatctctccgcggcgcaggcggcacttcgaggggttccgcgccacgtgtggacttcaccaccgaccaggggctgtttatcttcagacaacacaacctcaagctgggacttacagcaggtttctaccggttcttccatccagacgaaaacgacgcacgacatccgagaacaacatgctgaggggggcggagagcagcataaacc

SEQ ID NO: 654574 - DNA, 246 bp, Homo sapiens
  misc_feature (2)..(2): n is a, c, g, or t
  misc_feature (8)..(8): n is a, c, g, or t
  misc_feature (185)..(185): n is a, c, g, or t
gnctctantttttttgttgttgttgtgactgacagagtgagattccgtctcccaggctggagtgcggtggcccttctcggctcactgcaacctgcagcctcctagattcaagcgattctcctgcttcagctactcgggaggctgaggtacgagagtcgcttggacctgggaggcagaggatgcantgagccgagatcacgccattgcactccagcctgggggacaagagtgaatctgtgtctcacc

SEQ ID NO: 654575 - DNA, 207 bp, Homo sapiens
gagagggcaccacatgccacggagaagggggggggaatctttttgcattttctagggcactcctgtggcatacagaggttcccaggctagaggtctaatcggagccgaagccgccagcctatgccatagcaatgcaggatctgaaccacatctgtaacctacaccacagctcatggcaatgctggatcccttctccggtggcgtggt

SEQ ID NO: 654576 - DNA, 107 bp, Homo sapiens
tcgttgtcatgacgccacctgacccagcgcgagtcgctctccgatgagcgcggtgggtgacgtgcgttgtcgacttaggttgccgaggactgcggtgacgtcttcgg

SEQ ID NO: 654577 - DNA, 1528 bp, Homo sapiens
gggttatgttgttgttgtgtcgtccctgttactttgtttgtgttagatagtcggtgtacgtctccctctctctctctttgtttatgataagtgagggagggggtgtgggcgtatcgaagcagcccccctcgctgtctttcggttgcgccgaacatttgtactcccgaccgtcgacttcttgaattagacgtagggggtggtttgtttgattctctgccgtcagtaagtatatgtgttttggtccttccgttctttctttgttaagtgagtgcctgtcgttgtttttttgttcgttgggatgacttgtgttgttcctcccaacgacgcgttggtggtggcgccctcttcctgtggtctccaagcgacgaggagtagatagtagcgtctgtcgtccactatcttcgttctcatcaggaggggagatccaccagcattgttgtgtctgattttgttgactcacccacatcattgtgtggtataataacaacatgtggtgggggagaagagaaacaacaaccaccagctggggaggtggttgtgtttttatgatcaacagcgggagggcgtgctgcccgctgcatactggtggggtgtgattaagaggaggagtctcgcagcactatgtgtgcgcgtgttgtgtctcctactctgtgtgcgtctctttttagtatgtctcccccgggaggggcgcacattcttctcgagagtatttctctcctctctctcagtgtctctccacacagtagctgctgtgtgtgctctgtgtgggagtgtagtgtttatgtgtggggccaccccctggtggtctcatctctctgtggtgtgaagcacacgtgtctgttgtgcgacacacagatatactacctcacacactctgtgtgatagacaccttctgtgtgcgcccgctcgtctctctgtgtgcgcgccacgacactgtgtgtgtgtgtgcgcgctgtgtgcgcgcccaccgtctctctctgtgtgtgtgtgcgtctccctctgtgggcagacgagtgtgcgcccgtgtgggagagagagagcgccagcagagagctctactaagagagcgtcgtcgtgtgtgctctcccaccgcgtagttgtgtgtctgtgtgagatctctcctctccgctgtctccctgtgtgtggccagctatagtgtgcgcaccgccctcacgcgcgcgggtgtctctgggtagtgtgtaagagacctctgtgtgtgtctggggtgttgtgaatatgtggagagagagaggggtagagagagaggccacgccacacagaacctctagaatataggtgttccacacagagacactctcttgtgccccagcgagaggagaatatatttatgctcttgtagggctgctctgtgacgcactccacttacccacaaaagagaaaatattttctccccacccttttctcgaccccaggaaatcccatggggttaaaattatattaaaatataggtgtgtgtattatatatataaaaatatagtgttttctctccttgtgtttgggtgtaaaa

SEQ ID NO: 654578 - DNA, 244 bp, Homo sapiens
tctagaggatcccgttatcgccaacaccacgccggctattttttgtatttttagtagagacagcgtatcaccgtgttagccaagatggtctcgatctcctataggcacgtgctactaacccctggctaatttttgtcttttaagtagagacggggttttgccatgttggccaggctggtctcaaactcctgacctcaagtgatcctcttgccttagcctcctgaagtgttggggatacacatca

SEQ ID NO: 654579 - DNA, 413 bp, Homo sapiens
ctctttcggtctgctggtggctgagctcgaagcctgcctgcctgacagctccatttccgcgtacaatatcatctacttcgtaggcaatgtggtgaatgcctacgaggtttttgtcgataagagtttggcaatggcactctcgctgtatgtaggcttccagtagctctatcttggtatcgcccagcataaaaaaactggtgcttaccccttcgctggccaccgcctctactttataatggtctttgccgaaaagcttcctgaggagttcattggactgcccgagatgcttcatggcaatgccgatgtgttctacttttttgagcatgggtgttttctaaaagtacaaaaataagggatttaagttattttgctaaaagccaatcatttattacatttgtagcctaatttttatg

SEQ ID NO: 654580 - DNA, 631 bp, Homo sapiens
tgcccaggctgcagcacaatggtgcgatcttggctccctgcatactgcgcaccatgagttcaagtgattctccagcgccctctcccgagtagctgcgattacaggcatccaccatgcctggctaattttttgtatttttagtagagatggggttctaccatgttgtccaggctggtctcaaactcctgacctcaagtgatctgcccatctcggcctcccagagtgctgggattacaggcagagccgccatgcctggcctcttcactggtttttaatctctggctcatgggtactgcctctctcctgggtacttcactatgtgaagcttttcttccagcatccctaagcataaaccgtaaccctcagcaggtgttcctgaccagtttggtgggtggttaaactacacagcaagatgtatatttcctgtgagagatggtattatttaccacgtggtttgctcctaatagaacccatctcccataatagaggctgtaaattccaccaacttctgctcccagcctcccttacaactggaggttgacaagggactcatttatggtgaataagacttaagaagtctccaaggggctgttccccctcgtgatataagagcactcaaagagagaaatct

SEQ ID NO: 654581 - DNA, 322 bp, Homo sapiens
ttctttctgttggaggccgagcgggtggatcacttgagggcaggagttcaacaccagcctggccaacatggtgaaaccccgtctctacaaaaatacaaaaaaattagccgagcatggtggcacacgactattatcccaggtacccgggaggctgagacaggagaatcgcttgaacccgggaggcggaggttgcagtgagctgagatagtgccattgcacaccagcatgggcgacagagtgagacttcatctcaaaaaaagggagaaattatattgaggccagcctggacaataagaccacatctccaacacggactgggaac

SEQ ID NO: 654582 - DNA, 228 bp, Homo sapiens
cagcagtcttcaggaggagaatctgtaccaggaaagaaacccctttcggccccagcgaaagggttgtttgaagagctttaagtccctcttgtgaaggtgtaccggcaagtccctcgagaaagctagaagagaaaatggaaagtcaagggattatgaaaataaggaaattcaagagctcggcagttattaagttctgaaaggcaagagcttactgccttaggaagcagt

SEQ ID NO: 654583 - DNA, 437 bp, Homo sapiens
  misc_feature (12)..(12): n is a, c, g, or t
  misc_feature (40)..(40): n is a, c, g, or t
  misc_feature (96)..(97): n is a, c, g, or t
  misc_feature (113)..(113): n is a, c, g, or t
aatgtgtcaagnattttccctccgtttttaaggatgaaanagtattggcagtgtgtgtgtgtatgtgtgtgtgtgtgtgtgtgtggtgcggctttnnaccccccaggctgganttgctgtggcacaattatggctcactgcaaccttgaccttcccaggattaagccatccctccccacttcagcctctgaagtagctgggacctaatggcacatgcccaccgtgcctgtcttcactaaaaatacaaaaaaaacccaactaaacaaaaaaaacaaaaacaaaaacaaaactagctgggtgtggtggcacacacctgtggtcccagctacttgggaggctgaggcatgagaatcacttgaacctgggaggcacacgtggcagtgagctgagatcgcaccactgcactccagcctgggtgacagagcaagactgtctca

SEQ ID NO: 654584 - DNA, 1010 bp, Homo sapiens
atactcctgcaacggtgattgataaacggactgatcatgaatttcgtacttgcatcacaacgttgataacctcgcggaaacactaccagagagaccattggatacaccctcaccagtcatagtcctagatactctatttcctgcaagcagtcacccactttacatttatccaggcatcatgatcacgcgaatagagacactcattccatagttgcgcatagcatcgatgtacaagtgatggatgcttacggaacaagacagactaaagcaagcatactctaaaaacaactggagtcgactcatccagaactgtctagacatgactagtgaattttctacctaaaacagttaggttcggacaccactagatcatggtattcttgtctcgggcttagactaagtgatacacttgaccatttacgaaattatcttggttccataagttgaaataattttaacaaaaatcaaggtatctctaaaaggaatgtaaatctatgccttgcctaagatgactgttatttaccatacttctcgtatagtttattaaccaaataaaagtgccattgaaggtgaaatttgaataattagaaacgctattctacggattatcgtaaacagggacgcgattgggaaaaaagacgtaatggaacttaatatagttgcgtgtccttcggtgccatgctaggttaatggtactggagtaaaatgcgctcgaaagcaatgtattgactatttataagaaatgtgcaattgtaacgactcttacttttaaccacttcgttaaatcggtccaacgaattccggattgtaccaatgctcgttggaggttttgggatggtgaaatatttatttgtaaggctacttattgggaatgataacactgataaatagggggtaagagttggactcaattggactattttagcaagaaggtgaattccaggtataactatggctcatacattcatagcctgttggtggagggcttgtttatgacttgaaataattgg

SEQ ID NO: 654585 - DNA, 259 bp, Homo sapiens
ctcttcaacactaagatatgctctccctgcctgcacctgctatccggaaggcaatccttctcacctgtggacaccaacgacaggaagaatcaccacaacatgatgtaggtgccacccacctcctgagctgtctttgtacactgactgctgacagcaagttcttgctgctctccaatctcatcagacagtagcactgtagggaaacaattttgcccgactgctttttcacacaggacaacaaaatgttttactcatgttg

SEQ ID NO: 654586 - DNA, 213 bp, Homo sapiens
  misc_feature (4)..(4): n is a, c, g, or t
gttngtagtaaacaaactacggtttccttcacctggaggcagtatggtcgggtgacgaacgcatggtacacaggcgctagtccttctgcgatcttcttcccctagggaacctcctccaaagagtcttctccaactacttcattctcacactctcgaaatttactttaacccattatggattcaaaatccatttagaattagagtacctctctt

SEQ ID NO: 654587 - DNA, 271 bp, Homo sapiens
  misc_feature (34)..(34): n is a, c, g, or t
  misc_feature (49)..(49): n is a, c, g, or t
  misc_feature (56)..(56): n is a, c, g, or t
  misc_feature (146)..(146): n is a, c, g, or t
  misc_feature (209)..(209): n is a, c, g, or t
  misc_feature (257)..(257): n is a, c, g, or t
acatcgagctcggaccgctctcgtgagactcctntagcttaggactcanatgccanacgtgtggccctgaaaagttaaaaaaaaaaaaaatcagaaaagaatcagactgcagaggtttgggtagctgctgaggcatgggttacagnccctgacccagtgcaatgggttagactcctgcattgctgcagctgtggtgtagctgtggtgtngtttgcagctgtggctcagattcaatcctctgcccaggtacttccatntgcccagtctcacc

SEQ ID NO: 654588 - DNA, 205 bp, Homo sapiens
ggacgtccagctgagatctcctaggcgaaatataagaattattgtagaaaataattaaaacgttctcctttttttatctttaaataaaatctcaatttcgaacatgtcggaaaaaaaggggaggatttaacgtgtcatgtatgctaataatatttgtagtcgacgccaagaccctcactcgaacacagcacaatcacggtagagg

SEQ ID NO: 654589 - DNA, 252 bp, Homo sapiens
ccgcgtcgacctcgtaggttgcgacccagtccggcgcctggccctccagcctggagctgatcaccgggttgtaccagccgaaaggctgcagcgccttgcggatgtcgtcctcgccctgccgggtcaggcgctgcacctcggccggatcatattgcagcttgtcgggcgccttgctggcgtccacgcccttggcgtagtcgagcaggcgcagctgggcgtaggcgttgtcctgctcgtctcagccgaggccga

SEQ ID NO: 654590 - DNA, 800 bp, Homo sapiens
  misc_feature (1)..(1): n is a, c, g, or t
nttaaggttcccacacatttgtgcaagttaaccgtggaggctgccttggccttatattcaaattgttgtggttaaagaaattgggccagaacccagccagttttaaagggcccctttcccaacgggttttaactgcggttggcaatggaggtgtttaagaaacagggtctcactatgttcccagggtggttcacacatgtcggctgtttaagactgttgggaaatgcaccccggcctcccacaggtccttttcaagtttgacatactaggaccctctggcacaatcttgtgaatgagctcttacctcacttctaggaattgtgagtcaatgttccgtctgttgaatatgcatagtaggtggcagtggtttgtgtttgtaactaatacagtatggcctctctcacatcctaattatcctaccagttggctcaccggtattatcttatgacctggtaccatcccaattttgtgaatgaggaaacaagtgtttaaagtgtcgctctgaatgttgggcgcagtggttcatgcctgtgatctcagcatttggtagggtcctagacagaaggattactttaggccggcagtttcagaccagcttgagcaacatagcaagtcctcgtctgtcttatgtagcaatacaaaagttagccaggtgtggcagtgtgcacctgcggtggtggtcccagctacttgggagtctgaggtgggaggcctgttttacctagggaggtcgaggttgctctgagccatgattagccctgtgcactccagtgtgggtgacaaagcaaatccgtatctca

SEQ ID NO: 654591 - DNA, 335 bp, Homo sapiens
  misc_feature (1)..(1): n is a, c, g, or t
nacagctgtaaatccatataaagctgtgctcactcacccagcgctcaccccatactgtgtggcctggttcctacaaccggtttaagaattattctttctcagaatatctacctcgactggaataagctcacgttctgcactgtagcaccagtaggtgctcaataaatgcttgtcgcaagaatgaatgcgcggcctgggcacagtggctcaagcctgtatcccagcacttgaagctgagcgccagtcacgaggtcaggagatcgagaccatcctggccaacatggtgaaaccctgtctcttctaaaaatacaaaaaaaattgcctgggcgtggtgg

SEQ ID NO: 654592 - DNA, 1224 bp, Homo sapiens
  misc_feature (1100)..(1100): n is a, c, g, or t
ctaacttaggccaaaccatttacccaaataaagtataggctgatactaaattgaagagcactgcgcgcaagtagtatatagtaccgcaacgggcaaagatgataacagattgatagcgcgaagcagtaatatagcaaggactaacccctataccttctgcataatgaattaactagaaataactttgcaaggagagccaaagctaagatccccgaaaccagacgagctatctaagaaacagttactgagagcacatccgtctatgtagcaaaataatggagaagattctatagcgtagaggcgacaaacctacgcgagcctggtcgatagactgagtgtgtccgaagatagaagtcttagttcaactttaaattgtgcccgagcagaaacgcctctaagatcccctgtgctcaagtttaactgtgtaggtccaacagaggacacaggctctttgtgacactgaggaatagaaacctatgtagcatgagacgtacgacaatctcaacgacgcgcataagtaggctcgtaaaagcatgctcacctagttacacgaaagcgtacaagctcaacgagcgcacatacctacagaatcccaaacattataactgaactcctctagaccgcaactggtgaccaatctatcacgctatagaagaactaatgttagctataaggtaacgatgaacagacattctcctcctgcataaagcctagcgtcgaagactttaaaaggcgacttggaactggactaatttaacgaggcccaattagtctacggatcaaagccaaagacacgtcctcttgattacccctttacgtggtaaaagccccaatactagagtcatgctcactacagggaaacagtctcaaacacatgaaatacacgaagaacatggaaaagtcattaaatacccggtacttgtcgatccacaaataaagcatatatacgcgtaaaaagacataagcaagagaaattcaaagcgggtcacagcacagtgcccgagtagcacactgtgttaaaggggacgcaaaggaaaccccacacgaaggtgggaaaggaaagcacatagactaagtacaagaaataagcaagcaggacnatacaacggagccagcaagagcggcacaataagaaagcgtagagaacaacgaaacaaacaatccggaaagagagcgagcttaccacacaagtaagtaacgtaccgactgcttatgacacactaa

SEQ ID NO: 654593 - DNA, 805 bp, Homo sapiens
  misc_feature (124)..(124): n is a, c, g, or t
  misc_feature (565)..(565): n is a, c, g, or t
  misc_feature (567)..(567): n is a, c, g, or t
  misc_feature (603)..(603): n is a, c, g, or t
  misc_feature (605)..(605): n is a, c, g, or t
agctcggtaccccgagtgggtccctgctcatagcctggtactcggctgtgtatcgttcttagagcgtcggcagctcggcaggagctcaggcgcaataccaaatcttctctataggtggcgcagngggtgaactctttgactttccttttaggtttccaacgattccacaagctccacagattccagcgcttatcgtccttcatcgtctgtaccctctctgctgactgctgagtcgtacgaccaaaatggttaaagtggcgtcctggatgttggagacgatgcgatagtctccaactcggtacttccagaactcgccgagctctgagcctttcagagcgcttccaatactgcgtggttcgccttgattggtgatacgtccaacaagaaatttcagaacgtcctttgctgcatcgtccccaagttctttcagttccttttccgctgccggatcaaattcaatcccccaggtcataggacttgatcacgtcttgaagtgaaatcgtttcgctacggttctcacgcacctctcccaatcgctgctcagccaggtacagatcctctaggncntcaatgtgctcgaggatggcctcacgggcatagaangncttggtgcgtcctgtacgagcagcaatgcttctaggcgctcctctatttccggggcaagacggatcgctaacatggggccctccaaatgattgctatacaagtatagcgtggcgttaaggtgtgggacagcctatagcaatagtgccgtataaaaagccgccttggggcgatcaatgcaggctcacaaatgagctaaggg

SEQ ID NO: 654594 - DNA, 179 bp, Homo sapiens
ggtgtcgaggattccgaatctcgacagtggtgcagcaagaaattacatgatgaaagactgtaaacacccaaatatagttgcttatttgggaagctatctcaggcgagataagcttgggattggcatggagtttggtggaggtggttctttacagggatatttatcacggtaactgggac

SEQ ID NO: 654595 - DNA, 422 bp, Homo sapiens
cgtcaaacgcgccatcaatgttactgaggggacaaatactccgactatggcggactaaacaacaactcctacatactacccggatcatacctagagccatgcgagctgcgactccttgacgtgaacgaatcgagtagtactcccgattgaagcccccattcgtataataattacatctacaagacgtcttgcactcatgaactgtccccacattaggctaaaaaacagatgcaattcccagagaagtctaaaccaaaccatctttcaccgttaacacgaccgggggtatactacggtcaatgctctgaaatctgtggagcaaaccacagtatcatgcccatcgtcctaaaattaattctcctcaaaatcttggaaatagggcccgtatttaccctatagcaccctctctaaccccgtttgag

SEQ ID NO: 654596 - DNA, 224 bp, Homo sapiens
agccggtaccggcatgtgctgtaggccagcgtgactcattaatacacttagcgcagaggcctgactcattcagagatctcttaacaaccacctcacccaaccttacgatactttagctaatgatattctccagcttgggctgtcagaattatgcctcacacgtgggtaatgggttttatagcttgtaccagaagtaggctactagcgctggcctacagcacatg

SEQ ID NO: 654597 - DNA, 163 bp, Homo sapiens
ggatccggaggttgagtctggactaccaaaaaatctcttcaggtagtagatctgtccccatgtccttgccactagaaccagagctttcaagaagtgacccaaggaccactcttctgtttgtgttgtcgttgattgctctttgtattctcttccggacttcaag

SEQ ID NO: 654598 - DNA, 619 bp, Homo sapiens
gctggctacgccgccctctgcactgttaccaacatgaagctgctcgcagcaactgagctactgctcaccatctgcagccttgaaggagctttggttcggcgacaggctgaggagccatgtgtggagagcctggattctcagtacttacagaccgtgactgactatggcaaggacctgatggagaaggtcaagagcccagagcttaaggccgaggccaagacttactttgaaaagtcggagcagctgacacccttgatcaagaaggctggaacgggactggttaacttcttgagctattgcgtggaactaggaacacagtctgacacccagagaagtgtccacgccattgtcttccaacctcagctggtctctagaacacccactgagcagtcctagagctcctgtgcctacccactctgtgctacaatagatgctgaatgaagccgctacatgcgacgcaacgcgttgttggcacagccgactcgagggggggtccgtgacctgaattcgcctatagtgatgcgaataacaatgcactgcccgtctttttacaacgtgctgacgtggaggcgtaatagcgaacaggctcgccgatctactttcccacaggtgcgcctct

SEQ ID NO: 654599 - DNA, 518 bp, Homo sapiens
  misc_feature (299)..(299): n is a, c, g, or t
attcgcggccgcgtcgaccagataagcaaaaaaaggcatctggaaggcttcttgccaaatggtaactttctggaagtttcctcatttagaagtaatttctggaaaatttcttgattaatacaaatccgtgaacaaacttaaaaatgatggctttgttattgctttggcacaatatgttaacaacactgtgagtgctgccaaaactctgagagttctttcatgcggattatggtcttgtttacatatccagctgtactgaggccttgtccatggtggtaacctaacaatgttcccagtgngggtgcccattaggggaggggagactaactgaagtttagtttgtttaaattgagcaagaatgcacagcggcactcaaatctttggggaatgtgttggaagcataccctttctgggatctgttttcgtttatttaagggggatgtttgcattgctcaaaaattgcagtacacaaacttgccatgcaaaatgccctccacatgtttactggggtctattcc

SEQ ID NO: 654600 - DNA, 620 bp, Homo sapiens
agcgggtcactctccaagtcccctgcagtcttcctcccattgtcttttctctttgtgtttggtaacttttctttcctacgaatttaccagcctgaagagatgaaagtcctgagttttcctacttccttattacacaaatggaggaataaggaaagctgttgttggaaggatagcacgtcagtagatgagcaaagcaactcaagattgtctcctttagctccagtaagtttgatccaaactgggaggtcaccgatgaagcttagatcaaacaagggccaagcatcattggtcatcaagcaccatcactgtcatcatcataatgacatagaaatgacccaaaaatgttctaatttttgaggaggttgtgcttaaagtgaacgaaggttttaatatcttcattgtgtgctagattctttaaatcagaataatcaaactgaggtgttaagagaaagaatatcagaaaatcaggcaagaccttgcttaaggaaatatgaattgcctaaaggaggaaacggctagtaaagttacagatgatttgcttgatctcgaatgtaggtgtatacccaatttcagttaacctttgggtatgtgataagcaaaaaccacactccacccttccc

SEQ ID NO: 654601 - DNA, 190 bp, Homo sapiens
  misc_feature (57)..(57): n is a, c, g, or t
  misc_feature (84)..(84): n is a, c, g, or t
  misc_feature (87)..(88): n is a, c, g, or t
  misc_feature (171)..(174): n is a, c, g, or t
cggtagggtctgatccggagatatggcctcaatatgtgccgccagtgtttccgtcantacacgtagggggtggggttcattaanttnnactaaatgctcttccttcagaggattatccggggcatctactcaatgaaaaaccatgataattctttgtatataaaataaacnnnngggctcgttggcctca

SEQ ID NO: 654602 - DNA, 192 bp, Homo sapiens
tgttcgccagtttttttccccaccagaggttagtccattacatgtccagattgcttaaggttgcgatatgtatctcgttgtcaacgggtatatggctgtgaaccttgcatgtgtgtggatgctgagaataccctccacacatggcactgttgtaaaaatcaatattgatccctaaattctcttgcagggtca

SEQ ID NO: 654603 - DNA, 317 bp, Homo sapiens
tctagaggatcccgtgatttatcgcccacacctcgatggacaaggaaaagttctgtcacatgacaacttaaaacgttttccacagataacgaatgggtaaaacaacaaaattaaagaatgacaaaaaaaaaagaaaaaaaaacaacccagacacacaagtatgcctccacttctccagagtggcagaaaactgcacggaggaagcccagtcactgtagagagagagaaagaaataggagccccgtctcagggtccaggttggccctctgcagaagctgcaggtacgtgaggttctcgtgcgtgtgggggataacata

SEQ ID NO: 654604 - DNA, 1052 bp, Homo sapiens
agcggaatttgctgtaagttcaatgtgactccagctcagagcttaatggtttaaagtttcaggataagaagatgtagaagtcaggtggagacgctttgtaagtgtgtcctttcaatccgcactaagcgttcaaactaatcttttagccagtggaaaactgcagatatgtttaataactttgttgtgttttattttgaattgctacatactcatagcaaaaaaaaaaaaaaaaaagaaaacgtttcagaagatgtccctaagaaaaattgaaaatctcaccaatttccattaacacccgttccagacgatacctggataactaccgtagtgttgctcaaccttcttccagagtttttcgggtggaacacaaacacacacgcaaaacagtactcatacctactggtgctagcggtcctatcccttggctttccctattttagcaaattaccattgggactatatattctctttcaaatttacatcgggcagcgtggcagtcctacacattttaatggccttcttcaacaacgaattacctctgcatatgccttgcgcggggcattccagaacttctatgcgcatattggcttcaccctctttagagaacagcagctacctctctgcttcactcacatctgggccattcttccagaaagaagaactaaccggacccaataccttattgcaaagattctaatctgcgggtaacgtctgcatcccaactgggcccggccacgaaagaagcccccagttggcctgccctaattgagcgcttcgttccttaccactggacctcaacattctgggacggcggctagcgagacccccagaacacactttccgccgcaagcaaacaggcgcgatctctgaagcacgcttaaatcacccaaacgggcgccacatcatttccccctatcatctttcggacacccccaggggcgactcttcccaccttacgggcggggccaaatatctagcgcgctaatagtggcttaattctgggccttttccatcattggctctagtgtccctttctttgtgtatagcatgcg

SEQ ID NO: 654605 - DNA, 152 bp, Homo sapiens
gtcgactcaaaaattgccaatgccgactatatttcaagtagtcatggcagcatattgggaaaagttttcaattagcaataatctgcctcggattaacctcattggctacggtcgacgcggccgcgaatttagtagtagtagtaggcggccgc

SEQ ID NO: 654606 - DNA, 180 bp, Homo sapiens
  misc_feature (94)..(94): n is a, c, g, or t
  misc_feature (101)..(101): n is a, c, g, or t
cccaccgaagccagatgtcaggcagccggtccaagccagagcccccgaaggcgccaccgcggccctccatgtccaccgacatgtttgagccgtncccgatnccggagaccacgacgagcgcccactgattgaccagaaccctgatggctccttgacaaggaggaccgcacgacttgctgg

SEQ ID NO: 654607 - DNA, 314 bp, Homo sapiens
ctgagctcaatgccatcctcccaccgtcagcctcccgatgtagctaagaccacaggcgtgtgtcaccatggctggctgatttagatttttcgtgtagaaacagggtctcgctatgttgtccaggctggtctccaactcctggcctccagcaatccttctgccttgtcttcccaaagtggtttgattatagtcatgagccactgagcctggccttggaattctttttctaaataaaaatagcttcacatgggtgcagtgactcatgcctgtaatcccagcacgtttgggaggcagaggtatgcatatcatttggg

SEQ ID NO: 654608 - DNA, 298 bp, Homo sapiens
atgccctcagctcccaaaaagggggtgccccatttagttgggtgcaggggtcactgcttgtcagctcagggccctgggcccgcttgcctgttcccctacatttgggccgggacatccagaactgcctccttgccgctgcctccagtaagccccccttgagccagagtcaaggggtgcagccctgcccgatagaacacgcccgccctcactggtgtttttgccttacagcccccatgggaaaggtgcaccctttttgttttatttaaagaaagcccaacattaaagggttttccttgca

SEQ ID NO: 654609 - DNA, 449 bp, Homo sapiens
  misc_feature (447)..(447): n is a, c, g, or t
agccggtacccacttatgcgggcacttatgcgtggctcacgacatcgtactcacgacacgtacagtgtagctcattccacatgtccatcaataggagcgtattgcatcataggaggctcattcacgatttcccttatgccggggtaccctagagcaaacctacgcgccaatccatttcactatcatatacatcgcggtgaatctcactttcttcccacaacactttctcgggctatacggaatgtgccgaggttattcggagtaaccgatgcgtataccacatgagacatcttataatctgtgggctcattcatttctctaacagcagtattattaataattttcatgatttgagaagccttcgcgtcgaagcgagaagtcctattagtagaagaaacctccataaacctgtggtgagtatatggatgtcccccacgggatatggtngg

SEQ ID NO: 654610 - DNA, 1154 bp, Homo sapiens
ttatttctgctcaccattagtaggtgtcgatagctctaggatcctcatgcttcttcattgctgctttccgctatcaaaagtgtgctgtgatacagtgagcaccaaaaaccgagtttgcgagcgtcatcaccagccgtcctaatgcctcaagatgataatgtccaagataaggtaaccctctctgtcagagggaatatctccgtgatatgaaatgcccaatcgcctcgcacagtagtgaagtgctcagatcccatgtaaatcgctggcattctctattcactgctttaccttctgtgtgactgtacgcgtattgaaactacaaatgtggtactcaagcggttgattcaccaatgcacacttttcctcttacctttttcttttctcaacaagctatgttgttagcacactagaacacactcattggtttagttctttgggtggaaagggtcatatgtcacaaatagaatgtctccaaagctaggattgatctggatgtctacacctcttcccttctagtttctgaggacgacttcctcttggctcccagtgaggagcgattcccttgaccatgacacacattggccacctgtggcactttaagaccttagtggtatagataataaccaatttgtttttatgtcctcttctccctttcccatcttgtcagcatagactgggactcccttaagcccagacatgcagttgagacctgacccctagtcattggttacccagtgtgtcaggcaatctcggactttaccagtcgatgccattcgaacgatggcaccttgtgcaaaacgagcagtcggttgcgcatttcctagattgtggatcttccagatccaattgcatgctcattttcatttcagcttccttgataagtcagggtcggcttgtgagaagttgttaaacaacatgctaaatgtgatatgtcaaccctcactctttactttccctgttcagagcatgcagatgaagacttcattgggttttatagtggctttctgatttttgctagtccattgaagaagggagtttgtaagttgttggatactgtttaacgattggtccgcccatagtcctgcctgatataccattggactttgctttagttaacacccagttcatgtatttacagggcttagatagcttgc

SEQ ID NO: 654611 - DNA, 113 bp, Homo sapiens
acttagaggattactgcaatggttggagcaataaggggtataggggtaatggccaaaaaataaaatggtttgtgtgtgtatggggaggaaaggtgtgcaaagctgtggtgtga

SEQ ID NO: 654612 - DNA, 145 bp, Homo sapiens
tatggacccccaggtgttctaggcgtccttcctgagtgtgttacgcgttctcccaggtatgctcgcgtgttcacacaggtgtgctgtgtccttcccgtgtgtgccggattctcctgcgtatacctgagtccttcctgggatgtgc

SEQ ID NO: 654613 - DNA, 294 bp, Homo sapiens
gaccccggaaattcggccataatggccgggaaggtaattgaaaaaggcagggaattagttgcaggtcccgtggtggtaatggttgcccgttcgttaaacccaaccagggggactttaagggccaacaggcttttctgggttttaataaaaaaagttcttttgaccattataattttaatggccaaagtacccaaccttggggttaagtaaaaggtcctaatttttggaaccttttccaattttgggttggggaccagaagtaaaattaattccaaattacttccatttaacatt

SEQ ID NO: 654614 - DNA, 349 bp, Homo sapiens
caccgggcgcgtcgcgacgtgtatcctttttgattcgtgtgatggcacaaatgagcataacatatacacatgcatgtgtgcatatacatacacgtatactcgctcgtaaaatgtgaaaaatgcgaatatatcacgctggcattcgaaatcacttcagctttatacttcgcactcataggctctagatttgcccccaaaagtatttttcctggtcgcttatttaaatgcccaactagcaaaaccaatcaagggcccgaataagcggctgtacactgtgcatgtttcacgtccagggtctatgttcccaaaacaaggtcagcatgttcttcactttggccattgtgaacag

SEQ ID NO: 654615 - DNA, 814 bp, Homo sapiens
agagcttctcttgacgtttcctatttctacctctgcttgtatcgagctgtagaactcttcatttagaatataacatttgcaaatattgaaaaattactttcttttttgtggcgattgccactaggtggtgggtataatatgtgaggaatgatcacgcagtaactcaatagttctgatagtttcgggtacctatatttcttcacattcgtcgctgctcttttcatctacttgtgtatatttgacacattatctgtgaaaccttcagtctccttcctccactaattatctctcggtcctactcttctctcttagcagacaggatctcgctctgttgcccaggccaatgtgtggctgagtgtgactcactggctcactgcaagccttgaacgtctctggcgctcagggtcgattacacctgctctatggcctctccaagtgcgtctggcgacttgcggcgctatacacccaaccagtaccccagcctagaatccataaagcaccacaacagctgccaacacgctcacgaggacacagcactcctcgacaagagtacgaccccgggctaggagctcggagaactcctgagccccaagagtgaccccctacacacgctacgggtctaccccaacagctgccgcgccgaatacactaatggcaaccgcaccgtccacgtgtgccactaacagcgacctcacacacaactctccccgacgaattctcaaacaccaagataaacatgaacgcccctggagataaagtccacagacaaccccctgagggaaaaatcacaacccacagacacaagcagaaccga

SEQ ID NO: 654616 - DNA, 902 bp, Homo sapiens
ctagttgggatgcgagccagaggaggagaaaggtacttgcggtcttgttcgttggtacttacgatggtttacacacatttcgttgtgagatcggtagtttgtactataagatccgcggtccacatcgcgcggccctgatggcgcacagacttctaaagtgttggcacaaagaacactggtgtgaatttgctgtggtgccctcccctgcctttgttttctcgtggtaatgcaacacaaattttgggtggcccccatgcgaatcccctttttaccaccccgtgttggccccctgtgtgcctcgtaccctcacgccagttgtcgggtgcaacccagggccaatgcctcaaatgttttggggaacgccactgccatttctctgggcactatgtgatcaaacattctcccaggtgtcaccccccatccttcttctttttgcacagatacccgccccccccttttaagggggctctaaaggggtgcaaccacgaagtgttactccacagcaggcccctctgccaaaacgtgtgggtgtaccgcaaagctgtgccacctcagtttatcaaacacgaacggtgtgggccataccgtgttgcctcccctacctctgcatgtagcggcctcgagaggccccctcgaagctgtgttcccttattcttttcccccccccctctgtggctgctcagttacacccagggcacacgtccaatgtatttaaagtgggtggggccgggtgcatccaccatgggtcgaagcacattcttgttagcctcccactcgccctctcttcttggattagggtagtcttcccctttagacatcctccatactttctgccacgaagattgagaaaattcccaaccccccaaaccacccaaaaaagctttaaaaccgccaacaaaaca

SEQ ID NO: 654617 - DNA, 240 bp, Homo sapiens
  misc_feature (28)..(28): n is a, c, g, or t
caagatcgacacgccgcccatccgcggnctgcccgacgacccacacgatgccgccatcgcccgcgcgatcattgcccttggccgcagcatgcagctgacgatcattgccgaaggcgtggaaaaccaggcccagcagcgttttctggcagcggaagggtgtgagcagatccagggctacatcgtcagcctgccgctgccaccagacgagttcgcggccgcggtccttcgcatagcactatg

SEQ ID NO: 654618 - DNA, 198 bp, Homo sapiens
gggtgctgacagttggtatcaagttgatgatgagtgtttatgtatctatttttgtgcatgtgtgaaatgttccataaagcttcataagaaaaaaagattttaacttaatgaatatttgacgtggactgcaatttgtgcactcacttaccattaatggccctgtaatacaacaagcttccaggttgaatcaaatgtaga

SEQ ID NO: 654619 - DNA, 140 bp, Homo sapiens
  misc_feature (44)..(44): n is a, c, g, or t
  misc_feature (138)..(138): n is a, c, g, or t
ggacttgatggtggacgtagagcgctccaatgctgctgctgcancacatggacaagaagcagaggaacttcgacaagatcatggccgagtggaagcagaagtatgaggagtcgcagtcggagcatggagtcctcgcanaa

SEQ ID NO: 654620 - DNA, 273 bp, Homo sapiens
  misc_feature (2)..(2): n is a, c, g, or t
  misc_feature (34)..(34): n is a, c, g, or t
  misc_feature (82)..(82): n is a, c, g, or t
anaaaactgtggctcggcttgtattccccacccnttggaggcaggtggtggatcccccctaagacagaagttgagaccaggnctggccataatggtgaaacttcccatctctactaaaaaaaattagcgggtatggtggcgcatgcctgtaatccccagctacttgagaggcagaggtgggagaatcgcttgaacccaggaggcaagagattgcagtaagctgagatgacaccactgcatgccagcctgggcgacagagcgagacttatcaaa

SEQ ID NO: 654621 - DNA, 455 bp, Homo sapiens
catgccccaaaacaccaaccccagtgtttatttacgaaggggaggggccggaccctccgttttaatctgttcaaccggccctgaggttttcttgccgcgccctggtgtgggccgtaatgtaaaaagctgcctccctggccttccccttaattcttatcctaaaaggggccgccgggtggtggtgcccacccgttttttcaccgaccgggagattaattttttggtttctaacaaggcagacccgttttttgatgggggggggggtgtggaaaaaaaaaatgagatcccccttcttgtgttccccccccggggggacagcggggggacctatggaaggggggaaaggttggggggggtggttcccccccccccccccccccccctttttttttagggggaaaaattaaagtttttcccccccccccaccccccgggggaaaggggtttggccccca

SEQ ID NO: 654622 - DNA, 277 bp, Homo sapiens
  misc_feature (85)..(85): n is a, c, g, or t
  misc_feature (241)..(241): n is a, c, g, or t
tggaaattggctcctgaaattttattcttaggctaaagcctagcattaattatttggatatagtcactaggtgtaatcacaagtnccagtttgttttagctgatctcatttgaggtacattttggtctgagaaagtactagatcatctctgcacaagagatgtcatgcagagtaccctccccacctctgaaagaagtaaattaattgagctttttactcaggtgaataaatcaatgtgagnaagacgggaaaaatacaaaacggttatggcttcttt

SEQ ID NO: 654623 - DNA, 402 bp, Homo sapiens
  misc_feature (388)..(388): n is a, c, g, or t
agtaatggaatgtaatccaattccccactcccacgttcaactcttttctcacattatttcctccacctgctgggtctatgctgaccttgctgggaacactctgaggacagtgtgactgaccgagcggttggccccatgggtggtggggtgtgagaagcctgcaataccccaagaccccagagggcagtccttaggaagcacttacaccacctgggaacccctccgtcttttccctctactctcatcctaggaataaagcatttccacgccagagtagtttgggctgggggccagggttgggtggtcctgtccctccatatcatgtcctaccctatggtcctgttcctagtcatttagatcaccccagatggcctgatgacaacaagantttgtgaagttatg

SEQ ID NO: 654624 - DNA, 1044 bp, Homo sapiens
  misc_feature (114)..(114): n is a, c, g, or t
tgcagactggaggagatggtcctgaggaggtggtgctgttggactctttgcgatggacccctggacgtgcatggccctgggggagtgctggcctgaggctgtgcgtgctgagcnagtgctgtgacctgtgtaggtgctgactatgtgctggagtgatgcagtgacctatctggagtgtggacgctgaagcccctgtgggctctggagtgagcccctgcctagccatgatccctctgtgtgagagctgcagccctctctgcatagggtgcccagacgtgcggcggcggcggatcgggcctgcgagccagcaccggggaccaggcgagctgggcaaggtcaagaaggagcagcaggacgtgcgaggcggacgatgacaagttccccgatgtgcatccgcgaaggccgtcagacaggtgactcagtggatacgaactggacgctggtgacccatgcccgatgacgcgatcaacggacgccagcaaaagcaagccgaacgtcaagcggcccatgaacgccttcatggtgtgggactcagtgcagcgcgcaggaagctcgcggaccagtacccgaacctgcacaacgacttgaagctcagcaagacgctgggcaagctctggaaggatgctgacacgaaagtgacacgcgccccttcatcgaagaggctgagcggtccgtatgcagcacaaagaaagacaccggactaccagtacagacccaggcgggcggaaacacagggaaggcagcaatggaaaatgaggagtgccccgggtgtagaggcaagacaggtggaccgccgccatccaggccactacacaaggacaccttggacaccggaccatgaaagggtcccatggagatgggaccacagagacctcacgccaagccgaggcccgaaacagacgagacaagagacgaagcgcagcgacacgagcacagcgacaagacaataggaagaagcgaccacaaagcatagaaggagacgcgaacccgccagagacaaagagagaaggaagaaacagaaggacagagagacccagacacgcg

SEQ ID NO: 654625 - DNA, 1183 bp, Homo sapiens
agcggatcgtccgctcaggcccggggtgccgacgggatgggccggtgtcggggacttcgaactggctaggaagggtccgctattcaccgacgagaccatggagagtggccaatagatataacagaatcacagaatagacgtcaattattggggcgaacagcccacttataaaggccgagagcccctgtaataggacggtgcattcatctgtgccactagggaaatcgtgggtctggtagacagttaggagtttgatagtccaataacctacgaccagacaattcgttgccatgtatggagaagtgctgatacggggtccatgtctgaatccacaggaataggccatgaacacatcactggtccttttgggtatctctcagactgtatcgtgcttgtcgtatgtaacctttccaatgtggaggagtaatagatttgacttgtataggtctcttggctatagcgtcggagtctccggatcagcccaaggctcatagcatgttggattgatatatcgctggaaggtccagagtttaaggattgattagacgatagtacagatgggttagctcttatgtaggtcgcggtattacaatagggctccagaatatgggaacaagtaatcaaatcggaagtctgttgagatattctatactggatggaaaagaacatggtgttagcttgatactataaaattgtatcgagtgaatgacccgacactgaatcaagacaaagagaaaggaagggtgtggcgtaaggggccgggagacttcccgggtggccaggaatacgggtcacatggtacagcttttgatccagagagagggcgagggggacgctgtggaaacggacaccacgccattttgtgggtcccccccgttaaagaccgagaaaagtggggtgaaaataaaagcaaaccgcactgggtgctgcggaacaatcgatccggggacggataccaatgtccatgcacaaactaagaggacataggcagagcattgggtccaaaccgcactcttcaacaaaattgtcccaccaaggaacctgtggcacgaggtattaggacccccagattgccggtgagaacacaccagctgcttttccttccaaggtgcgcgggcactcctgatcttcatagaaggtcactgcacttcaagacacgtaccacctttcacggactaaattg

SEQ ID NO: 654626 - DNA, 103 bp, Homo sapiens
acatagcggtaaattgcaaacaacaacactgccactgccaaagcctgaacatgggccaagtctaattatgtttgagttggaaggtagatctttattgttcggg

SEQ ID NO: 654627 - DNA, 467 bp, Homo sapiens
ccccgtacatgtcgaggctattctaattactccaaaggcagagcctcaagatctcaattgcttttcaagaacttatcttagggttttttttgtttgtttgtttgtttagtttgtttgttttgagacagagttttgctcttgttgcccaggctggaaggcagtggcacgatctcggctcactgcaatctccgttgcccaggctcaagcaatcctcccacctcagcctcccaagcagctgcgactacaggcacgtaccaccacaaccggctaattttggttcgtacgtgtgtgtgtgtgtgtgtgtgtgtgtgtgtgtgtgtgtgtgtgttttgtgtagagacagagtctcgacatgtcgcctagggtgttctcaagctcctgggctcaagtgatcttcccgccttgggctcccaaagtactgagataaaggttagagccacgatatgtgcggggtacgagctcgaatg

SEQ ID NO: 654628 - DNA, 253 bp, Homo sapiens
tgccaccacacccgggtgatttttgtatttttagtagagacggggtttcgccatgttgctcaggctggtctcgaactcccgacctcaagtgacttgctcaccttagcctcccaaagtgctgggattacaggcgtgagccactccacccagcccagattaaatgtttttatttctacctgccatcattggtctttactaagtgaagtgacttctttctttaacaataaatggaattggtatactaagcaaaaaa

SEQ ID NO: 654629 - DNA, 280 bp, Homo sapiens
gcgaggcggcgaagatcaggcggtgatggggaaagcgcctatcaaaagtgcgatcaggcgagacaggagccagccctggaggaatgtacaccccaggtatggtcagcttctagctttatatttgctccataatgacatgaataatgcaagatatctttggaaaagaataccacctgctattctgcaaattctgaacttgggggaatttggtcagtaggacgaatctggcagagagatttccctgggatctatacaaccatccgctcaccagtggtctgag

SEQ ID NO: 654630 - DNA, 392 bp, Homo sapiens
  misc_feature (161)..(161): n is a, c, g, or t
  misc_feature (206)..(206): n is a, c, g, or t
  misc_feature (313)..(313): n is a, c, g, or t
  misc_feature (318)..(318): n is a, c, g, or t
  misc_feature (322)..(322): n is a, c, g, or t
  misc_feature (346)..(346): n is a, c, g, or t
  misc_feature (349)..(349): n is a, c, g, or t
tcagccgcctgccccctcttcctaagcagctttaatgtccccgtgtccccggggtgggagttcaaggctcagtaatggcctggttccccgggccctgccccattttctcatcattcccagcctttatggagaaggaaggggttaaggagggggggtcaaanggagccccctttgggagggaaccaacccccccctccctcctgggnccccccagcagtagacggcttgggggagtcggaggctccccggcagaccccccccccccattttgttcccttgaggtgcctcctttcctctgcccaggggagggagngtggncagnatttggaagttttgggattcaggntgntattaaaataataataataattaaaaactttgaagaaacttga

SEQ ID NO: 654631 - DNA, 550 bp, Homo sapiens
  misc_feature (199)..(199): n is a, c, g, or t
  misc_feature (236)..(236): n is a, c, g, or t
  misc_feature (269)..(269): n is a, c, g, or t
  misc_feature (273)..(273): n is a, c, g, or t
  misc_feature (282)..(282): n is a, c, g, or t
  misc_feature (296)..(296): n is a, c, g, or t
  misc_feature (311)..(311): n is a, c, g, or t
  misc_feature (315)..(315): n is a, c, g, or t
  misc_feature (327)..(327): n is a, c, g, or t
catcttcctatccacagcttgaaaattagccagtatatactgaacatgcactgtataaaaagcacattatggggtgctccagtaggtacagcagtgatcgagacagaatcatagccttcagggaagaggtatatgcaatgttctctccttccaaagattacctagatagagaactgttcataagaaatatcttggtacngtctacattactcttgagatataaaatatatattatntcttacgtctgaaatgagtcagttgtttctaanacantttgtattnaagtattcacattnaaatttgtaaatacngaanagtagagagaanaatcatgaatttttaacatggtaatgattatatcagtttcgttcttggcgtttctttaacttgatgggatagctaatgttttttgtcatagcaaggcgtagctaacttgtcttaaggtagagatgaatgcagcaagattttgtaatatcgaaagccactgtaaaaggatatttgtggtaattgttgtttcccccccaatgattaataaaagactctaaactat

SEQ ID NO: 654632 - DNA, 748 bp, Homo sapiens
  misc_feature (348)..(348): n is a, c, g, or t
gcgcccttttttcttgttttttaagggatttccaagaacgatctaagacagttaaaacacaaactttgttcaaaatatcacccatgtgggggtttagcttgaagtgtcagactatgtaacaactatagctacttggtaaaaaaggtactctcacctaaagccgtaacagtgattcattttttcgttctccaggaaacagagaaagtgctcttggggtcgggctattacatatcaaagagaattttaccttctaaaacgtgatcccagatacagcgagtggcccgttacaacagtttcagtgaccaactattgtaggttcatagtgcagaacaagggcttcattcgtcnttcatagaaactcataagtccaggtgcaggctcatctcgtgggtgaaaggcacgtggagacgctcgagaaccaactttttcaaaaaggcgtctcctcacgtgcaacagggtaactgggggtgtaaccagggggattacacacgaggaatgttggcgactacaattacgcagaccgtttagatcaacgtgaattacccccagtataaaagcagttcacgggcggtggacccagtggaaatccgtatactactccggggggagcatgcactatagcttctacaacaattgttcttagatgcagatcctcctctctctgtgcacacgcgaaaacacgttcccacaaccttgtcacaaattcttggcgaagcgtgaacagatgagcacgggttgtccaaaatcg

SEQ ID NO: 654633 - DNA, 343 bp, Homo sapiens
ttctgactctggtagttagcaattacagaaacttaggaaaatcatgtcgtctctctgagcctcattcccatacttaaaagaatgtagcagaacgtagatgatttctctggttctgttttagctctgcaattctgtcatggaagtgggaaacttgaatgtcaatatggacatttactttctccaaaacctaaatttgtcccttgtctcagtgtctgtcaagtctgaaatgtgagaggtttcttttggtttaaaatattgttatttatttcctaaataacaatgaacttcctcctggattcattccttacataagcatattaaatgcttaggacttgggtcttac

SEQ ID NO: 654634 - DNA, 413 bp, Homo sapiens
aacagcacgctatggtgaaggatcatagccatgcaccccacaatgccagataaccaagtgaaattcaagtttcagtcttccaaccgagtttggaaaaagaccggactacccattattgggaagttctgcacttgccttttgcctgccaatgacagaaaaaaggatggtctgcttacctaaaccagttaacttacaacgcagtgtgactgcttcctgtgacctgaagatagcctgtgtgtcgtttaacctgggcaggacacatctccctgcatttttttttttttttggaaaaaaaggtgtaatagaggaatgtgtgtttccagttatttgtagcccattactactagggagaaaagcaaagctctttcttatttccctcaatatcagctaccctggatagggattgctgtcgg

SEQ ID NO: 654635 - DNA, 678 bp, Homo sapiens
aactatttagaaccgtgtatcatgcttatcagtaacgtagaaaaatagaagcgtgaactctctgtacaactgtagtggactcaaaagaaaatgtatcgttaacagtgcttcacaaagacgaattcatgtgtggaggtacctatataaaaatactatatatctctttaaaacttactatgtacaattgaagcgtacacaagttttacaaagtactggttatgcgggttgtagaaaacacttgcataggacatgaaatcagtttaagaaaaatttctgagcctatagcatagaaggcacttgactttataccagtaacagcacaaccacaacaaacgcagtgttgtagatgatttcccacctctctgaagtacagatgtggtgcatacacagcaaggagagttcaggaacctttatctctcagccaccccatcgaagagcaggacttggtaccgtctgcccatgtaccccagatacagttacatgtaggtacagattgatgaagcctcagagcttatgtgatctcttagacagaactcatataaacccctatttcagcggttttttcagaccctcttgcagtatcttccatagaggcggtcccgagtgggctcctaaagcactgcggctcagctgtgctgcctttaccttggcgcccgcgtgcgggagaacgctccagcg

SEQ ID NO: 654636 - DNA, 584 bp, Homo sapiens
gtaggatgtggcaaattcggagggtaggctatacgacaacgacgttcgaggggggtggacgttttcttctcgctattcctttcgtattgctgtctctgggggtagctgtcagtccctgcgaggggagagaggccaggttgaagtacattagcacgtagtgcagagagtccaagtcagctcttcgggatggttcaattccaaggtgcgtgttgatggaggcgtaccgcgccgtccccgtgaggttcttgttctcacgataggggatgtgctggtgggtgcgtgcatcccggtacttcttggacagcccgaagtcgatgatgtacaccaggttgcccttcttccccaggaccatgaggaagttgtctggcttcacaatcccggtggatgaagttctttgaatgaatgtattcgatgcgactgatcaatttggtcagcaagcagcaggacggttttgaggctgaatttcctggagcagaagttgaagagggtcctccaggcttggccccagcagttccatcaccatgacgttgtagtccccctctgacctgcaccatctgatggtggggattgccactcctccctgc

SEQ ID NO: 654637 - DNA, 457 bp, Homo sapiens
  misc_feature (251)..(251): n is a, c, g, or t
tagaggtagtgtcatcccctcgatcaggtgtattctctgtatgggattgtcactgcagagcccatcatttcacagcgtagcaacagatgaaaactaggctacctactgatggatgtgaggctgctgtctacaggagctcatccaagcctgtttaactgggcagtggcaaggatactcgtcatcgggcattgcactgggggaactcccctcacccatggcttccaacttgaaacccagatttacctccaggnagaggtgagaaaaaaattgtaaatagacttgctaaagagcaactcagggttggggtgtgttttaattctcctgatcacttgaaataatctgtaggctgagtgcttatgggggtgggggagaagggtgactccagggtccttccattttgtgaagctctgggggtggagtgtgggcatctgaggccctatgatggcactacattgag

SEQ ID NO: 654638 - DNA, 587 bp, Homo sapiens
ccctattaaagggaacaagtgattatgctaccttggcagggttagggtaccggggccgtaaaacttgtgtcacggggcagggggggcctctaatatcgggtgatgctaaaggtgatgttttgggtaaacagggggggtaaaattggccgagtttccttttaaccttttttaaaccttttcctttatgagcatgcctgggtgttggggtggacaggtgagggtaataagtgactggtgggtggatggtaaatatggggcgtgtaaatggtcagtcaggtgtttaaatctgacgcaggctatatgcggaggaaaatgtctcagttgtacttatactaccataagttcttctatagggtgactaagatgggcccaattggggtgtagaggagtccagttaatatgtggggaatttttaaggtagtggggtgttgagcttgaaccgctttctaaatggggggctggctttaaggcctactaggggtgtaaatttttaactctctctacaaggttttttcctattgtccaaagagctgttcctcttgggactaacaagtaaatttacaaggggattcagagggttcttgagc

SEQ ID NO: 654639 - DNA, 110 bp, Homo sapiens
gtagtccagatacttgtggaggttgaggcagaaggatcacttcagtcccaggagttcaatgactacatacaatgtgctatgattgtgccactgtactccattgacagagt

SEQ ID NO: 654640 - DNA, 604 bp, Homo sapiens
gtggtttctcctgccactgcctagaatagttgatctatcaagccagggaatttgcaatacttactcaaatcagtctccctgaagactcaggggtttgaaatttttaagaataacttggtgggtaggggaccagtgagtcaggagtgttgattggttgggttggagattaaatcatagggagttgaagctgtcctcttgcactgagtcagttcatgggtggggggcacaagaccgaatgagccagtttattaatctgggtggcaccagctgatctatcaggttcagggtctgcaaaatatctcaagcactgatcttaggctttacaaaagtgatgttatccaggagcaatttatggaagttcagaatcttatagcctccagccgcatgactcgtaaaccataatttctaatcttgtggctaatatattagtcctactaaagcagtctagtccccaggcaggaaagggtttgttttgggaaagggctgttatcatctttgtttcaaactacaaactaagttcccccaaaagttagttcagcctatgcccatgagtgaacaagaagagcttggagttagaagcaggatggagtcagtttgtttcctt

SEQ ID NO: 654641 - DNA, 1081 bp, Homo sapiens
gaaccggtcatcacaaaggtccctctcatcatgtcccagtgagaggccagcgatggccttcttccgggcataagtaacaccattttctgtggaacatattgttccacttaatcattaccaaatatctggaaaacctgtctaactcagacagcaccaggtgtacaggaagcagcagacaagatcttccagatcacgcagggagaccccgggagccttctggttctcctacatgggcattgctgatgagactcgtgaatgtgcccacatgggcttcttccacattcgtggttgtgcacctcgtcatgtgatggagctcgggtgaattctccctacagtcccaaatcctagagccaaagtgtcctgccagagggctgtctattgtgtcctggttgcccaagggccactccgtgaagcggccatctttggggtaaggaaccatttaccaacgaaggcatggatctagtgtctagaggctcagagccctttggactaggctcgtgagtcatatttacaagacattcacgccaagatgctccaagttgcaatttataccaactttctctgaatcatatggggctaatcacactccattgcttattcctaaacgaatggatctgaatatgacagtgcccattttcccacttggacctggatggcattccatttaggcaagtccaggacttcatttcatattcaacctaacactccatatgttccctcaagataggagcctaatggtcacatacttcaaccgggggcacaacagcgcaataggacagatggcccgcagattttcatcaccaccaccttcaatgggtctggtcaaaagagcacggggaccaggaggaggaggacggggcaaaaacttttcgcaaaggtgctctgcgacaataaagagtggattattccgaacaaaacggctggggccaccaacctgccagtgataggtccgctgtccgaccccccccgcgagaagcttatatcctcaatacaccacacgaacgtctcgtatctgttgtccttttttcttttcttcgtctatttcatatctactattatatcatgctcagcgtggaggaca

SEQ ID NO: 654642 - DNA, 940 bp, Homo sapiens
gaagcttcaggcaccaccactgagcctggcgacagtgtaatcgactatgccgtcttctgtctcgtggggcatcctcctgctgtgcgaggcctgtgctagcctggtccctgttctccctggctggaggatccctcagtggaagatgctggccgatggaagacagatatcgatctcgcactcatgatcctaggtagttcacccaacctttcaacaaagtatcacccccaaacctggttgagttcgactgtctagccttataccgcctcatgactggacatcatccagtcctaacaggaaccaatatcttcttctccccagtgagcatcgttacagcctgttgcaatgtctctccctggtgatcacaggctgacactcatgatgaatatcctgggaggtgcctgtaatttcagacctcacggtagattccggaggctctagatccgattgaagtgtttccagagaactcctccgtaccctcatccagtcagacagccagctcctgctgaccatcgagctatggcctgttcctcagtcgacgggcctgaagctagtggatacgttctgggatggatgttaaaatagttgtggccactcagaaatgccttctactgtctatactttcggtggacacccgaatgaggcccgaggtaaaagcagatcagacggattacgtggtagacagggtattcaggggaaactttgtggtatttgggtcaagtacgcttgacagagacgccacgtttgtgctctgggtgaagttaccgatcttctttagaaaggcaagtggtgagaagacctttgaaggtcaaggcctccgaggacagaggaacttccacgtggacccaggtgaccaccgggaagggtgctatgatgaacgcgtttaggctggttaaccttcagcactgtaacgagctgtccagctgggtgctgctgataacta

SEQ ID NO: 654643 - DNA, 602 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaagcaaaaaaaaaaaaaaaaaaaaaaaaaaacaatggtgtgggcgcgcgcgcccgggcgcccccgggaagaagtttctttaaacaccaatcgcggtggggcgcgcgcgcggggcgcccaagaagaggcaaaggggaacaagtgggccacaaacgggtggtccctaaggggaaaacccggggcacagagaccaagggcgggggaatccccacccaatacataaaaaccgccccggggggcacaacgagagggttcgtgtgaaaccacactcccgagaatgggggttctcggagggtctcatatagcggggcgatcattattacacggagggggagtctcaagagaggagacctggcgaaatatctaacaattaagcgccccgggacggggggggatccccgaacgcgcatttctccctgcaccgacacaactacatcgcagacacgacctaccgctcaattaaccacgataacacccg

SEQ ID NO: 654644 - DNA, 102 bp, Homo sapiens
cgaaatctggcagactgtcgccagagcatcttatcgggaaatattcccccgtcatctccttccttcaattctccacattctgcaaggaacgcacaataatag

SEQ ID NO: 654645 - DNA, 378 bp, Homo sapiens
acagatcctgcaggatcccctcttctccgaaaggcacatatttactggggaaaacaggagagcaagcccagagcagggggcatcatggatgaggaaatgatggcagatgactgtgcacctgcctctgtgacccctactctgtcagggtggatccccagaagaatgcccagacactttcctcacttcgggaactggatcggccttagcctgctgcgcctctctgcacgcctgcagagaatgaggtctctctcacaccctccttgccgtgcatcggggtgggatatataacaagccgaggtggtctgtgtggggaagggtacgatggcgcagatatcctttacatgcttccttacatcttgggcgggcggagatgtgaga

SEQ ID NO: 654646 - DNA, 380 bp, Homo sapiens
cacaccactcatctgcattgaaactctagaagtcaaccggacatggtggctatgcctatatcccagcattttgggatgccaaggcgggtggatcacctgaggtcaggagttcaagaccagcctggccaacatggcgaaaccccgtctctaatacaaatacaaaaattagccaagcatggtggtcactgtactccagcctgggtgacagagcaagactccgtctcaaaaaaaaaaaagagaaagaaagtgtcatgcttttctgcattctgtgattggtttaagtgagttatcgaacttgagggcttggtgggaccctccaaatttggcagccagtttggtgagaagtacttgtggtctgaggacacccaagcctgcaggtg

SEQ ID NO: 654647 - DNA, 687 bp, Homo sapiens
  misc_feature (1)..(1): n is a, c, g, or t
  misc_feature (160)..(160): n is a, c, g, or t
  misc_feature (272)..(272): n is a, c, g, or t
nctataaaaatcttagagaaaacttaggaataccccttcccgacaatggcctttgccgagaaatttatgggctaaggcctcaaaagcattcccaccaaaaaccaaagcttgacaagtgggacctaattaaactaaaaagcttcagcacagcaaaagaacntatcaccagaataaacagccaccctacagaatgggagaagatatttacaaactctgtatatgacaaagttccaatatccagaatctgtaaggaacttattttgacaagcaanaaccaaataactccattaaaaggtgggcaaaggatatgaacagacatttcccaaaagaagaagacaaacaaatagccaatgaacatatgaagaaatgctcaacattactaattatcagagaaatgcaaatcaaaaccacaatgagataccatctcacactagtagaaatagcgataattaaaaagtaaaaacaaacaacaaacaaaaaacagatgcttccagcctgggcaacgtaactgggaccccatctctacaaaataaaaaaaaaattagccacgcgtggtggtgcacacctgtagtcccagttacttgggaggctgaggtaggaggattgcttgagcctagaaggtcaaagttgcagtgagccatgattgcaccactgcactccagcctggatgagagagcaagaccctgt

SEQ ID NO: 654648 - DNA, 318 bp, Homo sapiens
gccgggtactgcacttgacatacactcattctcctggtagaggcggagtgagggtgctgttggccatgtggcaccaacgtcccggtaccccacctgctggaacctggtgaatggcactgtggtgccacttgccgagattacaggctatgcccctcttcagacccggacgagaactcctcttggttctgatcgaagggtacgaggtgtattctcaccatccggaagccggactactatgcgaagatccctcgggttccgccgcatccggggcgagagtgagctgtacaccagcttatactgtcatgcacaacccacagt

SEQ ID NO: 654649 - DNA, 149 bp, Homo sapiens
  misc_feature (63)..(63): n is a, c, g, or t
  misc_feature (103)..(103): n is a, c, g, or t
  misc_feature (136)..(136): n is a, c, g, or t
taatttcgtaaatgccgcgtgcaaacgtggcatccgtgcgccagaatttgtacaatgcagcgnccccggacgagcagccgctcaccggggcgtttcttttttnaaccctccaggggccattaacgtgtaataacgnggccggaatagca

SEQ ID NO: 654650 - DNA, 1162 bp, Homo sapiens
  misc_feature (1161)..(1161): n is a, c, g, or t
agcgggttgatcctccccgaaggttccggcagccaagattgcaggttcccaccaagcattgtttccgaactgggccacgagagcgtgtccctgattggcttgctctggaggctgggaagggacctgttagagactgggaccactttctgaagcgcgaggcaggaagttatatgctttttctggagtcctgtagagaaagtgctctctgccgcattgatagcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatacagacaccgacgtgattgctctcactgtggcgttctttttgtttgaatcnt

SEQ ID NO: 654651 - DNA, 1108 bp, Homo sapiens
  misc_feature (1107)..(1107): n is a, c, g, or t
agcgggttgatcctccccgaaggttccggcagccaagattgcaggttcccaccaagcattgtttccgaactgggccacgagagcgtgtccctgattggcttgctctggaggctgggaagggacctgttagagactgggaccactttctgaagcgcgaggcaggaagttatatgctttttctggagtcctgtagagaaagtgctctctgccgcattgatagcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatacagacaccgacgtgattgctctcactgtggcgttctttttgtttgaatcnt

SEQ ID NO: 654652 - DNA, 421 bp, Homo sapiens
  misc_feature (223)..(223): n is a, c, g, or t
cccccccccccccccccacccattgtggctttttggtttttaaagggcaaaccgggaagaggggtttttttggttgggggtttggttttggttttggtttttcccagaaaaagaaaggcccaaggaataaggtgggacccggcccctgggggccccccaaataaaggaaaaaactccccttctgggggcccagccccaaccagggggcggccccggcccaggnttttttttttttttttttaaattttaaaaaagggacccccggggggggttagggggcccttaaaaaccccctttcccccccacggtggggccccaagggtggcccaaccttgggggccccggccgggtttgcctttcaaccgggaaaaagccattgggttgggccggtccagggaaaaacccccccccccttttttta

SEQ ID NO: 654653 - DNA, 493 bp, Homo sapiens
gttttacacgtatgtttttctcagacgggagataaaaatgccgagttagttaacgtgggtcatgtgtaaaatccgcccacttgctcgtgattatagtgggcagtagagatgatgacacagtcaatttccatccagccgtgtatcctcatggcgcaagctgcctgtctgactcaggatggcaagctggcagtctgggaggagcatgtttagcacagatgttttgttaggtccacttggtgaggagtgcagacagggctgcctctctctagtcgggagagtctgtgccattccctcgggccctgcacctagcctcattcacatcacttgcccctgtcgagacctacgtttgcaccctttgatagacaccatgttcgctactctgacaggctcagtgtcaggagcacgcgcctgagggcgactgaagacctgattctcttgttccctgttagtataacaccttcaaacttcagatgaagccaatgtccctgctgaa

SEQ ID NO: 654654 - DNA, 335 bp, Homo sapiens
gtaaaagtcaaaagaaacaaacataattttatgttgtcgttttataaatatatttaaactttgagacggagtctcactctttcgcccaggctggagtgcaatggcgtgatctcagctcactgcaagctctgcctcccgggtccatgccattctcctgcctcagcctcctgagtagctgggattacaggcacccaccaccatgcctggctaagtttttttattatttatttttagtagagatggagtttccccatgttggccaggctggtcttgaactcctgacctcaagtgattcgcccgtcttggcctcccaaagtgcagggattacaggtgag

SEQ ID NO: 654655 - DNA, 368 bp, Homo sapiens
  misc_feature (24)..(24): n is a, c, g, or t
  misc_feature (31)..(32): n is a, c, g, or t
  misc_feature (35)..(37): n is a, c, g, or t
  misc_feature (39)..(39): n is a, c, g, or t
  misc_feature (84)..(84): n is a, c, g, or t
  misc_feature (100)..(103): n is a, c, g, or t
  misc_feature (115)..(115): n is a, c, g, or t
  misc_feature (209)..(209): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (222)..(222): n is a, c, g, or t
  misc_feature (229)..(229): n is a, c, g, or t
  misc_feature (298)..(298): n is a, c, g, or t
  misc_feature (311)..(311): n is a, c, g, or t
  misc_feature (342)..(342): n is a, c, g, or t
  misc_feature (356)..(356): n is a, c, g, or t
taaaaatatacagttttaataganatattannatnnncnttacacttcctctcattgcagaaaccatgaaagaatatgcctttngtaatcaaagtaattnnnnatcatgcaaaanagtattttgttatgacattcgtaagtggagactgtatttcaaaacaagtttatacagacttcaaaaggtctaaagtcaaagtgaaatatatttnantntnactagtnacatctnatgcagctggcatactcatattcacagtttataaagtaaaaccactaaactcttcatgtcggctctganatagatgcatttncattcatacattcgctagttaggtctgttcntctaagggggaagncgggatatatgg

SEQ ID NO: 654656 - DNA, 624 bp, Homo sapiens
  misc_feature (468)..(468): n is a, c, g, or t
  misc_feature (493)..(493): n is a, c, g, or t
  misc_feature (503)..(503): n is a, c, g, or t
  misc_feature (514)..(514): n is a, c, g, or t
  misc_feature (588)..(588): n is a, c, g, or t
  misc_feature (602)..(602): n is a, c, g, or t
  misc_feature (613)..(613): n is a, c, g, or t
agcggggaacaatcacttgcagcaggaggtgtaggtgcagtgagctgagatcacaccactgcactccagcctaggtgatagagcaagaccctgtctcaaaaaaataaaacaaaactaccagaccttgaatcctaatttcttagggttatcaccagaaggaacattggctgcttgtcaataccaccataggtggtagaggcaggaagttgtaactagagatgtctttatcatggtctcagttactataaccatttggatcttagtttccttatatgttgagcaagaagattagcctggagaatctccaaaatccttctaactataacattcttcaattttattttaaaacggtgagattttgtttggtctgagaaaatctcgctgttttagactgaggcagtgtgttatgatagagagcactaaacagagagtgagaagacctaaattttagtcccatgtcctgtcatnatcatgcatagtgactctgggcttnccttatctgnaaaatgatatnggaccgtgatggtgatctatgtttaaggatcccctccaactttaagtgattacattatagacagaatgtgtttngtctttccattganagcgtatctgngtgatctttca

SEQ ID NO: 654657 - DNA, 722 bp, Homo sapiens
  misc_feature (583)..(583): n is a, c, g, or t
  misc_feature (619)..(620): n is a, c, g, or t
  misc_feature (680)..(680): n is a, c, g, or t
  misc_feature (714)..(714): n is a, c, g, or t
  misc_feature (722)..(722): n is a, c, g, or t
gcaccagcagagacagagagaaacaaaaaacagagggatgcacagaaaacaaaatggcatacttaagccttaaaatagggacagttattgtaaataaaaatggtttaaatataccaattaaaaagagattagatcaccaagaaatgatagatgtttaaggtgatggatctgtgaattacccaaacatgtatacatgtatacccaatgtatacatgtttcaatatatgttaccattatacaatgtatacatgtattgaaacatcacagtgtaccccataaacatgtataattattatgtgttaattataaaaaaatttttttaaatacttggcaaaaaaacagattggcagtatgaattttcaaaaaatccaatgtatactatctacaagaaatttacatcatagtacttcctgtactatattgaatagaagtggagagagtgggaatctttaccttgcactggatcttacaggaaaagtttttcatttttccccattgattatgatattaattgtgggtttttcataaatgacctttattttgctgagaaactttccttttatacttaaactgttcagcattnttatcaaggaagggatgtgaactttgtcaaatgctnnttctgtgtaaaatgagatgattttgggtgctttttatctttaatctggttgtatcacatngattcatatgcatactttcaggcttgcatgccanggattccn

SEQ ID NO: 654658 - DNA, 321 bp, Homo sapiens
  misc_feature (53)..(53): n is a, c, g, or t
  misc_feature (91)..(91): n is a, c, g, or t
tagaaaaaatacttttcaattacattaggaaaggcacggtggctcatgccctntgatgctagcagtttgggagcccaaggcaggtggattncttgagccccaggaattttagatcagcccagacaacatggagaaatcctgtctctacaaaggaatacaagggttagctggacatggtggtgcacatgtgtggtcccgactaatgaggtggctgaggcaagagctcatttgagccaaggaggtcaagactgcagtgggctaagatcgtgcatctggactccagcctgggtgacagtgagaccctgtctgaaccaaaaaaaa

SEQ ID NO: 654659 - DNA, 571 bp, Homo sapiens
ataggacctcaagttgtcaaaaaagcagggggttatttaatcgaacggccagtactatacggtctaggtacgaggctggtgcgatcaggagctctcagaacttcagccagtctagaagacacacaaacaagacagcaaggaacaacagaggaactttgctagggcactgcaggcagtgccaagggaagaggacacggaggcaaaagaacggacagcctcctccacgaggaaatgagggcccaggagacaagcaggagaaggcaacccagcgacgtcgcatggccgggagcggcgggtggcctccagggtgtcttataagaggagagtgggagtgatgaggctggcagcggtctgattttgagctctccagtggagaagcctctgatccctctgatgaggattccgaacctggccctccaaagcagaggaaagcccccgtcctcaaggacaaaggctgggtccaagagtgcctccaggacccatcgtgggagccatcgtaaggacccaagcttgccagggatcctcaagctcttcaagcagtaaagaggcaaaaatgtgcaggatggtgaaa

SEQ ID NO: 654660 - DNA, 191 bp, Homo sapiens
actttcgcctacccggagaggcccagaaaattgaccagatgatggaggccttcacccagcaatactgcctatgcaaccctggagcttttcaatccacagacacacgctatgcactgtccttcgccatcataacgctcaacaccaatttctacaaccaaaaagccagagacaaacctgacctaaagcgctcc

SEQ ID NO: 654661 - DNA, 471 bp, Homo sapiens
ctatgatccctgttgagagagcatgctgctgtgggcgctgcgctgtggaaggaccttgcatgcttaatgctgacttggaggattgaccaacagggtctatgcccttggcggttgacagggtcccagatggaggactactaccagatctttggcttacggaaggagtatgccatgctttgcgctttgggccgaatcgtctgaacaggctgggccatggaagagatgcgctgcatgagctcgtggcctaccagcagatgcagcctgtgatggtggtccaggcttagggaacaggagtgcagacttcagcctcactctggcaggggctggctgccgaggttgggcccaggccctgagggtctgctctgctacgggtctgcccttgagtggccttccgtggagggtgtgtgaccaggtggatggtgcagggcctctggagccctctactcaggagcagacctcagccttttctgt

SEQ ID NO: 654662 - DNA, 203 bp, Homo sapiens
  misc_feature (30)..(30): n is a, c, g, or t
ttcctactccattatataataaagcactcnccatttttttgtttgcttgtttatttagtggattcattttccgagacggagtctcgctgccccccaggccggagtgcagtggcgcgatctcggctcactgcaacctctacctcccagctactggagagtctgagacaggggaatcacttgaacctgggaggtagagcatgcag

SEQ ID NO: 654663 - DNA, 298 bp, Homo sapiens
cgtgctcgactctgactcatgatcgctgttcggctccaaagtgtggatacaggcatgagcacgtgctagctaaatggactattttgctcagttggttagttcattatcaattctggatatgaaagctttgtcagatacatggtttgtgaatactttctcccattctgtaggttgtctgttttctaactagatagtttcttctgctatacaaaagctctttagtttaattagatctcaattgtcaatttttgtttttgttgcagttgcttttgaggacttagtcatagagtctttccca

SEQ ID NO: 654664 - DNA, 195 bp, Homo sapiens
acttaatccccacttggtatcatcacccgatgaggcacacagcagaacgcctgaacgcaggccatacttccgatgtctacaccctagatagctcccttacccctactcatcgcactaatttacactcacaacaccctaggcccactaaacattctactactcactctcactgcccgtgtaactatctccgcctta

SEQ ID NO: 654665 - DNA, 207 bp, Homo sapiens
tctttgacccacatgtgagagatacaaatatagacacaaatgtgaacttatcaggaaagaactgtaaacttttattttatgacaggaaacagataaaatgtttcccatttctcaactaagaaaaataagttagtgctgacttagccagctgttactaatactcctttgatactttaagaaaatttagtcactggattagatacattg

SEQ ID NO: 654666 - DNA, 159 bp, Homo sapiens
atgttatagcagaagctctgaaggagagggccaagctcgtggacagagactgacaacgatggggaatgatcctaccatgacggcggatgacgatatgtgcaccaggatctacgtccgcagagtgagtggccacaggtagaaccgcggccgcataccacc

SEQ ID NO: 654667 - DNA, 936 bp, Homo sapiens
ctcgatactatcgcgccgtgcgcggtctgttcaatgttgtgagagccctttgcgcataaatggtgccgccactttcttgattggcgaatttctccccgacgccgtgatattccgggtgccgggcgcccgtaagtggggacttaccccggggatactaatggttcccgcgcgcggccgaacaatttttcccgggtgccgagcaggctccaaggtgccatagtttgaaagcgctactttggggatggccccacatttcatcagagatgcgcccaacagaagcgttctccacgttcgccacgcggggattttgggtgtcgccggtccccaagttgagatgcaaaaataggcggtttccacaatgtggggcagccccttaaaggggaatgccctttaaaatggggcaaacgtgtaattaaggacaccccctaggggttgtgttgaaaagaccccgtttccgagcacacttgtaataagaaagagaactgtcggggatgaaaaaaaatactccccgcgggtcccccccaacaagcaccacacgtgattgacccaccctacaattaggagtgtgttttttggaacccgcagtacgtttccacccccacttattgatccacgctacgaagaaaacctttaaacctttggggcaccattcctacatgcattaactctctctaccatacttcatcaacctaacattccagaccctcatacatcttgtttacaactcataccaagactcattttcacaacaacgacatcaactctcccccacgtccccccccacctctcattttttctatcttcaaacgacatctcatgagagtagccgcgcagcctcccccctctcccccctcctcgaaaacaagtatctcccatccacaaggactactcggacaacgaacaaacccctggtaccccaaacaaatgtcccgacaa

SEQ ID NO: 654668 - DNA, 163 bp, Homo sapiens
cggcgtgataaccgccaagctcgccagctcataggcctgtacgttcacctgggcgatgaagttgtcaccgcgatacgtcgtcgtggcctgttgatttacatagtcagcgcttttgacgccgatctggttgctctgcaggtcctggaagtagtacgggtcgctg

SEQ ID NO: 654669 - DNA, 195 bp, Homo sapiens
aagcatcacgcctggacaaattgatgacaatatgcatctgaccgacgctaagggagatctcagaaacccgatggaggcaatgatccacacatatttacttcatttaaaaacctgcgcaaagcttggcggaacgaaagctggtggcttaccatggaagtgaaagaccatcactgttctgaagagggggttttcaaa

SEQ ID NO: 654670 - DNA, 128 bp, Homo sapiens
attgatgactcgctcatcggtggaaatgcctccgctgaaggccccgagggtgaaggtaccgaaagcacagtactcacaggtgtcgatattgtcatgaaccatcacctgcaggacacaagtttcacaac

SEQ ID NO: 654671 - DNA, 105 bp, Homo sapiens
tgcaccatggtctgtgtgtcatgtgtcacatgtgtggccatgcacacatgtggcccctgcccagtgaccatgcccatgcctgggagacggggatgacgggctcca

SEQ ID NO: 654672 - DNA, 135 bp, Homo sapiens
cctttaagggaaaaccccttttttttccggggcccccttttttgttttggggcttttcccttttttttcccccccccggggtttttttttttgaaaggttttcccaaaaatttaaaaaaatttttttttttttga

SEQ ID NO: 654673 - DNA, 862 bp, Homo sapiens
  misc_feature (862)..(862): n is a, c, g, or t
ggcagcacgactcgcgtagccgtgcgccgattgcctctcggctgggcaatggtcccggattgccggtcgacgaccgccccgcgtaatgcggctcctcggctggtggcaatgtattgctgtgggtgctgggacttcccgtccgcgcgggtgaggttgcatgaggaaagtggtcgctgtaagtgtgtcagaggtagctagcctgctcaccctctccaggtgggggctgtgtacctggttgcaggcagggagctcctgcatgagcccgatgggccgggcacagggctgccatgaagaggccaatgcggtgctggcgctgtgacacccaaggtcgatcacagtggtgatgctggtctgtggattcctgggagaagctgacgtgaccagaccgtggcatgttcagagcctagcggcgtcacctgtgagtgctggacggagcgagaaggactcacggtgtcaacgtccgagagagcccttttctctctggaatggcgctggagccaccacttccctgacagagcacgcaggagtattacccaagagcccagaagtggcggaatctggatcggcagccccgacagaggacttccaaataacactgaaagtctgaaaatccccaaaggtgaacttgtgaggagagcaaacattaccggcattagaaaaatttcctctggaacatttccacatatggccacaggaccttttggattttctgaacccaaggtagtgctgtctcttatctggtttaaccccgggggccgttttctgcaattggccctcattaatcttgccggcattccacgcctcatttggcaggtgcttcagcacagcttcacgggggcggagcgcaataatttaacgaggn

SEQ ID NO: 654674 - DNA, 484 bp, Homo sapiens
  misc_feature (5)..(5): n is a, c, g, or t
  misc_feature (70)..(70): n is a, c, g, or t
  misc_feature (102)..(102): n is a, c, g, or t
  misc_feature (105)..(105): n is a, c, g, or t
  misc_feature (117)..(118): n is a, c, g, or t
  misc_feature (144)..(144): n is a, c, g, or t
  misc_feature (165)..(165): n is a, c, g, or t
  misc_feature (203)..(203): n is a, c, g, or t
  misc_feature (213)..(215): n is a, c, g, or t
  misc_feature (330)..(330): n is a, c, g, or t
  misc_feature (339)..(339): n is a, c, g, or t
  misc_feature (352)..(352): n is a, c, g, or t
  misc_feature (363)..(363): n is a, c, g, or t
  misc_feature (378)..(378): n is a, c, g, or t
  misc_feature (381)..(381): n is a, c, g, or t
  misc_feature (477)..(477): n is a, c, g, or t
cagtntaccttgttagtggtaatctttgctttgacaacacatgggaaactagaaacaaatgttataaganggaggacaatctgtcacttttcacaagttatnaanctaaaaataggnncttttaagtgtcagtcaaaatataancagttcttattctctttaatncaatttatgactcagtttttacaaccattttaagactntgagccaaannngagagagaaggaaactttcagacattaactattcatggaatcctaaaaccacacttttacacagattactaactaatcaacatgttacatcactaaaaaaaaaaaaaaattaggnttgtaaganatgaaattgcagnaataaattttntttttaattttcagnagntaaaaaagttttaatactttaactgttaacaaggtcttagttgatatccagttaacctaatactgcattaatgtttttattcttttcttgaaaatnctcaaat

SEQ ID NO: 654675 - DNA, 877 bp, Homo sapiens
  misc_feature (424)..(424): n is a, c, g, or t
tcgacggaaactggacactggacgtctagttcgccatgagactcctcccccgcattgcgtgcatgcttctcttactcgtgttccctgcctctgtcttgttccgaggcggtcccatatgctcgttagcagtggctacaatatcttacagaggatgaagaatcagtcgaagattccataattgaggatgacgatgatgaagccgaggtagaagaagatgaacccacagatttgggtacaagataccagaggacgaagatgtgtctcggtgaaccgtgaagcttcaccgagctgcgagtatacacactcatacgtgttttgtccaaggcagaaagtattttccaggcaaataacgattgtgacagttgcctggtaggtctttaccaacgaaggcgtaccagcaagattctctcatgtgtctgaatcncttccagatgcctcgattctcgttatccgtcaggactcaccagattttatagtccagaaattacacagactcttcctctgtaacactgtacgtgccaccccatgagacaggcaacttttgagtactctttcattcctgcagagcccatgggcggacgaccatttggtttggtcatcaatctgaactacaaatgatttgaacggcaatgtattccaagatgcagtcttcaatcaaacagttacagttatttgcaccgagaggatgggttagatggagaaacaatctttatgtatatgttccttgctggtcttgggcttctggttattggttggccttcatcaactcctagaatctagaaagcgtaagagacccatacagaaagtagaaactgggtccctccagctccgactgactgttgacctgccgttgggattcctcaggaaactttgaatc

SEQ ID NO: 654676 - DNA, 286 bp, Homo sapiens
tataatctagcaggctccatctatacacgatataatggagagtcagacacgatactcacatatcgacaagaacttgtacagggaggcatagcaccgcagtaggtgaatacacctcgaccaggctccatcttaacgatctctggaggtcaacacggaacacacgtaataccacagaacatgcacagggaggcatgcaacgcacgatggtgaatacacgtcgaaccagacaaggacaatgcaatgcatgaatcgagatactagaaggaatcctactagaagtcgacca

SEQ ID NO: 654677 - DNA, 1102 bp, Homo sapiens
gcctcttcgagcactgccccgtagaagaatgccgaagtgtacctggaacgggctgggctccaatcaaggtggagccggactcgccttctcgcgcaggagcagttcgggtcacgcagggaatggaatgcctagtggaggtctgtacccgcagttcactactgtttgtccacaggtccaaggctaggagacagccgacgggtagcccagtgacgagcagatgactctagtgcaggtcacggggaatttctattgggaaagtggggggctcatgacacagaatctgagttaccgaggccacttcaaacgtacgccgaaggaaatggacacagcgagaagaggatgcgagggaggcaactgctcggagcctcacacgttcttacttcagatgacaatggataggagaaggaaggagtccaatactggagtccgttcccgcatgttctcattggctacgtcccagaaagcagtttggtctggtcgtaggagagactctgcgctggtagtccctagctgcgtatggcacggccaggatccgatgctccagtgcagctggggtgcagttgcggggccgcaggggtcggtcctagcgtcgcagtctgggtcgctaggatggagcccctcgcgggcgaagggtgatcctgactctcggtaccgtggaggcccagccatcgcttcgcgtcgcgccattccgtcagctggtggcaaccgtgcggccgtctacgatgcttccagcgagggtggctccctcgtcaatcctggacggtccgctgtgtggaacccgggagggcccaactcaagtgtcccagagaacgccacgtattcaaaccatgcaggggatcctggaatgtgaacgcgtgagacctccggtcctgggcaaggtgcccaagtgccaacagtggtcgtaggatcacgacctttgcccttgacgatcttcatgacctttgaagcctgggggggaagaaacctcactctcgcgttatcccggtgccagaacgaaccaagcgctagtccgttgcgaagaaactttcgggtgaccttgtcatcgcccagatgtctaccctagcggtacaccaggaagtgagtccgggctaatactccttgc

SEQ ID NO: 654678 - DNA, 158 bp, Homo sapiens
tgacgttgattaaggttttccccatcccctcaatctagacggggagcccctgcgcatcaactagctcccttggccaggagcgagcgaagctgtggcctttgtgaagctagcctcctcttctcccctcacactacagccctagtgggggagaagggggt

SEQ ID NO: 654679 - DNA, 109 bp, Homo sapiens
gtgtcaaatggccggacatcccagacacgaggggtattgtccattgcattggacaaaagataagagccttcagaacttaaactcaggccagtcactgaatctgcatggc

SEQ ID NO: 654680 - DNA, 198 bp, Homo sapiens
ttattgtctatgaatggttattaacaagtctatataaggttaggattccaattctaaagtggtcacttggagagcctgtcagggttcaggttgtatgtcatgtaacgaggagtagcactgaattgggcataagacttaatgaccttatttacagcttccaagaaatccttctcggtagcaattttacgccgtgctctg

SEQ ID NO: 654681 - DNA, 862 bp, Homo sapiens
ccgggggctgcgttggcgtctgtgggtttgtcttcgtccttctgtgtcgtgtgtgccgcggttcgccggttggggggtgccacgcgggtgccaccgtgccggactgtgtgttcgccggtaggcacacgggttgttccgccgcttgtggtcaaaaccgtcggggtgggtggccccccatacttgagaggcttgggcgacaagggcgccccctctggtttggtaaggagtttcgctggctaagcaccccggtctctgaggcgcgtcttgtccacgaggtcgggttcccccacctgggggttggccattccctgttgcgggcgctgaaatgtaacaaccaccatggtatcccgagggcgatgttaagccaaaacgcgctggcaacaccaaaaaaagggtcgccccagggaccagtgccccacgagacgctcgcccaactttttcgcctcacatagatcctcgcagaaatgctcgacaacgagtttctattcactcctctatgatgcctgcccccccccctctattatatccgcagtaggcgtaatcctgccttttatggatggtctgtctatgtgcgaatgcggccctccttaactgtcgatcaattagaaaaccggtcctcaagacagatcacgctggacgcccacgtaggacgccactccgtccatacggaatacggaacaattcgttggaggagacccacgcggtcgtttatcttcttctcttcggtcgggcaccgttctatgcatggaatcagtcatcattacagaccctgaagactttttcctaggtggaattcactcttgggcccccacaaatctctgccccccaggtgtcagcacccctataaaacgcccacataaca

SEQ ID NO: 654682 - DNA, 596 bp, Homo sapiens
  misc_feature (140)..(140): n is a, c, g, or t
  misc_feature (181)..(181): n is a, c, g, or t
  misc_feature (189)..(189): n is a, c, g, or t
  misc_feature (191)..(193): n is a, c, g, or t
  misc_feature (221)..(223): n is a, c, g, or t
  misc_feature (273)..(274): n is a, c, g, or t
gattgtgttaatagggaatgcccgggaaacccagtctcttctaatggttatactaaaaaaagagtctgattacattgtgttttaaccggttttattaagtcacttcacttccaatgaatattcattaaatataccccttntgttctacaaaaaatgaattatctgttacgaacccattttnttatactntnnnattaatataaggaatatattttacaatnnnatgtttctatatttatagattaatatttcagccatttgagttgaaaatannatttttagtcattctcccttactggttgaatcagaagattaaccgtgtctgatttgaacggccttattatgggtatattgaagaatattttggccaagtttaagaggattactattatcaggatggctagcaaacttttctgtttcaatttaagtatataaagaaacttacttactcttagaggctctccacaccccttaaaacaatgaaataattatgtaatttaaatacattttagttttaaacatacaggcatacctcagagatgttgtaagttctgttccagactgctgcaataaagcgaatatcacaaaaaaaaaaa

SEQ ID NO: 654683 - DNA, 181 bp, Homo sapiens
actccccctaccctcggcctcccaaacgtgctgggacttacaggcatgcgccaccacacctggcctaactacgtgcctttacaattgttgtttactaaacacgtccaacttttgttttgggactttcctacataaaatcagtaacacaaaaacaaaaaacaacaaaaaacaacaaaaaaca

SEQ ID NO: 654684 - DNA, 106 bp, Homo sapiens
cctgtcatgtacagggcttcatgtaccgggaaggagagatagggcacaggtacattgaggtgtttaagagcagccaggaggaagttaggtcatactcagatccccc

SEQ ID NO: 654685 - DNA, 2188 bp, Homo sapiens
tgcttaccaggtcttctacccggtgaaccgaatgctctgtcagtctacctcactctgcgtcctacggaccgcggcccgtgtccctcgacaaagccagatgccactccccggagggacccaagccaagcaggaatccacgggagagatggaacaggacgcaaggaagtggacgcggaggcaagagaagaatgggagacgcagcaacggctaaccaggagacatatgagacggacacgaccaaatgcacctagacagaaaatggaggacccggggacgacaccatatcacggcgcggataaggcacaccagggggacacgaacagacatgaagagaacacatggcacaaaagggaggaaaggaatacccagtatacacattaacacacagtgcacgcatagctggaaaccaggaaatcacaaaagaatcggagaggaacccgaccacgagacagcacaaccagccgacaacacacccctaagaacgcactcgaacaaaaaaggaaagcaaccaacggccgtcacatcgggccgcattggcagaggtatcccagcacagggtctcgaacgacttctacccagaaacagtggaaaagtgggagtgaaaataacgacgtttgctcagaaacaagaattgaacatcaacgtagtggacacccaaactatctccgcagacagcattaactatccccacaatgaacaatgtcgacaacagtggatgcacagtgtgattacatacaagaacacatcacagaaggaacagggaatagactaccatggaggtacgaacaggcacagcggctcagcagtgcaagcacatatatagccatagtacgcttggccgaaccagccactgtgggcgcaattcacatctctgtactaatgagtaacacagaccaatctctacagacatggcggccctacctgacgtcggggggacgatcgtttatccggcagtttcaacaatgtaatgtctgcccatccattcagtgcatattactgacaaaaggaaaacctaaggagagagcaactagcccccacagcatggtcttgcgctgaccctatcacatgtgcgcacacccggattatcattgttacagacacaacgctgtacatggtggcttatgccctaactgaagcacaacgcgtacatactctcgttttctcttcttatccactcacatatcattctgtgttcacacacgacaatccagaacaaaacagcacgatcagaaaatcaacatacaagcagacgaacaaaacacacaacaaccaaaaccacaagcaagacaacacacaaccagacctcaacaagcatcagtaaacacaacaatacaaaacaaacaaaacaatagaaccaacaacatgaacacaacaaaataaatacataaacacgagcacagcacaacggagaggaaccagaagcgacaggaagagaagcgccacgagagcacacacacaacagagaaacaagacggcgaaagagagagaagaagacgcagacacgagcgagcacgccgagagaggaagaaggaaggcgacgagaacgaaagaaagcgcgagaagagcacacagacgaaccacagaagaacgaagaagaacaagaagcaggaaaacagcgaagaacaagagaggcacgacgcgaagcagagaacgacgacaagccgcacgcgacaacagaaaaccaagagaagagacaagagagaccaaagagaggcaaggacagaaacagcagcagacaagaaagagcagagcagcaaagagaaagacagggagacgggggaacgcacagcaccaggacgacacgccgcacgagcgcagccacgaagacagcaagcaggcgagcacgggggacgccagacgcagaaaccaagaagcacacgaagcagaggcaaaacggcagagcgcagacaccaggaccaacaagccaggacgcagaagacaggaggacggacgccaaagacaggaacagcacgcaagcgagtgtagaggacaagagaacgagcacgcagacgcacagcagaagagcagccggaagagcaaacgagagcgcgacagcacccaacgacgaggacgagcagcaaagccacacagggccaaaaacgcgaagcaccgagcaccgaaccaagcgccgcggagcgcgcacagatccgcacaccaacagcggcacccacaccagccgctcaacgcc

SEQ ID NO: 654686 - DNA, 296 bp, Homo sapiens
tcactttatacttctaaaagctataataatgttattcacagaagcacttcaatctaattgccttagcctctgatctcactttcaataatcctccttattgtaaccgtatcaggggagtgtacgcataataaataggaattttgcaccatttttcttgactgttactttgcattgtcgtgacttggagcaccctgtggtttctgcattagctgtttgcatgtatttagtaggttagaggtgggaactagagatcagagaattgtttatggcagcagagttagcagtaacttgagagg

SEQ ID NO: 654687 - DNA, 145 bp, Homo sapiens
gacccaggtatacactttactctctcccacttcgccgtgcaacgatgaggtaatgaggtcagtggggtaatgaggtggagatcctcatagaagtcgaacctgcattgcatagcaaagctatggcacatggcctgacgattttaca

SEQ ID NO: 654688 - DNA, 354 bp, Homo sapiens
tcaagaggtgaatgtgacactgacactgaggagaaggaaacgtgtttttttgagacggagtctcattctgtcacccaggctggagtgcagtggcacgatctccgctcactgcagcctccacctcccgggttcaagtgattcccctgcctcagcctccccagtggctgggatcacaggtgtgtgccaccacacctggctaatttttgtttattcattcgtgtgttaatggacacaggttgcttccacctcttggctgttgtgaattgtactgctgtgaacatgggtgtacaatgtctgagcccgtgcctccagttcttttggggtgtatagccagaagtggaattgctggatcag

SEQ ID NO: 654689 - DNA, 104 bp, Homo sapiens
actgtaccccagctgtatcttccaaacagctttcagcaacatgaactttcccattagatacatcaatcactcgggctatgggaggtctgaatctttcaacggca

SEQ ID NO: 654690 - DNA, 104 bp, Homo sapiens
tggtccgcttctgcttctgcctgcttctgcttctgccgcttctgttctgctgcttcctgcttctgccgcttcctgcttctgctgcttcctgcttctgcctcccg

SEQ ID NO: 654691 - DNA, 771 bp, Homo sapiens
  misc_feature (88)..(88): n is a, c, g, or t
  misc_feature (93)..(93): n is a, c, g, or t
  misc_feature (128)..(128): n is a, c, g, or t
  misc_feature (139)..(139): n is a, c, g, or t
  misc_feature (142)..(142): n is a, c, g, or t
  misc_feature (145)..(145): n is a, c, g, or t
  misc_feature (147)..(147): n is a, c, g, or t
  misc_feature (152)..(152): n is a, c, g, or t
  misc_feature (202)..(202): n is a, c, g, or t
  misc_feature (238)..(238): n is a, c, g, or t
  misc_feature (246)..(246): n is a, c, g, or t
  misc_feature (258)..(258): n is a, c, g, or t
  misc_feature (281)..(281): n is a, c, g, or t
  misc_feature (290)..(290): n is a, c, g, or t
  misc_feature (295)..(295): n is a, c, g, or t
  misc_feature (300)..(300): n is a, c, g, or t
  misc_feature (320)..(320): n is a, c, g, or t
  misc_feature (327)..(327): n is a, c, g, or t
  misc_feature (341)..(341): n is a, c, g, or t
  misc_feature (355)..(355): n is a, c, g, or t
  misc_feature (417)..(417): n is a, c, g, or t
  misc_feature (463)..(463): n is a, c, g, or t
  misc_feature (477)..(477): n is a, c, g, or t
  misc_feature (479)..(480): n is a, c, g, or t
  misc_feature (599)..(599): n is a, c, g, or t
  misc_feature (606)..(606): n is a, c, g, or t
  misc_feature (610)..(610): n is a, c, g, or t
  misc_feature (612)..(612): n is a, c, g, or t
  misc_feature (616)..(616): n is a, c, g, or t
  misc_feature (625)..(626): n is a, c, g, or t
  misc_feature (631)..(631): n is a, c, g, or t
  misc_feature (699)..(699): n is a, c, g, or t
tcctgttgtttgtttttctaatttgggccttaatttgtttatttgcccatttaagcaactaccagtttctttagtcaacactaacggntttcncttttcagctagtcaacaaagctttttattttttnccttctcttgnggntancnttttngtgttaccgcagactacatttttctttccattgttgtgactgtccacaanttaaccaggttaattttcaaagatactttgggaatnctccccanaacaccaccggntttttttttttttggtttttaanggcttaggntttgngggtngggaacttggttggggcggngcttaancaatttttggcctnttcttgcccttttngttttccaccaaaatgccctatcattttttttttttttggtttactggagggttctgtagtncgggttgcgggaggggaacgtttggtgctttttactttcttttttntcctctgctctttncnnttttttttctggtctgtatgggctattttttcgtggttctactgcatataaagccttttcatcaaagcattaacaatgaataaaataacatgattacatttaaacaacgctgaccattnccccccntttncntttnttgtttgtnnggggngttgacacttagtaagtacagaatgtaatgtcagcctgcaacttcatttttataaaggctaaaacttntttatatgggatattgttctatatactacgcgccaatctatattttaagtcctgtagttaggtatttataag

SEQ ID NO: 654692 - DNA, 630 bp, Homo sapiens
atgccccctgtggaggagctggatgtcatgttcagtgaactggtggatgaactggacctcacagacaaacacagagaagccatgtttgcacttccagctgagaaaaaatggcaaatatactgtagcaagaaaaaggaccaggaagaaaacaacgggagctacaacgctctgcgccctgcaattctacattgactcagctcaattccatggcatgcctagacacaactcctctgactgcgctttagcagcaaggaagaagacagcacagacagcacgtacaaactactagagcagctttaaagacacgcactagaggacaaacaccaatgaggtatatagtaaccagattcatcgacttggatggcctatcatgtatcctcaactttctaaagaccatggactacgagacctcagagctctcgaatacatacttctctcattggctgtatacacacgcgttcctgcaacaactctcacaggccgcggctcacgtcctggctcattctgcagagtatcaactgtacattgctcagtagtctgagcacagagcaacatctactacgaagcgtggccgtgctggacatcttgggcgccgctgtgcctggttcccgcggggccaccagaacggtc

SEQ ID NO: 654693 - DNA, 123 bp, Homo sapiens
cccgcgcacagttgggcacaagtcacatggcaactgagcaagctgctggaatgcagactaaacgaagatctaacaccagaaaaccaccaaaattagatgacatgctcaagcagatggcacgtt

SEQ ID NO: 654694 - DNA, 880 bp, Homo sapiens
  misc_feature (522)..(522): n is a, c, g, or t
aaactcctctaaaggaaatggtacatttttggaaatttatccttatccctcttgcagctaatgggctcttaccaagtttaaacacaaaatttatcataacaaaaatactactaatataactactgtttccatgtcccatgatcccctctcttcctccccaccttgaaaaaaatgagttcctatttttctctgggagaggggggggattcgatctagaaccaaattgtagtgtgtcccatataaaatttgttgcatatggcattttctaacttaggaagccacaatgttctgtggcccatcatgacattgggtagcataactgtaagttggtgctcccaaatcactttgggttagaagaatttctgtgatactcttatagcctgccttcaattttgatccctttattcttctatttgtcagcgtgcacaagattaccttcctgttttagccttctgttcttgtcaccaaccattcttacttggtgggccatgtacttggaaaaaggccgcatgatctttctgnctccactcagtgtctaaggccaccctgcttccttgtgttggttccccacagatatctcctcatcctatttactgcaggcacaatctctcttagttgatgagacttgtgtttattccttaaaacctacctattctgatgtctgccattgctgcttaaaatcttcctcttcttctccttaaactaaatatgtgggaagtataccagggccttaaaattctccggttggaaaacaaaatgcttaaaggtttttaagagcacaaaggaagttttgtttgcccgtgccaattgggggaaaaaaaaaggggcgggtaacgggggggttttcctgtagtactccactcatcccccacctctcgcg

SEQ ID NO: 654695 - DNA, 1314 bp, Homo sapiens
catgctccttaagagtcatcaccactccctaatctcaagtacccagggacacaaaaactgcggaaggccacagggacctctgcctaggaaagccagggtgaaggtacgctcgagcgtggtcatatgaggacaagtcgacgagagatcccgaggacgtctacagtcagccttacgacatttgaagttctacaatgcacccatcggagcatgcaaagaaaagcacctccgcggagcacggagacaccgacaatcgagcaccgtagactcacaagatgaagcaaacatggtgacatcagaacagctgaagttgccatccaccaagaaggcagagccgcgcgactcgggcaacaactaaagcaagctgacgcagtgtagctacgacacaatatctagagcaacacaagggtgaccacaaaccccgagagcagtatgctgcatgccaccatcagctgactcgcatacaccgagtgctctgcagagagtaacccaaccaagctccgagagcagaccaccgagccaccgagcaacgggccacgactgacgagcgcaggtcaccgccgcactacagacaaagcgggccccaaccgcgcgcacgaccaaagcaccgcagaacgactcaacatcgcacaccgcgtgaccaagagctcacacagccaacgccacaccctacggagcacccgccaccgcacgccctggcactcacgccccccaacctccccgccgacgcaccaccccagccccaccccactcccccgaaccaccaaaaccacccgggccaccaccgcacccacatgcctccacgaggccaagacgccagctcaccaggccaaacacggaccggcgcacaacagccgccacgccaagacaccaaagaactcaacaggcccacagccacccaaccaccgtcaacaccaccacaccaaccaccaccacaaccaacagccccaaccaacccgcccagacataccgcacggacaccactcgccagcgagccaagcaagtcacatggaacgagactcacacacagagaccaccgcaacaacgcgtacggcggatcccaccactacacatcctcgcgcaacccatccacggttctggtctagaactccatcacaccagagaagagcagcaaacagagcgaaaacgaagcacgaccacacatagaaaaatagaggaggaaaccggagacgaaacgacatagacacaaatcctaagagagaatacacaacacacaatcgacaaacataacgagaaagccagcagaaactgcacacacacgtgaactcgcgacgactcacactgacaacaccccca

SEQ ID NO: 654696 - DNA, 112 bp, Homo sapiens
actcttgagtatcccccagaatcatggtgaccacacgaggggctcgggaaggggtacgctgtgtccgtcgagacaccaggatgcccaccaccggcgcccggtgcatcagctg

SEQ ID NO: 654697 - DNA, 270 bp, Homo sapiens
gctcgactcattttgtttgttatgaaataaaatcatatagcatgtactcctcccgcctcagcctcccgagtagctgggattacaggcatgcgtcaccaagcccagctaatttttgtatttttagtggagacagggtttctctgtgttgtccaggctggtctcaaactcctgacatcaggtgatccgcccaggctcccaaagtgctgggattgcaggcgtgacaccgcacctggcccaagaaaacgtcctttaaaaatgtagtcgacgcgg

SEQ ID NO: 654698 - DNA, 820 bp, Homo sapiens
gcaactgtgatattcatcatcgacaaaatgtctgtctttgtgtctggaagtttgttagaacaggaaagaaggggaaaagagattaattagcgtctgaggctggtaagctggtgaagacccgaataaatgaactccttttagtttattacaacaagaagaggttgtgatatcaagagattcgctttcttcgttgttgacaaatactatgtttcaaaaatcttaccattgtcgaaggtcaagaatttggtttaggtaagcctgtttaaacccgattaagcaaatatattttaagtgctcaaggggagagaaagagtatgaggggaaaaaacaaacaagtgatagtagaagaccatagtgcaggtatagtatggacacagtgtatatgaggctgtatagttgaaactgatattggtgtaccgaatttcgacaggggttaccatgagaagataaaagtttaactaagactttagcgtagcatgtcaacacattggtacatgtgaaacagagaagcattaagaagtcgcagtgagctagtatcaagtacgtgtgtatggaagatactcagcatacttgggatccagtgtcatgcaggattgtgtcgggttaacgtgtgcggtaaggacgggaaacagcttcagttaaccgtggaattccacatcgggcacgcaacgcccacccgccaccacactcccagcacacaactgcccactccctgcgcggcgcgccacagggcgacccccgcgagaaaggaggaccagacagaccgggaccctgaggagcacacggcacggggccacgaggcaggcacacaacgcgaacc

SEQ ID NO: 654699 - DNA, 383 bp, Homo sapiens
  misc_feature (296)..(296): n is a, c, g, or t
ctcatccaataagtgttccctccttattaagttttgttcccgaaagtgaagtccatgcctttagaatgatacgcattttctcacccaaagaatcgtgtcttcacacggttctcaatacctgcagcaattcccttaccgtgtctgtagaaattctgaacctgtgaaatggtcatttcaaagcacttggtcttcacttggcttgaatgatctgccactttatagcatcagtgcaagtgtaagaatccttaagagttctgcaagtgtctgagctcacagccataccggtttccactganaatccacaactctggttgtgtcacatcgcacatagcatacagcggcggctctctgcacgcctacatggacagtgtctggcacgtgcg

SEQ ID NO: 654700 - DNA, 126 bp, Homo sapiens
gccaattatagcaccgcgggggtacaggtgccctcttaaggggcagtgacagtctctctcccagcacgcttcttaatcagcatgcgggctgtgacatgcggaaaccaggggcacaggctctgaatt

SEQ ID NO: 654701 - DNA, 207 bp, Homo sapiens
tgcggattatgccacttgggacatgagtacagatccactgccgtcaactcttcttgaatgggacggctccataacctactgaacccgtgagttggccaacgtattaacttatgctgacgtttggcgcctatgacttggtctgctccagaactttatgtccgagagtgaaggcagctggcttgctcctactttcaggaagggatgcac

SEQ ID NO: 654702 - DNA, 195 bp, Homo sapiens
caccacccatcagctacaatctgcttcaccacccataagctacaatcgctctcaccacccataagctaccaatcgctctcaccaccccataaagctacaatccgctctcacccacccataaagctacaattcgtctcatccatcccaaatttagtgcccttgatccaactgttctctcaagtttgcagtgccctc

SEQ ID NO: 654703 - DNA, 367 bp, Homo sapiens
cgtttactctcacaactggttatgcacgtgtcgcacggctacactaccgagcagtggatgacaacctccttaagttccttgtctgatgatcatcaacgtgtagcgcctgagtggtatcttcctatcattcccatggtttcaataaatggtgctgaaggcattggtactggatgggcttgtacactaccaactcatgcatgctagggacaattgtgcacacaggtcagacgcaatgctcagcatggcctggatcctcatcccatgcttccaaactcacaaaaactttaaaggcccgcattcaagcaacttggtcaaacacagtatgcagtccgtggtgcaatattagtagtggcacagcaaccacagt

SEQ ID NO: 654704 - DNA, 341 bp, Homo sapiens
gggaggctgagcctacaatgaaccatggtcatgtcactgcattccagtctgggcgacagagtaagactctatctcaaaaaaaaaaaaaatttcctccggtaaggtggggactgaagaaagaaatagaaacttaactgaacagggaagtagaagtgttggcccaacaaactgacgtgagacagggaagactgctaaaagggaaggaaggaaggattttctggtacttaacattcttcataaatctccggaaacagagtaatataaatggtggagggcatgtctggggggagttcccgggtatagcctttcacgcttggtggacatgggcgtaagggtaccga

SEQ ID NO: 654705 - DNA, 178 bp, Homo sapiens
aaagcccctgatgctggaggctgtattcacgctgacccagacctggggatgccgagtcctacaggatgctaatcgtaagaggcttttatacaacaggaaaggccgatcagaaataatgctgatgagtcagacaacacagcgaggctgttttccagacctcctatgaaaaaaaaaaata

SEQ ID NO: 654706 - DNA, 423 bp, Homo sapiens
gcacgaggccgcacagactgcgcgtgaggaactcgataatagaaaagtagaaaagatattgagcagaattcctcttctcccgcctctcaggaatgacacacatgagagctgtggctcctcggcttatgataactcatattgtgaaccacaacttcaaatcctatgctggggagaaaaatctgggacctttccatataacgcttttcctgtgttatcgggcccaatggcagtggcaaatcccaaggtattgaatctatgccttttgtggttggctatcgagcaccataagaacttagtgacacgggaaggtcattttccaaagataattggttagggaggggatgattatgaaggcatttcttacagtttctatgtgttcacaaccggccgcggagataatacctctgtgtattacatgagggg

SEQ ID NO: 654707 - DNA, 168 bp, Homo sapiens
tgtcattactagaagactacttttccaagactgggcggtaaagtaggcttataaaacaatacagcaaaagaccgccaagtggcctaattgtttccagctgtgcttgccaatcttagcatggttactttccagaatgtcactcactaagttttacttctaccagtgtag

SEQ ID NO: 654708 - DNA, 241 bp, Homo sapiens
  misc_feature (25)..(25): n is a, c, g, or t
ggcccgggccccccccttgggcctngggggttttttcctgggaatttggttaacccaaaaaaattttttcgttttggttaaaaacccgggggattaaaaaaaaaagctggaattcccgtttgaaaaaatttttttttgggtgaggttttttaaaaccggttttttttaaaggccaaaaaaatttttttttctttttttggattttggaaaaccccttttataaaaatttgggggctgggga

SEQ ID NO: 654709 - DNA, 107 bp, Homo sapiens
gggggatatttaaggaagggggggaggagctaaaacccttctaaagggggggggggtttagggccaacaaggggggaaaattttaaccccccaaaaaggttttccca

SEQ ID NO: 654710 - DNA, 217 bp, Homo sapiens
  misc_feature (48)..(48): n is a, c, g, or t
  misc_feature (58)..(58): n is a, c, g, or t
  misc_feature (96)..(96): n is a, c, g, or t
gtatagccaacgaatccccaacagatgacccccaccgtgcacaccccnatggagagtntccggaagtatacaaagatgggcaagttttccagaaantcagaggatattaggcccacttttattgacagcccttgttggtttttcagtttaatcccacaaatttttattttctctggcataaatcacaaatcccattaatatttgtcatatttgtcgt

SEQ ID NO: 654711 - DNA, 324 bp, Homo sapiens
tacggaacttgataatagaagatctccaccctggtctagaacagaggaaagacctaagttagtcttattatatttgttaattatttaaaatatgctctaacatttatgagttgaagactattttacaagatttgtctggttgctcataaaactatttaagtaccaagcattataattagcctgccaatattgtctccatgatctagcttctcctcacaaaatcctagacgctctcttgaggatccagaactattgtatatatcatatatctttgatatcaccagatgttttacatagatacctggtcacacttatgagaagctt

SEQ ID NO: 654712 - DNA, 300 bp, Homo sapiens
gcagttcttgtatatttagaggagacggtttcaccctgttggccaggctcgtctgggactcctgacctcaggtgatccgcccacctcggcctcccaaggtgctgggagtgcaggcatgagccaccgtgcccagtcaactccttctcaaaaaaaaaaaaaatagggcggctttctctttcaggtgtcctgattggggtgatggtaaatgccactctacttataggggatctacctcagaaggctattggggacactggaaagagaaagcagcactattttttttttggggggactcctcta

SEQ ID NO: 654713 - DNA, 126 bp, Homo sapiens
tcaacgcactgtcaagcggcagtgatgtgggagctgaggagcacggggctgtgagtgacgaggccgcgtccggggctcacatcttggcactgactccccaggacaacttggttccccacccaattc

SEQ ID NO: 654714 - DNA, 195 bp, Homo sapiens
catgatccaggacccgacctggcggacttgctgcgcgattgcggcgcggtcgtccttcgccaggctctgagtaatgacggggccgaggatcgggtcgaagctcgatttcagtttctgcggtatcgagctgatctgctgcgccatgtagtagatgccgacatatttgggctcgaacatcacgcccaggatgaagcg

SEQ ID NO: 654715 - DNA, 169 bp, Homo sapiens
tatagacctgcctggttgatcctactgtaggctggcagcaggaagttgagcagccaacacacaaaactaccgtttgtgcataggtaatgaccgtggtgatattatagcatacctgggcatatcacataccatgaagtaggaatagtgggctctgcaccaggcgtaagtg

SEQ ID NO: 654716 - DNA, 506 bp, Homo sapiens
atctctttgccggagaggtgctgaatgtgtgaataccgtggggcaaagagcttccaggctcaagagtcagaggtgaacagccaaggtgccccacagactgtgaaaagcaaagggctcgcatgcaaagcctcatgagcgccagccgtgcttgctccaccttgttggtccctgcttgtactagtgagggaatttcctgcctgtccagtgcttcaactcagaggtgctactgtgttgatgctgagggtcaggccattcctggaactcgaagtgcaatagggaagcccaagaaatgccccatgccctgtcaattacaggctgagcaatcttttcctcaggacggtgaggccctgctctctaactccagcatgctcccaccctttccgacacctacatcccacagtgcagcacctgatggcagtggatgccaagtgcaatgaattgggcctcccgagcagtcttcgagttgtccaagatgggaggctcagacagggccaggatctgacgcc

SEQ ID NO: 654717 - DNA, 631 bp, Homo sapiens
  misc_feature (302)..(302): n is a, c, g, or t
  misc_feature (592)..(592): n is a, c, g, or t
  misc_feature (595)..(595): n is a, c, g, or t
gtggtcccaagaaacacctgaagcgtgtactgctccaaaacattggatgctggataagttgactggcgtgtttgctcctcgtccatccactggtcctcacaagctgagggaatgcctgcctctcatcattttcctaaggaacagacttaagtatgccctgactggagatgaagtaaaaaagatttgcatgcagcgattcattaagattgatgggaaagtcaggaccgatataacctaccctgctgggtttatggatgtcatcagcattgacaagaccggagagaacttccgtctgatctatnacaccaagggtcgctttgctgttcatcgtattacaccggagaggccaagtacaagttgtgcaaagtgagaaagatctttgtaggcacaaaggaatcccgcacctggtgacccatgatgctcgtactattcggtacctgatcccctcatcaaggtgaacgacaccattcagattgatttggagacaggcaaataactgacttcatcaagtttgacactgggaacctgtgtatggtgactggaggtgctaacttgggaagaattggtgtaatcaccaacagagagagacatnccngctcttttgatgtggttcatgtgaaagatgccaatg

SEQ ID NO: 654718 - DNA, 870 bp, Homo sapiens
  misc_feature (38)..(38): n is a, c, g, or t
  misc_feature (63)..(63): n is a, c, g, or t
  misc_feature (74)..(74): n is a, c, g, or t
  misc_feature (92)..(92): n is a, c, g, or t
  misc_feature (95)..(96): n is a, c, g, or t
  misc_feature (103)..(103): n is a, c, g, or t
  misc_feature (127)..(127): n is a, c, g, or t
  misc_feature (132)..(132): n is a, c, g, or t
  misc_feature (157)..(157): n is a, c, g, or t
  misc_feature (234)..(234): n is a, c, g, or t
  misc_feature (252)..(252): n is a, c, g, or t
  misc_feature (300)..(301): n is a, c, g, or t
  misc_feature (332)..(332): n is a, c, g, or t
  misc_feature (336)..(336): n is a, c, g, or t
  misc_feature (348)..(348): n is a, c, g, or t
  misc_feature (353)..(353): n is a, c, g, or t
  misc_feature (393)..(393): n is a, c, g, or t
  misc_feature (395)..(396): n is a, c, g, or t
  misc_feature (405)..(405): n is a, c, g, or t
  misc_feature (408)..(408): n is a, c, g, or t
  misc_feature (411)..(412): n is a, c, g, or t
  misc_feature (427)..(427): n is a, c, g, or t
  misc_feature (436)..(436): n is a, c, g, or t
  misc_feature (445)..(445): n is a, c, g, or t
  misc_feature (454)..(454): n is a, c, g, or t
  misc_feature (484)..(484): n is a, c, g, or t
  misc_feature (517)..(517): n is a, c, g, or t
  misc_feature (591)..(591): n is a, c, g, or t
  misc_feature (644)..(644): n is a, c, g, or t
  misc_feature (746)..(746): n is a, c, g, or t
  misc_feature (773)..(773): n is a, c, g, or t
  misc_feature (854)..(854): n is a, c, g, or t
gacaagcttcatacagtatgtatgtccagttggcactnttcaagtttagtttcagtgttaaangtgctacagtnacaaaccacattttaggnagnnttttttnttgagatacatttagagaaatttntttangttgtacacaacatatttttgtttnagctacatgatctaaaagtttaaggtcccaggtgccccatcctgaacttggaaagtgtagccttcagaggtagtttntggtacaacgttttgatnttcctcttcctctacagagaaatacttctcaatttagcttaacggggnnttatgcgcaggctcattttcatggttttgtngggnttcagttttgtntgggngtccgcattcttcaatcattattctaagtttctcagtttngnntggtttctnggnggnntgggaggtatttggngtggggtcnggggtgggnggggtgatnttggtgtcttttgcggtttgggggttcatnggcggttctgttgtgccggagtgggcggggtgngggatgtgttcagctgttccggcggtggtgtggttggtcgcggggggcgcgggttcgttttgtgtgttggggtntgcgcttaggggggggcgctgacaaggaatgggactaatccatgattcacaanttgctgtatctggtcctggcggccggctgtgatgtttgacattgtccacgtagcttccttctgaatgttagttttggggttggtgagcaggctgggaaaganggcgagtgctcctgcatcaatcacaanctgagtctgttcatctgttccagtgacaatattccctatggctcttagggcaggagtcacaattggcaattcaggagctcntagaagcttcacaagt

SEQ ID NO: 654719 - DNA, 582 bp, Homo sapiens
taatcggtcttttttttttttaatcaaaggtcccttactggccctgttccataattacccgtaaccagggaaaaagggaaagaaaccacccggcacaggtaaggcgtcactcctccacaacattcccatttcattccccagaaactaatctctaaacaaccccagagctcacatcatagcggtacaaccaatttgcactacattggagaaggcggctgagagaccatcgtgcgcacaactgacgacagcctgcaacaacacaacatttacagtgtctccctcaccttcacatctgtcggcggtgttatccatcgaaagagcgcaaaaaaacttcaggaaacacctggaactcaccaaagcacccaccaatactgcagacagatctgctggcaataatatctcctacaatcgcacagtttatgtgtgaatacagcgccccaaacaaacacatcgtccacaaacgagagacaatgcaacacggagacagccatcgcaccccgaaacttcccaccgtgatggtcatggaacggcgtgtctctgcgatctgttcacccaactgagtccgttgtctagcggaatcgc

SEQ ID NO: 654720 - DNA, 200 bp, Homo sapiens
tctagaggatcgctgttctgtcttccccaccacaagactacttccgcacttcgacctgagacacggtctgcccaggttacgggccacggcaagaaggtggccgacgcgctgaccaacgccgtggcgcaggtggacgacatgcccaatgcgctgtccgccctgagcgacctgcaggcgcaacaagcttcgggtggacccgg

SEQ ID NO: 654721 - DNA, 405 bp, Homo sapiens
  misc_feature (6)..(6): n is a, c, g, or t
  misc_feature (87)..(87): n is a, c, g, or t
  misc_feature (145)..(145): n is a, c, g, or t
  misc_feature (206)..(206): n is a, c, g, or t
  misc_feature (288)..(288): n is a, c, g, or t
ccaaanctaagggtttaacgtttaaaactatgcccactcccaaatgtcaccgcccataaaatttttttcaatgtagcattttcccanccctacttcaatatctttttaaagaaatctacccgaaggcccaggcgcggtggctcanacttgtaatcccagaactttcggaggccgaggcgggcagaacacgaggtcaggagattgancccatccctggctaacacggtgaaaccccatctctactaaaaatacaaaaaattagccgggtgtggtggtgggcacctgtantcccagctacttgggaggctgaggcaggataatggcgtgaacccggaaggcagagcttgcagtgagccaacatcacgccactgcactccagcctgggcgacagagaaagactccatg

SEQ ID NO: 654722 - DNA, 174 bp, Homo sapiens
ctagacgatccccttactattcatcggtcaccgggtcatagtattgtgtgtgtgttgaattcaactacgggtgccgataatagcgaggtgtcagctattcatcggcacctgaaatcagaacacaggcagaagctgaaagccatagtatagtggtgtgttaaattcaatacggga

SEQ ID NO: 654723 - DNA, 373 bp, Homo sapiens
  misc_feature (136)..(136): n is a, c, g, or t
atgatcagtgcattgtgtttagatatggatccaagagtagacacacatgtctgtgacacagtggcatagtgaggaggctgggggtgaggctgcggttggtaacaagtgcatgaacatcggtggacggggccagatncgctcgatgtggtcttgcacagaggtgtccttctcacacttcgcacttctcctcgggcgtcgcctgtgccgcatgccctgccagccaggtttcctcgcatactccttctatgctccaaggtgtctccaactttctatagggatgtcccttgctgtccctgcatcgctcggccctctaattccctagacaggttgccacgtgcatgccgtccggctggccttcctccccatggcaagc

SEQ ID NO: 654724 - DNA, 125 bp, Homo sapiens
  misc_feature (66)..(66): n is a, c, g, or t
cttttttttttgggggaaaaaaacttagaaattttaataaatcctcccaaagggaggggggtaagnggggccaccatccctccccttgcaacatagcagcccttgttggaataaaaaaaagaaca

SEQ ID NO: 654725 - DNA, 184 bp, Homo sapiens
ttttatctatcatctatctatccatccacccatagcggcttttattttatctatctatctatctatctatccatccatctttccatccatccatccatccatccattccaatcttgtatattctctggggatatatgaagtggtagatatatgaagatgtgcactttttggtgtacctgtgctc

SEQ ID NO: 654726 - DNA, 1134 bp, Homo sapiens
  misc_feature (2)..(2): n is a, c, g, or t
  misc_feature (5)..(5): n is a, c, g, or t
  misc_feature (380)..(380): n is a, c, g, or t
tnttntccccccccgctagctcctgcttctgcattcagaggtacttcctgtattatcccttgttagtactgcgtccagcatcactctgtctgtcgcgcgttgtgatgtattctctcctccgactgctgtttcctaataacccgctcccctcgcgttattctatgccggggatatcttttttcacgggacttcttctcccttgcctttgggccacctttacgaccgggtgccacaaaacacggggttccccctcctattcccggattgtccaacacacgctcagttttcccccttttgagagctatgttataaagtaacatgaaaacgttgtcccccgcataacctgcgtcaaattaaccccgtgactcacaattcccgcnccccatatttccattcatcacaccaggtcattttaccctccctgtcaaccccacacaggcatgctcataaggaaaggttaaaaaaataaaagggactcggccaatcttaccccccctgtttacccaaaacatcacctctagcatcccccgtattagaggccccccctgccccggacaccaaggttaacggccccggtaccctaaccctgccaaggtagcataaatcacctgttccctaattagggacctcgtatgaatggctcccccgagggttcaactgtctcttaacttttaacccgtgagaaattgagcctgcccctgaaagaggcgggcactgacacccgccagatcgcagaagaccctatggaggctttaaatttaattaaagccaacccgtatccttaccaaaccccccaggtccttaaacattacccaaacctgccatttaaaaatattcggttggggcgaccttcggagccagatacccctacctccgagccagtacaaagcttaagacattccacccagtccaagcgaactactatactccaattgatcccaataacttgacccaacgggaccagttacccttagggataaaccagcgccaatcctattttagagtcccataatccaaccaatagggtttacgacctcgatgttggatcaggacatcccgatggtgcccaccgctattaaaggttcgtttgttccacgattaaagtcctacgtgatctcgagttcagaccggaga

SEQ ID NO: 654727 - DNA, 196 bp, Homo sapiens
cccggttatgtcagaaggtgctttaccttttgacaaggagactggctttcacagaggtttgggtcggttcagtttcttcagaagaaggactcggaatgcactacaacaggaaaatcatattatagatggagtaaaggtccaggttcacactagaagggccaaacttccgcaaacatctgatgatgaaaagaaagat

SEQ ID NO: 654728 - DNA, 671 bp, Homo sapiens
  misc_feature (20)..(20): n is a, c, g, or t
  misc_feature (502)..(502): n is a, c, g, or t
  misc_feature (526)..(526): n is a, c, g, or t
  misc_feature (534)..(534): n is a, c, g, or t
  misc_feature (599)..(599): n is a, c, g, or t
  misc_feature (613)..(613): n is a, c, g, or t
  misc_feature (626)..(626): n is a, c, g, or t
gtcgactctagaggatcccnatatatccgcctatcctgagcatgacatgtttttccatttgtttgtgtcttctctgatttctttgagcagtgttttgtaattcttctagagatctcctagagatctttcacctccctggttagctgtattcctaggtatcctattttttctgtgtgtagcaattatgaatgggattgtgctcttcatttgactctctgcttgacttgatgtataggactgctagtaatttttgcacattgattttgtatgctaagactttgctaaagtttatcagcagaagaagctttggggccaagactatggggctttctagatatagaaacatgtcatctgtaaacagagacagtttgacttctgctattcctctcttccctcctctgtttggatcccttccagttttgcacatcagtgtaatgttggctgtgggtttgcatggctagctctcatcattttggcccttctgctagaaggccaagagggnccagtgttgttgttacctgaaagnaagtgcanccacaaaaatgcagtgaagaaaaaatgtattatgcatatgttaagtaatccaatgagattattancagacagatcaatnagttgatgagtgntgctgggatgtgggggagttatatcactccaggttttgctgggca

SEQ ID NO: 654729 - DNA, 161 bp, Homo sapiens
tgtcgatcagtgcatctgactgttcgtctgcctcttgcttagcctgtgtgacctcaggcacttgtgttctgggcctcagtcttctaatctgtggaataggaatgacaatgtcacctgtatcctgaggctgttgagggttaaagcctttattaccaagtgcc

SEQ ID NO: 654730 - DNA, 351 bp, Homo sapiens
gaatttccggctctctggggacaggccgtaggaatggagtggagtaagtgtgaatacaggtcaatggagtagagactccctgtcctctgggggcaggcgaggaatggaagatagagtacgtgggatacaggtcacgggcagagctcctggcctcaatgatgcctcctgatctatcgctgggcctggacgaccaacactgggatgatgatgagcagaatggtcatgaagatgcccaaaatcagggcccagatgttcaggcacttggcggtggaggcataggcctgggccccggtcacgtcgccaaccatcttcctgtccctagacttcacggagtacgcgaatgctatgaag

SEQ ID NO: 654731 - DNA, 128 bp, Homo sapiens
  misc_feature (6)..(6): n is a, c, g, or t
  misc_feature (94)..(94): n is a, c, g, or t
  misc_feature (119)..(119): n is a, c, g, or t
atggcncctgtggtcccagctacttgggaggctgagtcaggaagatcatctgagcctaggaaagtggcactttcatgcactcacccactgcacntccagcctgggcaacaatgagagancctgtctga

SEQ ID NO: 654732 - DNA, 121 bp, Homo sapiens
  misc_feature (117)..(117): n is a, c, g, or t
cggcacgaggaaaatttaagctggcacatattctcagctactctgaaggctggggcaggaggttcacttgaactcaggagttcaagtccatcctgggcaacatggcgagactctgtntctt

SEQ ID NO: 654733 - DNA, 227 bp, Homo sapiens
atgcgtgccacggaattggaatacgcaatcatctggatagcagcaaggcgggaagagagtgccagtgtgctggagccatctttgctcacagtgatgatcggggcataatgtggtcaagagcagcaccaaaaataatggtcctttcccatgggatgaaaagtgcgtcctcccaatcaagtgtcctgaatgcatggaattggtcgaagatgacagacaggtcagcgtag

SEQ ID NO: 654734 - DNA, 894 bp, Homo sapiens
cggaggctcctgggctgagccggcttgacagagcccgggaaggcagcgagactgtgggcgccggcccagccccgtcccgtgtcttcaggctctgtgccgcgtgacgcctctggcctgcgcggcgcgcctccctccgcgtgcgccgaactaacacggatacgcggcgccaggttgctatcagtaaaggctgggaaacagcaggtaacgagtaagaggcacgctaaggagggagatacatcaaaggacgcagaggccagccgcccaaaaaggcaaagacaagcaataaagaggcaaccaagacgaacggagagagacacacaacagcacacaccagagcagcgccagacgcggcggcacacaggacgaaggagcagcgcgaagacagacagaaccacacaaacaagagggaagagacaaacaacggaggcagccacagacgcacacacggcgggacagagaggcacagacgacgcagaggacagcgcggaggagaaacagaacagaagagccacaggaacagccagcgactgcgcaagacgacagatcagacgacgaccagacaaacccgagagagacaaccagcgacgacaacagcagaaagcacaacagacaggaaccaaaaagaaacacgcaaaagaacacgggcaccagaatgacacagcagacgacagggcggcacacacagacgaagccacagggacaagcgcagagacacagcgacgacaacaggacgggaaagccaggagggccacgcgacaggagggcagcgcgagagacagagaggaggaagagcaacgaaagcggccggacagagagtaacgggacggcaagagagcgagcaggaccaacgaccgggaagccagaaagaagcagacggaggaaggaagaccaaca

SEQ ID NO: 654735 - DNA, 292 bp, Homo sapiens
  misc_feature (23)..(23): n is a, c, g, or t
  misc_feature (39)..(39): n is a, c, g, or t
  misc_feature (56)..(56): n is a, c, g, or t
  misc_feature (67)..(67): n is a, c, g, or t
  misc_feature (287)..(287): n is a, c, g, or t
tctccccgcctcagcctcctgantgtagctgtgacctanatgcgtgcacccactanacccggctaanttttgtacttcttagtacaaagtttcacccatgttggcccaggctggtcttgaactcctgacctcaggtgatttgcctgcctcagcctcctaaagtgctgggattacaggcatgagccaccatgcctgtcccattatgtatattgggcggaggttgcagtgagccgagatcgcaccattgcacttcagcctaggcaacgagtgaaaacgccatctcaatntaaaa

SEQ ID NO: 654736 - DNA, 1043 bp, Homo sapiens
  misc_feature (357)..(357): n is a, c, g, or t
agcggctactcattagccggagaagaggacaaatgatactcgagatgagaaccagacgtaacagagaccgaaaaaccgaggctggagagaccagtgatccattccagcatgaacaaatgtcgagcgcacgaaagccaagaactaggcacgagcgcgagctacgaagtatggcagtcgagagctccgcgaaagagcgatggtggcattggtctagaggtgctgctggcgacagatggtcatgagtaggcggcccccgtttgcgttccgcgtggctggaccgaactgggcattcggtgttgttccgttagtggccgtgtggccaacatggttgcatggacgggctggatgaggacgagngcaaaagcgccgtgcgagcgtgggccatcgagagaaacagactgatacttttgcaagccacacgtattttgctttcgccagaaagaagctgagccataagacttattcgaaggatattttctaatctagattgttggaattacgcgaatgcggcttctctacgagtaattgttcagtcatcatgccgaacattgcacctcgtgttcaattcttatccacttgtatttgggcgccccttcccatgacgtagtggccgtgaaggcggtcctgtcgtaacgaacaccaacccgggggcggcaggatccaaggggccacggaatcatgtatgcacacgaacataacaaacagagcaacgccaaagtcgtgctgcggcaaaagggggccctagaaggccgggcaaacccggggtaacaacaggaggagagcccgatgaaaacggcgtgaccggtgagcttatcccaagggaaaaagccccaatatccagtttgcagaatgacgttccaaatatgcctgtataggcgaaagcacccgacgggttaggctgggttcggactcctgggtaactaagaggtcgcaaagaacagtgggggccataacggagaatcaatttcccccaggaacccaaaagggtttcgaggtagtggggacacagtcgaaccccttaagtggacaccccgtggaaacca

SEQ ID NO: 654737 - DNA, 192 bp, Homo sapiens
tttgtagtgtgtcacagaatattcatccatttcacccaggcattgtgtccccatatcctgattaatacccacagtcagccttcctccgaagatgagttactgttaccttcagttaatattggcagtggcagctaccaacatgtatgcactcaagccatcctactgactgacatggtccagagaggcagcgag

SEQ ID NO: 654738 - DNA, 106 bp, Homo sapiens
taatcagaggatccccctcaacgcttatacttcctcaacgctttactttctcaacgcttatacttataccgggaaagatgagaaaatgcagcggactcggacataa

SEQ ID NO: 654739 - DNA, 339 bp, Homo sapiens
  misc_feature (16)..(16): n is a, c, g, or t
ccgcgtcgactaacgnactcactataataggtgtacaaatttttaatttaatatttaagatttatcaaagaacttctaaagatgctcaaaggtaaagagagacatggggtaaccagttcccacacaggacagacacatggcctgaacctgcaaatagtgtttctcaacagcaaaggcgctgcgcgatcgctcggacatcgatacgacttttgttttgttggtttttttttttttttttcaggtcagtggctatgtagcttaggctgacctgaaacttggtatgtagacatggctggtctctatggagatcctctgcctcctgactgcagaggtcgacgc

SEQ ID NO: 654740 - DNA, 145 bp, Homo sapiens
atagaggtcttgtggcgaacgatctcactatttcaacttaatggtaagaagccggtcgctatcgtaggagcccgggcgtggaaatagcgaggtgcctaagttggggcacttttggtatgcagaactgggggtaccgagctccaaa

SEQ ID NO: 654741 - DNA, 429 bp, Homo sapiens
  misc_feature (14)..(14): n is a, c, g, or t
  misc_feature (31)..(31): n is a, c, g, or t
  misc_feature (426)..(426): n is a, c, g, or t
  misc_feature (429)..(429): n is a, c, g, or t
tgcccccctatgcnatgccactggcctattnccctcctatctggaaatactctttcccccctagaatacccacatgacctcacctacatcacccttcctttagcctcgttgatgaaacgtcactttgggccttggccggtggcctcaccctgtaatccccaacactttgggaggctgaagcaggagaattcacttgagtcccaggaattcaagactagccctgggcaacatgatgagacctcccctctacaaaaggtaaactaaattagctgggcgtggtggtacatggcggtggtcccagctgctcaggaggaggctaaagtaggagaatcacttgagcctgggaggctgagggtgcaatgagtcatgattgtgccactttactccagcatgagtcacaaagcgagaccctgtctcaaaaaattnatn

SEQ ID NO: 654742 - DNA, 93 bp, Homo sapiens
acaggctagttcataaacaaactgaatgtgtaactaacttctcaaaatgactctatttcataactcggacaatttctgggtggtgactgagta

SEQ ID NO: 654743 - DNA, 403 bp, Homo sapiens
tatcctgtgtcggggttgagaaactttccctctcggctcggagacggcgccccgcgcgtgccggagtggcgactctgccaggctcggagtgaaccggcagctctccacgcccctgaccgaagcctgacccgactgcctctctcatagagacggggtttcaccatgttaaccaggatggtctcgactctcctgacctcgtgatccgcctgcctcggcctccccacagtgctgagcttaccggctttacgtcgtggacactgaacatttactttggctgatcctcatcatgaaccgtgcttttagcacgacgaccagctccttggcagtccagcagtggacacagccacaccacggacccgccgtcgtgcgacgatgctgaccggaccctaaaggctgaaccgac

SEQ ID NO: 654744 - DNA, 669 bp, Homo sapiens
aaaactacgaatgcctaatccaaggttcccaaatcagcccgcacatccacctcggtatttttagtgataatcacgtacaagggggtacaaacgttatcttttggaggctaacgttacgtacttatataacgcaaggataggaagggggcttcgatgcctcttcgaccggataaccggctcgaacgaccgatatagccgacaccgccttaatatcctacttcgtagaaccgttcgaataccccatcgactaaataggataacgacctttaaaaacgacggtataagacccgatatccatgattacttccattttgacgccaaaggaccgatcgttaggacgtcccgattcctaagataaatcggcctaagaccccgatccgtaatataactaactattctacgtcaaatcgccgttactagacggataggacgtcgagccggatactctgtctatgaacgataccccgtcggaaaattcgaatgccaagatctaggacggttcggcattagcgtctaccgagcctacttcttagcgaacgaaaccgacgggaacggtggactacgctgccccgtcgtaagatgttgcgcgccagccgcgtccgatagaggcgtagaaagctttaccgcggccttgggaggcgggttccactccggacgttgtttcgacgg

SEQ ID NO: 654745 - DNA, 168 bp, Homo sapiens
ttttttttaaaaaaaaaatttccccccccccggggggggcccccttggggggggtttttttgggggtgggcccccggtccccgggggtccctttttggggtcccccccccccggtttttttgggggggggtttttttttttccccccccccccccggggggggtttta

SEQ ID NO: 654746 - DNA, 336 bp, Homo sapiens
tttggggggtttggggggggagggaatccaaattggagttgggggagggggggatcagttcaggatacccccgcctggggtcagggccagggggggatggccccccttgtatccaaaagttcccaggggggatttttatggtggttgggactggaggttgtataaggtgtttttggaaggaaggggccggggttggaatttgttggtcccccctgtcccccctggggttgtgaacccccccccccccctttttttgttttttaaaggccttttggtttttttaaatttggccagcaagggcccctttttttgtccaataaaaattggaaatgccga

SEQ ID NO: 654747 - DNA, 154 bp, Homo sapiens
gcgcaaaagccgccgcggcaggtaccattgcggctttatgccggcaataacctgaatgcggccaatgacaatcgtgcggcggcattggtagtgcgggtttacaccttaaaggaatcgaccgcctttatgcaggcgcccttcgacgcctttgtcg

SEQ ID NO: 654748 - DNA, 318 bp, Homo sapiens
aaacacgaaaacgataaaaaactaagaactgacagagatggaaataaaggaggtaacgagagagtggaggaagccaggtacggtggctcacacgtgtaatcctagcactttggtaggccaagccaggcggataacttgaggtcatggcgttcgagaccagcctggccaacacagtgaaaccccatctctactagaattacaaaagttagctggatgtggcggcaaggcccctgtaatcgccagctagtcaggaggctaaggcaggagaatcacttgaccctgggaggcagaggtttcagtgagtcgagattgcgccat

SEQ ID NO: 654749 - DNA, 529 bp, Homo sapiens
agctggcggcggtggccagtcggtgttgccttctcggcgcgccctgctggccggctggggagcctgtgatgcctggtgctccctgcgtgggcaaggtactacttatctgagaatgtggcgtccctctgagtgcaccactggtcctgggactacaccacagattgaactgaagcttgcatgctggcggcctctggacccctggtgtgccttggttgtgttgcctctgtgccttttcctctgagtgacaaaaccatggtattgggcatcaggagaacgccaagaacgaagagattcttgaattccctcaatgtacgtcctggcctggtggtgggttctgagcccaacttcatgctcttcgagcaagtgcggaggtgaactggtgctggggtgcgcaccctctcttcgccttcctgctgggaggccctgccagctcccagctgacgactgccaccgcgcttatgaccgacccaagctcatcacctggtctccggtgtgtacgcaactgatgtttgccttggaactttgagat

SEQ ID NO: 654750 - DNA, 106 bp, Homo sapiens
ggccccctgtggaattggcccttgcccccctgtggaattgtgtgtggttttagagggtttctgtttgtgaaatgtatgtattaaaaataataaaattccagaaact

SEQ ID NO: 654751 - DNA, 586 bp, Homo sapiens
  misc_feature (276)..(276): n is a, c, g, or t
cggcacgaggcctggtgccacctgggaggcagctccagggacaggaggggaaaggactgagaagacgccagtcactggtcctcccagggctcctgctgctgctggggctgagctcagtgccccctggtggacaggagtggatgtgctgaataaaggcccaggtggccctggccatgtcagaagtggccttggaaaccacaggacttttcctgccctctagaggaatacatgaaggcacagctaggctgagggccaacaagttgcacagctgatggncggcagattcaggacccatgcccagttccctggcttgcgttatctcctctgacaagtgtttactgagcactggttctgctaggccctattctaggcactgggggctgtggcacacaaagacctatgcgctgttagtaaataaaccacagctgcgggaacagctgcactgccgcccggcgtctgttattaccatcattgtggctgagtaacactctggttgggtagtggcccagtttctcacacggagcttgcctggcctggttctcggatggatgatgtgtgcccctcaggggctggctggcctgtgggc

SEQ ID NO: 654752 - DNA, 609 bp, Homo sapiens
gatggaatccagagacgctgtctgcttgctgccttaggacagttagctgaatggctgattaacttttaaaatacccagttgggttaatttttcttagaatctgttgctaagactggggacgctgttttcttttacaaggggaaatctaagttaatttcagggcattcgaaagggggaaggactattattgcattttgggaattgagaagggagtttcagatgaggatattaaaagggcttaccgaaaccaggccctcaaatttcatccggccaggaccaaatctcctaaggcagaggatttaaggaggtcgcagaagcttatgaggtattgagggatcctatcttccggcctcttaagttctgcctctttattttttccagtctttctgccagcctcttttcccctttttttcagcttgttaaggttatccttaaattggattctcaggcatatcaaaggttgaaggccgggataataccatggtttaatctctgatcatatgatcgagctttgcagagccctgatcgaacatgcctctgtggccctttttaattttagcatctttgaattatccatcctcttcattggctttaccatgttaccccggt

SEQ ID NO: 654753 - DNA, 1348 bp, Homo sapiens
gacgactgtccgagctggtccccgacggcggctgtgttgttgcaaccttattactccatcttctacttttttgtccgatcgctgcggggtccgttacgagagggaacctcgatggagacaggttcgagaactcctcagtccccgtcgcaaggcggttgccgagcggcctccagagatctcagggatgcagagcggctcgcagaagctctgagacgcacaagaccggacgtctcgttctcctcgtctcgtggcctgcacagtgcttcgacattgcacttccgtcgcttccgtacctcacctctttcaggccgtgggcacccagtcttacgttacaccgtgtgccagagcaataacctcggcggcacccttgctttcacatgcacaggtctgacacgtaccgtccagtgcccggacattccggcccacaagtatggtcgagataagagtgcgaaccacaaagtttgcctagacctcattgttggtttaagacacgccattgagcgcgttcttcacatacgacggcacagcaggagcatgccctgggttctaggccaattgtgcattacttgtgcattaccaatgtcaactttccgcaggatatttaagccactcgtacacttgcacccatgtgcaaagaggtatccctcaaccgtgataaggtctccccccggccgtcatatacctcctttccttgccccatgttaggtggggcacagcttttcgggagttatgggtaattccaggacagactgaacaagctccaaagaaccaggatccaatcacaccacttattcaatgtcccatggccacgtttggacctatggggaaacgaaagccgtcctcggaatacgcagggaccaaaggcccctgggtatgcgggtccctttgaaccccaatgggttgccccctttagactttcccaaggcctttgcactggaagaaaggtacttatctcgcccaagtggttttcacaacttacatggcgttccccttcttaacgcacccactgctccttggtgaccccatacaaaggctgaagcgctcccgtacaattacatgattgggaatctgcgtgtgctccgccgctgtccaaaggcggtgtgcctactttcgcttccaagaaagaatccccaatcagaccttggggtgccccatttcatccccacaaaggtttccttgcggagaatcgttcaacagaaaggatatcccgaggattgcccccttgacaaccccacgggttaaagagcccattggtcgccctttccgagcctttggtgtaagtgcccacggagaaaaccttcccgaggacaacgcccatgacttgcacaagtgggaacccactgagcgt

SEQ ID NO: 654754 - DNA, 327 bp, Homo sapiens
  misc_feature (47)..(47): n is a, c, g, or t
cgcgctcttgatgatccccgatgagtaaaatcttgtgttgacacagntagtcatcgcctataaatccagcaattggggaagccaggacaggaggatagcttgaggactggagtttgagaccagactgggcaacatagggagacccccttctctaacaaacataaaaaaattggccaggcctggtggctcatgcctgtaatcccagcactttgggagaccggggtgggcagatcacctgaggtcaggagttcgagacccccctggccaacatggtgaaaccctgtctttactaaaaatacaaaaaaattagccaagatttactcatcg

SEQ ID NO: 654755 - DNA, 375 bp, Homo sapiens
  misc_feature (357)..(357): n is a, c, g, or t
ggagagcagagagggagcgcgccttgtgtcgctgtccttgtcggcggctcctcttgagagctgtggcgcccacgagaggatccctcacccgggtctctcctcagggatgacatcatccgtgcacctccttgtgcttaaggaccacctcctctccatgctgagctgctggcaaggggcctggtggccatctacacctcacgagggcactaagagcacggtttcctggatcccaccaacatacaaagcagccactctctgacccccaggaccaggatggccaaggatgaagaggaccggaactgagcacccagctgtccctcttacctaaagacttccaatgcgcctataatgtagggngggggggggccccgcccc

SEQ ID NO: 654756 - DNA, 395 bp, Homo sapiens
ggtatctctaacattatcaagtattagctgttagatgcacaaaaaccataccgagttcttaatgatagggaaatcacagtccagtgtaggagacaagctctttaacataatatggtgagtactaaaataggctgggcacagtggctcacgcctgtaatcccagcactttgggaggccaaggtgggcagatcacctgaggtcagtagtccaagaccagcctgaccagcaaggagaaactcccatctctactaaaatacaaaattagccgggtgtggtgatgcatgcctgtaatcccagctactccagaggctgaggcaggagaatcgctttaaccctgaggcggaggttgcagtgagctgagattccgccattgcactccagcctgggcaacaaaa

SEQ ID NO: 654757 - DNA, 102 bp, Homo sapiens
agctcggtacctacttttcacagggaacgaaagaaaaaaaaaacctcttacaagttaggaaaggaaacttatctcaacttgataaataacatctttatttaa

SEQ ID NO: 654758 - DNA, 311 bp, Homo sapiens
acgggcgatgtactgcgactgccgggtcgaagagtacgccttcacggaaatcgacaactcggtgtcggcgggtctgtccgtgaagggatcgctctggggacgccccgatgacaccgtgggcgccgcgttttcgtcgaatggactgagccacgaccaccgcgactatctcgcggcgggcggcctgggtgggttcctaggagacggccgactcaactacgggcgcgagcaggactgggaggcttactacagcgccctggcgtatcgggggatacatctttccctcgactatcagctgatcgtgaatcccggct

SEQ ID NO: 654759 - DNA, 292 bp, Homo sapiens
tgctctagaggatctcacactgggttcgagttcttactgggtggagtgcaggggcgatcttggtccctgcaactccgcatccgggttcaagtgattctcctgcctcagcctcccgagtagctgggattacaggcacccaccaccatgcctggctaatttttgtatttctagtagagatggggtttcaccattgttgaccactgctagatctcgacactcttgaccctctagctgatgtgcccactttcgaccctcctcaaagctgctggcgattatagcgaatgacgttatg

SEQ ID NO: 654760 - DNA, 86 bp, Homo sapiens
ttcaagcttctaacgatgtacggggacatgcctgcaaccttgcatccatttgggctaccccacccaagtatacaataaagtcttcc

SEQ ID NO: 654761 - DNA, 509 bp, Homo sapiens
tggctctaaagggggtaaagggggtgctatagggtaaatacgggccctatttacaaaaattttaaggggaatataattctaggacaatggcgataaaactgtggttggctccaaaaatttcaaagtttgaccgtagttataccccgcggttcgtgtagcggtgaaaaggtggttgggttaagaacgtcgcgggaaatggcttcgtgttttataagcctatgtgtggggacaagctcatgagttgcaagcacgtctggctgaaatgtaattatttatacagaagtgggggcttcaatcgggagtactactcgattggtcaacgtcaaggagtcgcagtgtcgccgggttctaggaataagggggagaagtatcgtcggagttcgaacgattagtccgccgtagtcggtggtactcgtaggttcagtcaccatgggtggccaatggattcgatgggtaagcgaggggatccgttgacctcgtctgtatatgtaagaggatgcgtaagggat

SEQ ID NO: 654762 - DNA, 527 bp, Homo sapiens
caacctaacatggaggaaccacaagaacacaagatgaacacatactacagacaaaaacattgaataagagtacctgcacaagtctttccagatcatacaaataacatatgtttctatgtaactatccacaacatctaacttcctcctgatccacagagcacaagactttatacccacacaatgcaactcaggctcataaaatatgagggctggcaaagactttggcatactcatatcgatcctccccttggattctgaacagactaggccattaaatgatcccagaaaacatcttttaaacaatatatcggaaatccagacagacaacggaactacaatccaacactattaagtaagtatacaaatttaaaaaaatttaggataattatacctgtatttactctaatcttaagtgtaaacagcaataactgctgtccacaaaacgcatcccttaattcactcaacaaagactaattaagtacctaaggtctccaaagacatctgctaggttctcgaggtaagaagaa

SEQ ID NO: 654763 - DNA, 805 bp, Homo sapiens
gctctctctaagtcacgggaactgcccttgctacttgttgacctgccctttactcagcagtttatgttctgggaagccctgggattctgctaatacctatcactgtaggtgctgaagggaaacagggatgaagaacatgaccttcaacgaggcttcctgtcaatgagaagaccaagctgactggcctggcagagatattaatagagggagcctgaaactgttccttggacatcttatgaatgtcagaaaataccttttggagggttagaagatcacgggacatggttgttcaccatttgctgccacgaacagcaccgtctagtcttcacttgggaatccagaatcacgccttgtgaagagatcatccctaaagcaggtagagaagctacttaagagggattgtgtcctcctccagcttccctgtgctcggctctccacctgtactcccattctgatgcatgatggttcaaactggaacagactctgccagctgcacttacttgagggcctctaggactgctatatgcatgctggccactgtggtctctggaaactaccttacaggttgacagtgtgactctgaccacttgggtctggagtccaggaatctcaaagccagtactgtcaggacactatctctgtattaaattctccttaaacttcccatgcaaaagagcgttctatccactgttcaggggtccccccgaggggaccaagaggcaggtgcttcaggctattctgaataaactggaggtccgaaggaagcgagaacccttaacagacacccactacctctcactaaacg

SEQ ID NO: 654764 - DNA, 222 bp, Homo sapiens
agcctggcccttcttttcttagcacatcgacgaattctcagcacaagatgaagagtagactcctttgatatatgtagtcagacagagtacgtgcatctgttgagtgagacccatgggcgtcagaataacagggatagagaaaaatctaccaagtcagtgaaaatcagaaaaaatcagaggttgttatcctaatttctgacaaaacagactttccgtatggat

SEQ ID NO: 654765 - DNA, 1043 bp, Homo sapiens
ggtgtaatacacgggcattcccccctcgcgggtctttgggttcctgctgtgttgatgacgcgggggatgtcccacgccgtgtgtgttcctcctatcgcccgggtgcccccactgggggccacattgcggcgccctcgttgtagattgcctggtgacactgctgtgtgttcacaagctggggccccttgtgcgacgttgcgtaccaccttttggtgaggagggggtgcccccccgggttatgacccccaggggggacccccctttgtgtgtcagaggcacacaagattcgatcaagcggtgtgacgtcgcctcttcgtgtgggctccttcgccttgaggcttccacgagacgtgtgtctcaccgtttgcttgcccgcgctccaaaccgcgggtttctagacgttatagagatgcggggacgggtttatattataaccgcccctcccgtttgtggacttccttcatagcctccggcagcctcattttgtaggggctatataggcgggcatagtaggagaccagccctctcttgtggaggccaccctgttgacctgccagcttatgtatgccccttctcccagtgttccacctgtcctcgacacatatgccgttatcccccatttttgaatccccctgcgtatggcaagtgcccccggggcgtttgtcgcccaacacgccctcatgccgacaaaagctcttatctggggagacgagagttatttggagaatgcgttgaaatcagcgttttccacttccacgaagagagcccccctttttcactttgggggtatataatgtggaagactggtttcagcccacggagccccccactgaggagaggattctacacaacaggggggcctaactttcccaaggggcccttcctggcctggagtgaaggccttttacaacacaccaccacacaatacacacactaccacaccacacacacatattcccggtttccacacagacccctgctgcatttttgtggccatttggtctgtttcttattaataaaggaatttgggtggtcgtggttta

SEQ ID NO: 654766 - DNA, 258 bp, Homo sapiens
gtcagacgctgaactatgtgcatgtgcctggcggcttcagaaaagcggctccacgccctcagccaggcccctgatgctggggggtctttcctgctgctggccgtgaccctcccctccatcgcctgcatcctgatctgctactggtcccgtgaccggtgggcctgccacccactggcgcgcaccctggccctctacgccctcccacagtctggctggcaggctgttgcctcctctgtcaacacatagttcagcgtctga

SEQ ID NO: 654767 - DNA, 334 bp, Homo sapiens
agggatccaagttgtaattgacagtagctagaaccaccattttaaactttaagcaatgtcataaaagaagtgtgtaaacaagcaacagacagatctaaaaagttccaagtgtggatttcacattagatcttataaattaaaaaaatcctcaatataatcgtttgttcactatcttctttcaataagcacatggacagggaaagataatcacaccttaatattcacaactgctatttgtgttctttacaaaaattgtatctctgcaatgcagggaggcaggcaatcccttgttcaagtcatttctgttttccctaagttatcaaaaagtacaact

SEQ ID NO: 654768 - DNA, 289 bp, Homo sapiens
attcatagtgagcaccatcctggagagatttggggaaacgaggatctcctccagcccctcaattagggtaattgcacctcgtagagttatatctttcctctgtttaaaaggaggtaggcaagttggagagactccttgttagaatgaggagcattggcaaagcgttgtcttatcataagtgctctgctaagtgctctgcgtggcttaaggactcatagagctggaagaggagaaataccaaatggattaactttgcaattacatgtggatggcttgagcagttaagtaa

SEQ ID NO: 654769 - DNA, 856 bp, Homo sapiens
gacttttttttttttggaaacagggtctggctctgtcacctaggctggagtgtagtgtggcgatctgttggttcgctgcaacctctgtctcccgggttcgggtgattctgtgtgcctcagtctcccgggtagccgggattataggtacccgccaccacgccgggctaattctggtattttgggtagagatggggtgtttcaccatgttgggccgggctggtgttgaactcctgacctcaggtgatccgcccacctcagcctcccgaagtgctggggattggcaggcgtgggccactgtgcccagccacatgtgaccatttaattaattctagccatttgggcaactctttgggtaacggtctcatgtgcatatgtaacagatttctctgaatccaaatagtcatcttaaatggacaatttatagtgctgctgcttggtgctacaaaacacgtgacattattatatttttcttctagaaacattattccatcattggtgtcgagggatatccaggcttctacaggggtcaccctatgtgtatcagctactggacatgatgtgaacgtagaaccgactccgaattacaagaaaacctttaagccaggcctgtctgaagaataggtaatccataggcctggtggaactcaacgtcattcacaccttttagagcgcccaaaatgggtctccttcttaataatacttcggcggcagcacttttaccaccttctcgtggaagcataacgcgccagcctcgtaacctagaaatatctgcgcccaccagctgatgcttttaacagcttgccccgcaatggtgctcgttgccaatctcgcggatcttcagagatctgcgcgatcc

SEQ ID NO: 654770 - DNA, 421 bp, Homo sapiens
  misc_feature (1)..(1): n is a, c, g, or t
  misc_feature (85)..(85): n is a, c, g, or t
nttccggccgcagagctccaccgctgaggccgacgaggccgagggggttattgacgggggaagaaaaattcttcctttcaggtgnagaaggggtttgcttaatttaactcagtatttttttccattctttgggtgagtggactgggttttccaccctaaaatctgtgttttctttcttcaaataataatatccaccacagctacttattctgaaaagaaagtggaaggggggggaacaggggtccaccaggggggttcagtcactgggtcgtttcttcacaaagagtctacttttcctattagttccgagcccggggggggtgggaaaactggtgggggtgggcgagtggatcgtcttggctgggcatcacctcccctacggaactccagaggttgagcggaggggccttcttcctcccgg

SEQ ID NO: 654771 - DNA, 592 bp, Homo sapiens
gctgagaatgtcggtatccgacagaatagataggcagaaaggctcatagagaaaaatgaagtattacataataaaaagttataaatccaaaaagaggtgtgtgtgtgtgcctgtgtgtacaaacacagcctcaaaaaaaggaaaacacaaaaattaaaaaaaaaagggggggacagaattctaaggagaaatggatgaagccaccaccagagctctcacaaatccagtttaagcaggcagttcaataactatgtgcagattgaacatgatgagacagcatttcctaactataaaatccaaccactcatggggccatgttggtctcagaaaatgcttgaccacagagcaatgcagttggcaaaacaatgaccaaaaagataaaccagaaaaaaagtcacagaaatgacaattaaaagaaaaaaattctaaatctgcatgccaaagcagccatgatatttgatatttataattaaaatacaataaagtatgatactgcaattcttggggatgtgacaggcattcaacataagaaactggaaagaaacatcccaaaaaggaagaaaatgataacaatcagaaagtttcaaataga

SEQ ID NO: 654772 - DNA, 991 bp, Homo sapiens
  misc_feature (325)..(325): n is a, c, g, or t
  misc_feature (574)..(574): n is a, c, g, or t
  misc_feature (644)..(644): n is a, c, g, or t
agcgggggagcgccgagtggttagcgtcggtggctttgggcatggcgactttttctaggcccggctgggtccatatcctgctcgtccttcatagtcccgcgagggaatgcatagtcagcaggtttgcaaacacgtgacggtaggggcgcaggattacgcaaagacgccatacacgcacaagcgaacacaagaggataccaagagacaaacattacgtccatgggaagtacgctcctatgctgacggccgacctagcctaatcctcacattcgactgaacactcgcgagcagtacttatctgcaattaatttattcgtcgccaagntgttatggtcgagcatggtaggacttagcgagttgcacgggcggtgtgccacgaatggtaaataggggacatggagaatgagcaaaacggctgagtgcgatttgctgcgaagttgggaggtctgacggaatgtttggccagaaagatagattggcgtgataacgagatggaagctaagcgtacgctgattatgggctgcacaacgactgcttagagcagcttgtgcagtgtttatgggccgagccctgnaaataccagtcaccatgacaccgtagactccgtttgacagcactgggcacattatgtccaggtttcaagncgagccaattcatttgatcgcgatcaggttggaagatcgggtactagatcgcgaaagtcggacatctaaagtagcatagacagtgtctacggatgggcacggaagcgcaatttaatacaagggaacagagaacatgaattagctccaggaaggaaagttacggtataagaaagaggcaattgacgtatgaatattgcccttcatatgtgagttgtgacacgaacacagggcacacagtactttcatgaaagctaatcgtcagtacgtcgtacatagaaaggccaggatttaacggtaagaacgacagaaaaaagtttcaagggtactcttggaccactcctgaagaa

SEQ ID NO: 654773 - DNA, 181 bp, Homo sapiens
gctgggggcatcccttgaaccccagaagcagaacaaacgagtggcccctatcttgcttaagtctaagaaatccaagattttgtttaaaaaaaaaatcagggctcagtggctcacacctgtaatcccagcattttgggaggccgaggtgggaggatcacttgaggccagcctggacaacata

SEQ ID NO: 654774 - DNA, 173 bp, Homo sapiens
gggtgtaccgtaaagcagtagtttcaacatttgagagtatcgattcctaatgaaaacactgcatatagaattgtagcattactcaccgcactatgatgatatgtgttttcttgtggaacgacacaagcaatacttaacaatcaaactcgttgtactacgtctcctgtggactc

SEQ ID NO: 654775 - DNA, 938 bp, Homo sapiens
cgtggtggtgggcgcctgtagtcccagctacttgggaggctgaggcaggagaatggtgtgaacctgggaggcggagcttgcagtgagccaagatcgccaccactgcactccagcctgggcgacagagcgagactccatctcaaaaaaaaaaagatgggggaacatggcagcacctttaaaacagcaacacgggccaggcgtggtagctcatgcctgtaatctcagcacttgggaagctgaggcaggcggatcacctgaggtcaggagttcaagaccagcctggccaacatggaaaaaccccctctctattaaaaaagacaaaaattagctgggtgtggtgatgggtgcctgtaatcccagctactgtggaaagctgaggcaggagaattacttgaacccaggaggcggaggttgcagtgagccaagatcgtaccactgcactccagcctgggcgacagaagtaagactccatctcaaaaaaaaaaaaccaccaaaacaaacacttgttggcggggcgcttgggctccgaaaaagtttttgaacccatcggttgggcagcgggaccccacgagtgaagagtgaacagtgcgccatacatggtcccagagagaaacccgcgcagaactgaggcgtgtgtatcctcaccaaaaaaaaaaacgcgggggaatcacgagctgttttggacacaatgcacagggggggtcgtgatgaccagtcgggcctacacagagaggccaggggactgaaataatgccgacgggcgaggaagcccacactcctccagcaaccgccagaacagcacagcgcgcgcagacgcactctccatcgcccccgcgcgcacaacacgaacacaacagcaccaccaacaccagcaacacacacaacacacccagctacacgagcagacatcctagccgaaacacagcgacagcagccag

SEQ ID NO: 654776 - DNA, 118 bp, Homo sapiens
  misc_feature (18)..(18): n is a, c, g, or t
  misc_feature (79)..(80): n is a, c, g, or t
  misc_feature (105)..(105): n is a, c, g, or t
  misc_feature (115)..(115): n is a, c, g, or t
gatcaccatgaacaaagntatatttcctatttatttattatatgtgcacttcaagaagtcactgtcagagaaataaagnnttgtctaaatgtcatgttggagatncctttgcatnctt

SEQ ID NO: 654777 - DNA, 219 bp, Homo sapiens
aaaaaaaaatccccctttggttttacccctaaaaaagggtttcccccattttttgggttctgacggggtttttaaaaaaaaggggggccccccccccttttcctttcgccggggggggggggtccctgggccccgttttttttttctttttttttagggcccccgggttgtttttttttttttaggggaattttgcccataaaggtttttggaccccca

SEQ ID NO: 654778 - DNA, 162 bp, Homo sapiens
cggtcctgagtttcttcacttcgccagcttgggtcgtctctcccgagcctgtctgtctagttatggctcatccagctgacgctgcatcttctcttgtcccttctgtagccgcatcttctacttctctttgctctcagcagtctgtgtcacagaggcttttgc

SEQ ID NO: 654779 - DNA, 662 bp, Homo sapiens
cgttgtgatctctgcctcaactacaaactctgtctccctatcttcatactgattctgctgcctcagacttccgcgactaacttgagattacaggcttgctccacaatgcctagctattttcgtacttatcagtaaacacggggtttctccatgttgattcacgcatgagtctcaacagtgctgactctcaggtgatccgatccgctttgtgattccctagaagtgcttggattacaggcgtgagccaccacgtcctgtttatttgtatttgttttttttttttgagacaaagtctcactctgttgcccaaaagctggagtgcagtggcgtgatcacagcttactacaacctgcacccccctggttcaagtgattctcctgcctcagcctcctgagtagctgggaatacaggcacccaccaccaaacctgggctcatttcggtattttcagtagagatggaatttcatcatgttggccaggctgatctcaaactactgacctcaggtgatctgcccacctcagcctcccaaaatgctgggaatacaggcgtgagccactgggcctggaccaattttagtttaatttcttaataaaggggctcaatatttaatcaggcaataaataattaaagggtgcccattccttagttgccacgaagcccc

SEQ ID NO: 654780 - DNA, 256 bp, Homo sapiens
gtatctaagatccgggatcggtgtgtgtatcttctcagacagaagatagtggtctgtctagatctacacagtactttgggcagtatcacatcccttgcgtatggaggtggtgagagtgttgatcaagtggtatatggagtactcgatggtaaaggacaacactatctatttagaagctaagctgtatgtgcttatccccagggagatagaggtgttaatcaccatgacagcatgagttagaggacactggcatcaa

SEQ ID NO: 654781 - DNA, 940 bp, Homo sapiens
gattgacgcaggaatactttgtggtggctgcgagcttgacatgatatcatccgccgtttcacagcctccaagtttggctccacccggtgttgcaggaactgtgtattgatgcttttcccgagatcaggtggccatccagctgaatgacactcaccctgcagtcgcgatccctgagctgaatgtagggagttttatgtgggagtattgcaaaaactgcgcgctggtctctacaggcgatgtgagagctcaccctagaagcacctttcggttcctatcgacccaactcactacagtgcttcccgtgaagcccatgggtagtcggctgtgacccgggtggacctggtgtcgaagtaagctgcatccgcgtcgacaatttggaaatcattctatgagatcaatccaggaagcatttagttaatagaatttgtggccttgtttcctaaagatgtggaccgtctgagaaggatgtctctgatagaagaggaaggaagcaaagaggatcaagcatggcccatctctgcattgtcggttcccatgctgtgaatggcgtggctaaaaatccactcagacatcgtgaagactaaagtatgcaaggacttcagtgagactagaacctgacaagtttcagaataaaaccaatgggatcactccaaggcgctggctcctactctgcaaacccaaggacttggcagagctcatagcagagacacattggcgaagactatgtgaaatgacctgagccagcttgacgaaggctcaccagcttctggggtgatgaatgtcttcctccgggaactcgccacggttgaagccaggcagaatagcttgaagtgtctcagttcctgggggacgcactcaaaagtgaagaaaaccaatcctccatgttggagtcacgggaaaggggtacctggtaaagcgcacgcttgacgttgctgggacc

SEQ ID NO: 654782 - DNA, 400 bp, Homo sapiens
gtgtgcagagggggttctcagagagaaaatgtgaaaggaagagatgaaggagagttttcttttccttttaattttggattttttttcagcagggggagggaaggtaaagtaatactatgcagggtggagtgactgagggactgggacaggaatgtgggtcactcccacagctgtgacagtgtgataatggggatacaaggtttctccctgtgtccctttggtcttcacaaaggcctgacaacacggtgatggcctcagggcgggaaaagggagtacctaggggggtcatctagtagcagctccggctcccccaaatctagcaggtcttagagggacatgaggaaatcaggcttttggactttcccctccagtgccaaaatctacagggcacgtgaaaagc

SEQ ID NO: 654783 - DNA, 378 bp, Homo sapiens
aaacgactgcggttgccccgaaggccgcgactcgtagatgacctccggtgcaagtggcgtccaacgggtgaccctgactcgtgaattatgcccttgtggctggcatccagagggtgccacggaggtcctctatttattgttttcatctatttgggtacgaagtgtgccaagtcacacgaccttttgccaagaggtttgctagacagcagaagaatatcgctctctctcatcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcc

SEQ ID NO: 654784 - DNA, 215 bp, Homo sapiens
cagcttctcagatgaccaagatggtcatctgagaagctgaggatggagaacccaccaagccccgctagagccacctagactggatgcagagctggtgagctccctgcaggttctctgagaaggggtggatggcagcctgctccttggcctttgtgccctccaggccccaaagtcagggaaccaaaagaaggaaagggggccgtagctaggggcag

SEQ ID NO: 654785 - DNA, 576 bp, Homo sapiens
  misc_feature (29)..(29): n is a, c, g, or t
cattctctcgtatgtcacctgccactcangtgatcacccacacccgctgtgattggaagtgcatgcatctcgcatccgctagctctcgctacgtaagcgtgcacacacttcccattcatcccagcacctgccatgcatggatcttggggcaacatgccgacccaagtgtggctgtgtggactggtgtgaatgggcagcgtgtctctctccaggaactgaatccagaaatgggaactgacaatgatagtgaaaattggaagcaagtgcatcagatggtggttcacagtgcctatgaagtcatcaagctaaaaggatataccaaccgggctattggattaagtgtgcctgatcttattgaatccatgttgaaaaatctatccaggattcatcccgtgtcaaccatggtaaagggcatgtatggcattgagaatgaagttctcctgagccttccagtaatcccaaatgcccggggattacccagcgctatcaaccagatcgttaaggatgactagggtcgctcagctcaagaaaagtgcagataccctgtgggacatccagaaggacctaaaagacctg

SEQ ID NO: 654786 - DNA, 318 bp, Homo sapiens
  misc_feature (165)..(165): n is a, c, g, or t
  misc_feature (173)..(173): n is a, c, g, or t
aattccttatatactctctaagccactggaaacttgaggcagagaagttaaaagacgcacatggatttctctgaaatatttgaacaccatcagaacatgttggttagttcaggaccataccaggctttgttgttacattgaattgtaaataacttatattcagancctggatntagaaattcttggctgagaattgacactacttctggcttccaggagccagaacccaccttcgaatgggattttgaaataagccccgttgaagagactcacagacggctgaggccgcagcacgctgtgagaccttcttcaggtcgg

SEQ ID NO: 654787 - DNA, 1118 bp, Homo sapiens
  misc_feature (79)..(79): n is a, c, g, or t
tcacaggtggatgaagatgcctctacctgttgatcagcccgagagactcggtgaacgcttggaagttgcaaacttatcngaggaagtcatgtattggcagaagacaaagctcattacacttttactgggcgttggccctgggtgtgaagggcttgtaccagtgggttgtgtgacggtggtgaccagcgtcaacgaaattctatacgatgaaggcagaccaggatcgattggcgaggatggcgtgctgttgtggttctctgcagcaaactagtgaaagggacgtcgtgagaacaggttaatgggcaggaggcgtgtactggaggatgtaagtatggctccatgcgtgtgacaacaggtgtgccaagtaggaacgaccgaggcaataggaaggcttgcttgcagatggatgtcgttatgctaataggcagcgtgaggaatgttggcgcaaccagtcgatagctggacagatgcagggctatgacgagtgcgagaccgtggtggcacagctcagggctgcgtcacagtgaaggcaataccgaatggtggattggatatgagggaaggcaccgattggagatatgggtatcctgggtataacagaaagtgttcaagtgaagcgagaggttcttctgagtgcaggtgacagcagcagagggtgattctgcgtgtggacagacatcatcaaagcggcaccaggaaacgtgtcctgatcacgacgctggtgagcattcccacggtggcgtggatctttggaccagattctagcacagttgtgtctgacaggatactctattaacgcaagactggggacccggttattcggagccattatatcctaagttggcaattagatgactttgtttgacatagttcaaatattggcggaccattttcttaagatgcagatgtacacaagtcggccgcagaccgggggtcaaacaacctgcgggccaaaaaaaagacacagcagagaacacacaaacaacgggggcgccaaataccgaggcaaacaccccacccagaagcacaccagagccacaggggccaaaacagcacagagtcaagacactgcgagacaccgcccagacaagcgcctcaggaccacaagcgacaggcaa

SEQ ID NO: 654788 - DNA, 363 bp, Homo sapiens
tttaaaagcatcggccaggtgtggtggctcatgcctgtaataccagcattttgagaggccaaggtgggtggatcacttgaggtcaggagtttgagaccagcctggccaacatggtggaaccccgtctctactaaaaatacaaagattagccaggtgtggtggtgggtgcctgtaatcccagctactcgggaggctgaggcaggagcattgcttgaacctggggaggcggaggttgcagtgagccaagactgtgccactgtactccagcctggggtgacagagcgagacgctgtctcaaaaaataaatgaaacaaacttaacattcatactttttatgtcaataagagttgaagttgcctttaa

SEQ ID NO: 654789 - DNA, 152 bp, Homo sapiens
gggggggggggggggggcccctttttttcccccggggggtatttttttaaacccctttcccccggggggggggccccccccccccaggggggggtttttcccccccccgggggttttttttttttttttttaaaccccgggggcttttttga

SEQ ID NO: 654790 - DNA, 442 bp, Homo sapiens
  misc_feature (264)..(264): n is a, c, g, or t
  misc_feature (284)..(284): n is a, c, g, or t
  misc_feature (322)..(322): n is a, c, g, or t
  misc_feature (382)..(382): n is a, c, g, or t
  misc_feature (424)..(424): n is a, c, g, or t
  misc_feature (436)..(436): n is a, c, g, or t
taatggagtttcgcccttgttccaaggctggagagcaatggtgtgatctcggctcactgcaacctccatctcccaggttctcgtgattctcctgtttcagccttccaagtagctgggattacagccatgcaccatcacgcttgactaattttgtacccttagtagtgacagggtttcaccatattggtcaggctgatctcaaactcctgacctcgggtgttccgcccgcctcagcctcccaaagtgctgggattacaggcgtcnaccatgcccagtctgggatnctgtttaaggtaatgtgaaactatggacaaaccagggnattgccagccaatgatacaagtgggtgaacactttaacaggaaaagcagcgacaaatggnttttctaccgggggattattcagttttactacccttcatctncacttacattantttttt

SEQ ID NO: 654791 - DNA, 1181 bp, Homo sapiens
aggaatacatgcacctggccctgctactgcttcgctagcagccagctgtccaccgccctgagcctgctgtacctgcgccctgctacctcatgctgcctggtgttctggggaagaccaccccgcagcatgcgcgcctgctgctgccaacaaccccggtgctgcgtgctgcaccgcgcgtgcactggacctccgacctgctccctgccccttccctgcacgacctgctgctgtgccgtcacccccccacctgtaccaccgcgcgcccaccgcgcccctcctcgcgctggcccctcccgcccacccacctccgctcgcccccgacgctcctccccaccatccccacccgccctcgacgttccccgcgctcgtgccccctgccctcccccgcacgcccccgacggcccttaccccccactcctccccacccacccccctcccttgctgccacccgccccacctcaccaagacccccccgcccccccctcccccctcctcccctcccccctcccctccccccaccccccctccccctcccccccttccccccccccccccccctccccccccaccactcctaccccccccacccccgcctccccgccgcccccccccctcccccgccccccctcctccgctctcaccccgcccccccccacccccttgctccccctccccgtccctcgcccctcccgcctcgcccccctcccctctaccccccccctcttccccccctccccctcccccccttcctccccccccccccccccaccacccctcgctccccacccccctcccacccccccccccccccccgcccccccccccccctccccccccccccttcccccccgccccccccccccccccccccccccccctcccctctcccccccccccccccccccccccccctcctccctccccttccctcccccccccccccccccccctctccccccccccctcctaccccccacacccccaccctcccctctcccccaccccccccccctccctccctcttcccccctcctcccccccccctctcccctccctcccccccccctgcccccccgcaccttcccccccccccgtcccctcctcccacccccgcccctcccgccctctctcccctcctcccccgcccccccctcctcctccctctcgcccctctcctctcc

SEQ ID NO: 654792 - DNA, 479 bp, Homo sapiens
  misc_feature (3)..(3): n is a, c, g, or t
ccnctcacgttacctcaaggcacacctacaccccttatccccatactagttattatcgaaaccaccagcctgggcaacagagcaagattcagtcaaaaaaaaagaaaaaaaaaaaaaaggggattcggtcttttacaacaacttaaagggaactgaggttattatgcaaagtgaaataacccaggcacattggaacagcgggtctcacatgaaaattggtgacagtgaaccaaggccctcgtttgtagcattgacactggccacttcctccacggtgcacaggcttggggaaggtggggacttcccaagcaaaagaacaaaatatgctttgcgataaaagttgggggttgggtttggcttgtacaggattgttggaaattggacctagaatccaaaactcactacagaatatttgcagtcttgcttacaagtctacgtttaatgatgggccatattgtagaggtaacccgtgggggggg

SEQ ID NO: 654793 - DNA, 267 bp, Homo sapiens
  misc_feature (152)..(152): n is a, c, g, or t
  misc_feature (216)..(216): n is a, c, g, or t
  misc_feature (222)..(222): n is a, c, g, or t
  misc_feature (237)..(237): n is a, c, g, or t
tgaaaacaacatttccatgagttgaaaatgggcagggtactgtcctctaaatgctcccattctgtagctgtgtttacagctgccactagcacatgatttatagaagaggcatatcagctggacccaaggagatgtactcatggacttaagangattagattataaatgccatcccacacaatctttaataaacaaaacccaggtgagctatatcantctttngctgcatcaaaagangggaaaccaaacagttgtcctcttgtggtt

SEQ ID NO: 654794 - DNA, 121 bp, Homo sapiens
aaggtacttcatttcgagattgagtttcttgaggatcagccacttcccacgtggagatgggcgtcaactactgctaccctaatttaacccttcgctgtggacactaagacactccgccggt

SEQ ID NO: 654795 - DNA, 80 bp, Homo sapiens
tgagtttgaagttgcagtgaactataatcatgccactgtgctttagcctggacgacaaagggagactctgtctcttttag

SEQ ID NO: 654796 - DNA, 177 bp, Homo sapiens
tatcgtgtcacacagtgatccgggagcacagcactttacagccatgataactgcaatccgactctcccagaccaagagacggccaaacagagccaggctccaacttggcagtgttcacagagcaccataaccggttgaaatgccacaacctagaaggcagactttatccaaaaggtg

SEQ ID NO: 654797 - DNA, 304 bp, Homo sapiens
  misc_feature (287)..(287): n is a, c, g, or t
tgttgatggagtctggggaattgcctcatttatttcaatcaatgtcgatggtcatccggttgtccttcaagaatctcctggcgacgttctgttttcaccaacatattcccgatgaggagcgagtggtaatcctgcgcctccatgtacagacgtctctatccagggtcaccatgtctgaactcctggtgaaaacgggcgagtacctctgtctcagaccgacgggaagtgtagtgactccacgctactgagaaaactcgcttagaagagattaaggcgacgctggtcangtgcttgagcagatgtc

SEQ ID NO: 654798 - DNA, 401 bp, Homo sapiens
aaaccggggcaaatcggcagaggcttacctgaatctgcgaccagctcttaacagcagcaacttgcgtcatctcagaaacagcacagcttcacctcaagtaacaaaactatcaaatccttcttaccacactcaggaaaagactggtctatagtgtgatcctgaaaccttgcctgagagcctctttattttctgtggaagccgaatagcagtaacagccagaaaactgagaaagctctgatcaatatccaaaactgtatggcagaaaagagagaaaacagagttgatagagactcagctgaaagcatgtgcctcttttatacgaaccagggctttgcttcactttacccaacctcagcaaacattcgatgctttggagaggaacttagggactcaccaggaaa

SEQ ID NO: 654799 - DNA, 1801 bp, Homo sapiens
ggctttctggcagctgcctgggttatggacagaccctgcctcccctcccgcacggacaaccacctagatcccctatcctgctctccactatgcattcagggcgtggctgctgtatctgagaacattagcaactgggaagagagatggagctcacatggacttacccggtggcgcattactatctgcacaccctatcgctatccaacgatcagatcccctcatatagttccacctgctgcgacatagcacagattcataagacagatataccctgactgcccatgcatgccatgaagcagactagcatcacagcgagcgcggcaaggcggcacccatgaggcactgacaccattgagcactttaacggatccttgctgactcatgcactggatgataacatatgctgcacacctattaccctatccgctccacgatcaccacaacactacatctaaacgacgcataaggcgcatatcaacggcaaactacacttataaacgacatcccacccaactcatgcgcttgactgcaaaacagccaagaagacaaaaaccacatcacacggagaacgacgacatcagacgtcgaaatacaaacacccacacagcagctcagcgcacggataccacactacagctcgaaccccacaaacgcagcgcaatacgaggacacaccaccaacaaacgacggacgacaccacacacctatggcgaaagaacccccacaaacgccacacgaaatcatccaccacacagcacaagccacggcgatgaacacagaaacttgacggaacacaagaaccaaatccacacagcggcacaccaccttgccgcaagacggcccctggggaaacacaccaacaccaccacagtatagagacaccctagcccacaaaccaggcatcagacaccaaaccacaatgcagcaccacactcagaccaccacatccactactcgaacgcaacatgacacccacggcacacacgaggagaaacgcctaggcacccaacgacaacggaggaccacgcgagaatagctacatgcaataagaactcatgcacgagaaaacaaacaaccacagaggagaacagggacacacaccaccgccacaaagacgaccagacaccagagaacaacagcacaagacacagacagcaccaccacccataggcgacataaacccaggaccgacagtacgaacccacaagacgacacaaacagacgcgaacagcaacgacaaacctgagccaccacgacaacatacacacatatcagagacacgtaagccaacaaccaacaacagcaacacgaagtaactcatcacacttactccaatccaaatactctactcaaccactacaccctcgaccacactatcagctaaattatacagaactcattcacctactctcatatttcgataactaccactctacatctcgtatacacctccgaacaatcctcactatctatcgagcacacaatttcacaccaccataaatcacttcgagcgattcttgcaacaccacatcacacatcgcttctttctatacaacacacttctatctatactagtgatctatctaaactatgatacaatcctaatatcctcacaccaacctctgcatctactctactagtctacatcacctactcccacatagcacaatataatgcgttctcatcaaccaccacgctctctaacctacattcccaatcacctacaaatatcacttacaccaccatcaactatagaccattcaccacatctgctgtccagtatattaacaacaacacaata

SEQ ID NO: 654800 - DNA, 843 bp, Homo sapiens
  misc_feature (456)..(456): n is a, c, g, or t
cttgcccccgaactgaacagggagatgcacttgggggtggccattaattccattcactatctgggataatatttccctccccagtaatctagttacttacaaatatgctggttacaaatgcgccagactccctggtggtggtaccatatcactgctggtacaatcctgcttcaacaacaaattaaaatactaagcttgcatgtagaaaaagctcttaatgctagtagcactggacttacgttgttatcagatgaatttgctcaggggcgtactgttgtgttgcaaaatcaaatggcattacacatccttacagcagcccaaggaagggtttgcgccttactgcatgctgaatgttgtgtgtatatccctgacaattctcacaatattactctccttgcccaagacatgcaaaaacaaagcagttagaatataaccatgggcaccccatcgtgaatnggctgtccgactgggcattggcgttggccgtggtgggtgtggtttttattaattgtgcttttaattctcctgtgttttaccctgtatctgtaatctatatcaactatgccttccccatgtatctttacacgttttatccacaactgagtatcaaattgaggccgaatgtgggaggaacaagttaacatattttaacttgtgaacctcaattgaacatggacataaacgatgggtcaccaaactcccggaacagggttgcatgagccccttggagggcatttcatccagcaaaagctttttcagagacaatcctgtcctgtaccgtcaagttacctggagaaaccaacagacaatcacaaaaacaagtagacctttttgtgtcctgag

SEQ ID NO: 654801 - DNA, 545 bp, Homo sapiens
tgactgtatcatgcctagctgtatcctgagtaacatagtaatccgctatcgaggacgacgtagtataacgactgactagagaatgtcgtaatcataggtcatggttgagtgccagagtgaaatcgaatatagtcagcccaatcacaatggtgaagatggtacgtgtagagggaaggtacatgattgatattgctagggtgtcgcatccaattaggtgcatgagtagttagactgcagtaatgtagcggttacgcgtacggacagggatatgggttgaaagagtaggctgatggtttcgataataactagtatggggataaggggttaggtgtgcctgtggaagaaggggctaggattaaaatcttagagcgaagcctataatcactgcgcccgcacataaggggatggccatggctaggttaatagatagttgggtggttggtgtcaatgaatgaggcaggagtccgagaaggttagtagtggcaataaaatgattaaggatactagtataagagatcaggttcgtccttaagtgttgtgtatgg

SEQ ID NO: 654802 - DNA, 951 bp, Homo sapiens
aatattaataggtcaacactctcctagcctttactactaataataattacattttggactagcagaacacaatggttacgtaccaaaaatccacccgttacgagttgcggtgtcgaccctatatccccacgtgcgcgtaccttttgtccatacaatgcttcgttatgtagcttattacctttcttatcatctgatctagaacatcgacctccttttacccctaacgcatgagctcgggtaccaacagcaaactaatccgtggccactaaatagttagtgtcatccctctattattaaatccagtcacttccctaggcacctagaagtctcgggcctatgtagctgacataccgagaaagagtattagtactgagaccgaataacccctgaacgtgactctctcctgacatagagatgatcaaatgaaccccaaaataaaactagcgggggggggggtccctggatctgggctcttcgccgagtgacttgaccagcatgtgtctccccacggaggtcctttggtcctcccgtgggctgccgcttcatcgcgaggagtgacccattctggagccagggggggcgaggcacccggtattctaaccctgaagggaagttccggagaactaccccgaccccgtgggccaattgtcgccaattcaatccccttttcgtgcttcgtgggggcggcgtcaccccctgggtgagagctcacgcaccacccatcaaattccagagggcatcgtagggaggactagacgtggtgcccagggtgcttcatcgcggggaaaccccggaaataaaagtcatctgcctgccccagtcaggaaattgcacacaaaaccaggaaaaaaggcggcggccgattttaaatcacccagcgggggagacacacaaacacgagggggcctcccggtatctaggacaaaggggggccctaaagagacgggcaaa

SEQ ID NO: 654803 - DNA, 756 bp, Homo sapiens
gggacaaggccaacaagctatgtgtcatgaagcttgtcacgagtatctgggtaccaggttagagctcgagagatggctgctgtacacgtttattgcaactggttttgatgtctacgaatttcagctccaatcttcgcatcctgaggaacacttaaacgtttctgcaggtcccattgtgtatacagacgttgagaaggaccggtacataagcttgtctgggttgccacgaagcatatctttcttattctgctccatcccaagtaaacaggctggtgccctcactgtgatagattgttccgaaacaacataatcaccgtggagtgcagccagttctacgcagaaatatgcctgtcagctgggcgattcaacaaagtggagtttccccaagcacagcttcttgtgaagaagtgcgtgtgagaggtgtgtgtatatgtgtgtgtgtgtatttgaagtttattatttgtattgtgcaaaaattttgtgtttgatcttggggattctggctgtgaagtttggtcgcacgacgaattatggtgaatgagaacatttgcttggtctagagaagatcattagatgtgttgtgaccatacaagttgtagacagctggatcgtctgatgtagtaggtatagttaagatagccgggactgtttcccgggcacagaatagtgatcgtaagttaggatggacgttggatgtgattatggatgaataagggaaggtcgggggcctattttcaggccggggtggaaatccac

SEQ ID NO: 654804 - DNA, 493 bp, Homo sapiens
gcaacgagctgactgtggaagtgagttgtatcggggttgatgtaaataactgacagcaccttatcctgagtgatgttacagctgcagacccatggtaagccagccgacaagtatcatatgccatatattaactagaataggttccagcttactggtttttcctttcggagtaggtgttagtagtaggagatggcacagtggtgatagtatggtagggtgccactgtaagaagttatagtcttataatcacacagagaactcatttagtgctcactagtgccatatatggacaaaagcttgtacaacgaacaacccagtagtgtaaggacaacatacattacttttccaaacgttgatcaactacttgcatctaaccaaggtcattacaatggaattcttgataggcccaaaagttcatcacacagtacacaattccttctatctatcagcatcaggaaatgttgtgtaaatcaccagtgtatgtaggaaaatg

SEQ ID NO: 654805 - DNA, 547 bp, Homo sapiens
  misc_feature (315)..(315): n is a, c, g, or t
  misc_feature (486)..(487): n is a, c, g, or t
  misc_feature (489)..(489): n is a, c, g, or t
catgctgctgccaccccagacactggctttgcctgcaacctctgtgggcagagcttccgaggctgggtggccctggttctgcatctgcgggccaattcagctgcaaagcggcccatcgcttgtcccaaatgcgagagacgcttctgcgacgaaagcagcttcgagctcatcatgcgcgtgccaccctcccgccccggagcccggcccttcatatgcggcaactgtggccggagctttgccagtgggaccagctagttgccacaagcgggtgcacgtagccgaggccctggaggaggccgcagccaaggctcttgnggacaccccaggggcgcccccggtgaccgccccccggcccggtggagatgccgtcgaccgccccttccagtgtgcctgttgtggcaagcgcttccgcacaagcccaacttgatcgtcaccgccgcgtgcacacggcgagcggccccaccagtgcccgagtgcgggaagcgnntnaccaataagccctatctgacttagcaccggcgcatccacaccggcgagaagccctacc

SEQ ID NO: 654806 - DNA, 367 bp, Homo sapiens
tggggactactgggtttggctgttctaaaaaatcataaagaagggaattcatagtggggaagtttcggaaaacgtgaaaaagattcagtgtgtgtaaagctttttttggctgtgtaagttatggcttttcaaaagaccccccctttttttacagaggacttttttggcgcaacgtggtggacacttttcaagtggtgccttgaaattcttattgaccctcaactttttcaaaagcactttttccaagtgttatttatagccagtgttaaataagtgtgtagaatagaggaattaaccgtgttattatctgtgggataaatataaaatatttatttcggcacctagtgaaaaaaaaataaaaagaggg

SEQ ID NO: 654807 - DNA, 349 bp, Homo sapiens
cggaagatggacctctagtatccagattatagtttctaatagcattgcctacaccccactcccaaaagacgtcagggatctctggaggaatgcctgattccagttttgaggcaagaaatgtatagaatatgccaggctcatcttctcacgccagtttataccagctacagtcatacttagctttatcttgctctgcgctattgtgcttcattttattgcactttgcagttactgcattttttacaaattgaaggtctgcagcaatgctgtgttgagcaaatctattggcgctatttttccaaaagcatgtgctcatttcatgtctctgtgtcacatcttggtaattctc

SEQ ID NO: 654808 - DNA, 252 bp, Homo sapiens
gcggacgatgccttcggacaccatgaattttgatgttataaagggcaagccagtacgcatcaatgtggtctcagcctcatccatcacttcgcaaaagtagagtaggcaacatattcaataaaaatctggacaaatccattgataataaagcactgtatgatacaattctgcttttgggtcacataccctcatgtaaaggtcgtttgtgatagaaaaaaggttcccagggctatagggtatagtacacactga

SEQ ID NO: 654809 - DNA, 228 bp, Homo sapiens
tcgacgcatatcacacagtcagtggagtggtgcagtcttggctcattacaacctctgcttccctcggtgcacgcaattctctgcctcagccacatcgagtagctggcattacaggtgtgcatcactatcctggctcactatgtattaccagtagacacagggttccgccatgttggccaggctggtctcgaactcctgacctcacgtggtccacccacctcgggctcc

SEQ ID NO: 654810 - DNA, 927 bp, Homo sapiens
catataatatagtaaaaaccagacctatgagccctaataagcggctccactctaatccctcctaatgaactgcggccttactcatgtgataaaattatcaactcaataacgctcctcatactaggcctacctaatccatgtatcactaaccatataccaaaatgatgcgctgcgaatgtcactcaagacgcagagcatcattacacacagggtcaacccactacttcaactgtccaaaaaggccttcgataccgggataatcctatttatggacctcagaagtcgggacttcgcaggatattctgaggcggggacgagtccaggctgagcccctacccgccgaattaggaggggcacttgggccccagaggaataaacaccggtaagagtcccctagaagataaccaattcctacagaggagcgagtccgtaatactcgcgatcaaggagtatccaagtgcggccctgagctgcgaccatagtcggacatagaaaacaagcgaacccaaataattcaatgccaccaagtttatcccccctcgaggggggtctctgatttaccctcctacaagcctcaagagtacttcgaagtctccttcacattttcgacgggaatctacggtcaacatttttgaagcacaggctccacggactcacgtcataatggtcaattcctcaatatctggttcatcgcaactagtattcacttacatccaacatcacgggatcgaaacgcgcgatactggcttgtaatgggcgctatcggagccacacgtgagccaaacaaaaaaacaaaaaagaggggcgccgcagacatcaacgctgccgggccacgaagagaaggcaagaacgagggggcacaaacgcgcaggcacctcggcagccacagcccccgggaagaggcgggtgaaccatagacacacgcaa

SEQ ID NO: 654811 - DNA, 216 bp, Homo sapiens
tactgagtattgatagttgggtggttggtgtaaatcagtgaggcaggcagtccgagggggttagtagtggcagtaaaaatccttgaggatactagtataagagatcaggttcgtccttcagcgtcgtgtatggctatcatctgttgtgaggttactttgattagtcatagttgggtggtgattggacgagcgttgatgagatatttggaggtgggg

SEQ ID NO: 654812 - DNA, 794 bp, Homo sapiens
gggtggaggaagcccctgtgaaaaaagcgaagcgatcatcctgaccactgctgccctagtgcttatggaggaacacttggtgatagcaggaaagagaccatgccttgtgtggccatcagtgcttctctttaacgcatggcaaaaagatatgcatgtgctgtaagtccctatgtgcaagcttattggctctgtatcatgttttatacacgcgtttaataaactattgttcatagaatgatattatgtacgagtttatttcagataaatggacaaataagtttactttgtatctgaactcaaaacaaagtagttgtatatcttaactattcaaaattgggatttcccaatgtgacactatcattgaatgcaaacccctccagcccatcatacgcctaggctgcctacctggtaaatctgtgtatagtatataaacatgtaaaacataggttgtattttactctatgtatgatgcgtaagtcaactgaacagtttatttattttacagagaaaacttatcctgtgaactttactatatctctgtgaatgttacttaatttggcttgaaaattagcaggggtttaaatgctatgcagtcccttgagtagagaaagttttgagggactctgcctggtctgataacgtatcttaatatgatctggcagaaactcgcgtgttccaggtaatggtactttagctagagaacggttcttcactggcttgccgtcgcacgtcgtggctctgtgtttagggaaatgtccttgtcagatttactgcctcgtggaactgtctaccag

SEQ ID NO: 654813 - DNA, 416 bp, Homo sapiens
  misc_feature (11)..(11): n is a, c, g, or t
agaggattccngaaagaggtggtgtctcccacatatttgtggttatctacctttggtctttgatgatggtgacgtacagacggggttttggtgtggatgtcctttctgtttgttagttttccttctaacagtcaggaccttcagctgcaggtctgctggagtttgctggaggtccactccagaccctgtttgcctgggtatcaccagcagaggctgcagaacagtgaatactgcagaacagcaaacgtagctgcctgatcgttcctctggaagcttcgtctcagaggggcacccggctgtgtgaggtgtcagtcggcccctactgggaggtgcctcccagttaggtaggctactcgggggtcagggacccacttgtgcaagcagtctgtccattctcagatctcaaactctgtact

SEQ ID NO: 654814 - DNA, 165 bp, Homo sapiens
cggactcacaagacggttcacactcagcgtcctccgagggctaatacacatccttctccccacactctgttggtcagaagtcactgcttgggcccatgtacctttccttctcctccaccacgaggaggaggaggcacagtagtcccaaaatgacagttttgagca

SEQ ID NO: 654815 - DNA, 637 bp, Homo sapiens
  misc_feature (637)..(637): n is a, c, g, or t
cctacgtggttgagaaggcaactcagtacgtagctcatgcggatttgctatagctgatcatagtcatctgattacgcttgctgtagttcgcacactaggtggattaaggagcctatcatctgatgcgtgaccatgaaggcatagcagtcaacgattcccatggatgatcgcaagatcagagctccttcgagtattgtcgatccctctgcgtctccagctcatctggtatgctacagactgcatgccacactcaaagctatgtcccgtcagccgccagagctgagccactctaatgctagctttacacacttctgatcagcacagtgtcgtagttttagcgcagctcctgagtcgaatgattcatgtgatagatatccccgagactggtcctattgcctcgaaagcgaagagtggtacctgcgctgggcctgtagatgggctgttcgaatctttcagatatgctggggatacccccatgtacttgctagattaatggctctgtccttgaatgcctagcttttatgcattgaggcgcaggactgccattgttgataagctctcaggcctccaatctctcagagtgctcgggtaccttccctcaactaagttctttaatatcccgtttttctctagcttn

SEQ ID NO: 654816 - DNA, 308 bp, Homo sapiens
gatagtgagtgcgcatgacaatccttggatctcccttcgtggacaggacaccggggtctcctgcccacccaggaaggcgcgaggatgctgatttgaagcgatgtaaatagtgattccagacaccgcctgaccatccgctattccagacttgctaaaagcgaatgtaatctggcccctttcatgctgtgatacctcctggtacacactggcatctctgatcctcttagaatgggttctggtcctagttgtcctccctctggagcctcgtcctgtggtccgcctcttccttgcctcggcgcccccggccg

SEQ ID NO: 654817 - DNA, 1487 bp, Homo sapiens
agcgggggcgccactgcgcacacgtgaccgaaccgcgccactgctcatcggccgaggcgactgcggcccgtcgttatccttccctgcccggcccttgacgtcgggacttatcgcgtgctcacgaggcgcctggccgacgcgcaggtgcccaagggctccgggctcgtgggttcggcagccacgacggcgtgctcacgaggtgtgctgttggtcgtgtggcagacgtgagtgcgccgattgtgctggtgtgctccgtgatagggtcgggcccacactaggagccttgccttgcccgcttccgtcgaccagatcccgctcgcaagctcactgactagtggacctcagcaccacagtacccttccttattgcattcttgcgaaccctggggagatgtccactcgccgcgagtaagctacctttatgtgacgaacggctatactagaaaggctttgacgtgcggccctacgacttgccaaggtgcgccgatctatgcgatccttcggctgggtatactccttctcgtacgttaccctctgcgggcactaccgatgccattccaacctaccctggtggcggtctgtccaacctgactgtgtctgccggggttcccgcccattttgcttggttcgtcgttggccctccctggccgtgcattccttgacgtcggttctgattgcacttttagccgcctttggcaaggtcctagtgcctagcgcaatgggtgcctttgcagccctgcgcggcgtatcacttccggttcccccagggcccttgcggtcggtctatcccaccagctcttgctttcaccaaggggcctgccccgaatatgcctattcggttcggtcctgagtcgggggtccataaccaccgctacccgccgggcaggccttgccaccatggcttttcttgggaaggcttgggttgccgggggattgccaggaagtgatacccaactggctagccttggtccgtccttgaacccctcgctgcggttgttacgagagcgttcaggcccccctgccagctttgagcctgaggagcagaattgcggcgacctgttggcggccaggctcgttgtggtaccattgggcacgcggaaagataccggggcgggtttgtgtgtgaaccccctgggtgggaggagttaggaaagtgtccagcaccgaaaggagagctaacaaaagctccacatcgccagacagcaccgtttccttcccccagggtgcatggggcccatttgcctgtgttgcccccgcgtcaaaccaggggagccccactggaattttgggggggtcctgcaaggttacgcctgcttgtgagaacacggggctcgcgggtgagtgcgcttgtggggggaaaccgtacgcaagttaccttgtgcaggaaatccccttgttggtgagaaacgaaggatgtgttgactgaggagtcgggttagcacacgcgggaagataaagtgtgtcgcgtcattttagccgtcttcccgc

SEQ ID NO: 654818 - DNA, 183 bp, Homo sapiens
tataaacccggaaaataggctattatgaacatcggtcttggagaagtattctccacagcaaacaaacctacggaagcagaaatctaacttgggaagtgtcatccatatttaagtaaatatgctaacatacggaaatagaaatctataataaataatggccagtaaaaccacctctacacataa

SEQ ID NO: 654819 - DNA, 242 bp, Homo sapiens
agaaaaaaattttaaggtaaggttaatggaattaatgagatgaaaagatagtaaagcccggttggctacttacatgaaagaagactttaaaaaataatcacggcacaaaaggtaaaggggggggttatgctgtgatattaattttcctcaataaggtttttctggacggttcaagaacaaattaaagtttccacggcaaattggttttcaaaaggccgaatggcgaaacaatggcgggcttc

SEQ ID NO: 654820 - DNA, 1043 bp, Homo sapiens
  misc_feature (9)..(9): n is a, c, g, or t
  misc_feature (43)..(43): n is a, c, g, or t
  misc_feature (53)..(53): n is a, c, g, or t
  misc_feature (123)..(123): n is a, c, g, or t
  misc_feature (133)..(133): n is a, c, g, or t
  misc_feature (145)..(146): n is a, c, g, or t
  misc_feature (152)..(152): n is a, c, g, or t
  misc_feature (271)..(271): n is a, c, g, or t
  misc_feature (321)..(322): n is a, c, g, or t
  misc_feature (329)..(329): n is a, c, g, or t
  misc_feature (331)..(331): n is a, c, g, or t
  misc_feature (530)..(530): n is a, c, g, or t
  misc_feature (580)..(580): n is a, c, g, or t
  misc_feature (747)..(747): n is a, c, g, or t
  misc_feature (813)..(813): n is a, c, g, or t
  misc_feature (821)..(821): n is a, c, g, or t
  misc_feature (857)..(857): n is a, c, g, or t
  misc_feature (901)..(901): n is a, c, g, or t
  misc_feature (955)..(956): n is a, c, g, or t
  misc_feature (981)..(981): n is a, c, g, or t
  misc_feature (985)..(985): n is a, c, g, or t
gtttcatgnggcgaactaaccctgcggacagggttggttgtgngatggagctnagcatgctacaagcgaatgacagcatccatcacataactcttcttttcttggctgtctcacaccaccacncgcattgatnctcattgtagtnngtagtnttactagaacaagctcatgccgatgtgccagtgaattataatattaggtaatatgtgaacaattttttcagtacttcctaaccataccttttgactacattcccaccatcgtcgatatntatttaatgtatatagctgtgccttaaatctcccgtttcctcctcgttcnngtttgcngnttggatggccttgatgaatcacacatatattaagtcctttcatccactcgattgttacctcttgggttgcttttctccttataatgttccgagtttattcttcgtgcttgcctgaatattgcatctctctcacctcgtctatcttcccatcgcgcacaatgcgcactctaactagtctacttcatccccatctcggtgnttccagtgtctatacttctcatgagacatcgctgtttgtgacattttgcntgctaggaacaatattactataccagtattggcgtcttcggagccccttttaaactattattccgcgattctatattgacataaatgtaaacgactacatagaggcgctgcccggtagtgccactgctaacaccgtcggcacgtgctacttccgccccgcgtcgccntccacctcatcacaactctggacggcgatacccacactctccacacgatgctctctctacatcttnatcgtaantgttcaccacacgtcatctctcgccacctctcgcgntcgccgctctcgtactcagtcacctccgctcgccagtcatcttncgtctacagaggtctgtacgctgcacgctatacgattcgtatcgcaccgcatcnntccctgttatcgctctcaccacacncaantagctatacgaatactcaacacgtcacgcacacagcacgccgaccctagtcattcatt

SEQ ID NO: 654821 - DNA, 852 bp, Homo sapiens
gggcctgcaagggggcatcccccacgcccacccaggacagtgtccccccgaggactccgcagcttctgacacaactccctgggggctacggtaggcgggcctagcccggcctccacggccccaacggaggcgccctcggaggttgggatcttgagccgcacagctgagccgcctcgtgacccactgctggactgggcctgaccttcccgagccagtaggggtagagggaggccagccacctcgcttcctctgggaactgcaccagccagtgatcgggggctcttcacgggtttcgtgggttttgcccggaaggcggctgttcctccacctgctagcgaggtcgcgacacgaggcattgtacccgctagtgagatggttagagatcggtcagcaaggagaggaggtggtggaggttaccgcggaaggttcatgagagagggtcttggaataggtctgcacgtgaaccagtcctgatggatggagtaggggtcccagtggtgaagcgtctctgagcaaggtagtgaggtgtggtaggatgaggccgtgcttgggcgatggggcactcgcgcccgtagtagccggccgaccgtcagccacggctcatgcactggtgctccctgcacgtgccgtctccatggcccctgccctccctgcgtgtgctgccaggcttggggtccccgggagaacagagcttgcgcctagggaatagggacgctggggtgcaggcgccaacatcagtggcagcagccagggccgtggtccagtcccattcggggatggactgggccggcggccgaaccagtcacttcggggaggatgcggaggagcagataatccagtctattaattgca

SEQ ID NO: 654822 - DNA, 333 bp, Homo sapiens
gggcccgtcgtggctgcaacccacggtggtatgttagtgtttccaggcacttgacagcagctgccgggtagtgtgtgtgtgcgacaacctgagagttcctggaggaaagggactggggacactttctaagaggttctcctgcctggaatcaagtgatgcgtgtccacaaggcaagagagggcggctccacctggtttaattttgggaacgggacggagccatctcctccttgcagaactgtgggccccactctttggtgctaacacttcccctacctcggttcactgtacaaagagctggtctgccccctgcattaccctgaaggtccctggc

SEQ ID NO: 654823 - DNA, 130 bp, Homo sapiens
gcctgatggtctgactctacgagtgatccccttgcatatggcaaggccaagcgtaggggcacaccaccacactgatatcctgtaccatgtcctgtgccttacacaagctccttggccttgccatatgcaa

SEQ ID NO: 654824 - DNA, 271 bp, Homo sapiens
accaaagggggggaaattgggttccgggaaattttaattttcccccctttggggccccctaatgggaacggccggtttgcccggggggggaaagggaaacccctggcttccccccgccccttgggggtttttaaagggaatttcccggggggggaaatttgggaaaaaaaaatgggtttttttttggggtttcaaaggggggcccatgaaaaactgtttgggtaaacccggggggggggcccaaaaaaaagccccgaaggcccttttggta

SEQ ID NO: 654825 - DNA, 751 bp, Homo sapiens
agcgggctgtagtggcttcgctcttcggtttgttctctgtccttcgctaacgcctcccggctctcgtcagcctcccgccggctgtctccttaacaccgaacaccatgccttcaattaaggttgcagagttctgatggagagactatttgaagttgatgtggaaaattgccaaacaatctgtgatctacttaagaccactgtgggaagatttgggacctggatgatgaaggagatgatgacccagtttcctctaccaaatgtgaatgcggcactatttacacaaggtcattcagtggtgcacccatcagaaggatgaccctcctcctcctgagagatgatgagaacatgagaaaagcgaacagatgatatccctgtttgggaccaagaattcctgaaagttgaccaaggaacactgttcgaactcattctggctgcaaactacttagacatcaaaggttggcttgatgttacatgccagactgttgccaaatatgactcaaggggcaaaactcctgaggagattgcgcaagaccttcaactatcaataaatgactttactgaatgaggaggaacgcccaggtacgcaaagagaaccagtggtgtgaagcacacagtgaaactgttgtgcctgactactgtaacacttgtaaggattgttccagatactgagttgcactgctctgtttataactgttcatattagacaaacagtaggacaaatgcatcatccaggtcaatgtattagcggact

SEQ ID NO: 654826 - DNA, 291 bp, Homo sapiens
ctggctcagtcctgcctctgcttcgcatctctctccggctcctccactgctcccgtgtctcttttcagaagcttaatatgcgatcagaacttccatggctagaaggccgttgacctctcgagtctgcacagcaggcttctagtggctgacggtggtgctcagagccacctgccctcgggcaccttgtgttctgggctgtgaaatgctcaaggacagggactgggtcagtcaccaactacctgggagtgtactgggtactgctgggtatagggctgcaaagaaaacagcaca

SEQ ID NO: 654827 - DNA, 446 bp, Homo sapiens
  misc_feature (29)..(29): n is a, c, g, or t
  misc_feature (135)..(135): n is a, c, g, or t
  misc_feature (218)..(218): n is a, c, g, or t
agtttttctggagcaaacaatggaatgtngcaatgtttatctctgtcagcaacattctggaggtgaagagccccaaacccatttctagtaattagcgagggtaatgacttcttagtgacccagggacgtaggctnaggtagggaaagccttacgggaggattcatttggcgttgtgtgactaccccaaaggtctgagccaaaggtcctgtgccttagnagtgggaggggtttgtgtatgtttcctgtaagttctgttcataaatgctgaaattcttctgttgacaggatagtaatgaacccaattggttagaaggttgaagtaatggaaaaacctgtttcaataccataagttgtgattgttgtacttttcagattgcagttcttctaaatggcttatagaagtttccaactctgctttgccctgacacataagctctttagggta

SEQ ID NO: 654828 - DNA, 492 bp, Homo sapiens
gcagagaagtttcatcaagccagaaaaggtgttggaactcgccataaggcattgatcaggattatggtttcccgttctgaaattgacatgaatgatatcaaagcattttatcagaagatgtagggtatctccctttgccaagccatcttggatgaaaccaaaggagattatgagaaaatcctggtggctttttgtggaggaaactaaacattcccttgagggtttcaagctatgatcagaagactttaattaaatattttcatcctataagcttaaataggaaagttttttcaacaggattccagggtagctccctacatgttgaaaaaaatagcctttaaatcatttttaaattaaaactttgtataatagagataagtccattttttaaaaatgttttccccaacccataaacccctaaacaagttgttttagtaccaaaacatgagaaaaatgtttatgtagttgaaaataaaatgaggtcccaagcca

SEQ ID NO: 654829 - DNA, 1050 bp, Homo sapiens
ggcttgcccggtcggtcgctagctcgctcgttgtgtcgctgtctgtctccgctccatggctggctcttcggtgcggctgctggctctcgtccctggtctctggaccctgtgtgccccgccgcgaaccctggcggggtcccgcgcaagtcagccctacctatgctggtgctgcagctacagtgaggctccggggcctgtcgaggccagcggtcccaagcgtgtgtgctgaatgccagaaggttattgcgcgctaatacgcgaagtactttcaccaaagcatgcgacgcagtggtacgcaaaggagaaactgtggctgatcaaacgagctcatcagctacgagtgcgtgtcgctggatatgaaacaggtcccgtggtggagaagggctgtccgagcgaggccttatcactctcataaaactttactgataagcctggggagtctgttggattcaaccgagcgatcagtctgtacgacgggaggccgcacgggagaagctgaggcctgagatggaggggcccggcaagcaattcaccagtcttcgcacccttagcagaaggaggcctgggcctccttgtccagcatgaagtgcgtgggacatcccgtggtcagaaagtgtcaacattgagctgctcaatgcctccgactacgcatatggtgggcaggcgagatcctgactgatgagctgagaacgggtatgacctcagctctatgtaacagaattccaacatccagatccaacacatatccttaatgggatttgtagactgttgaagtgtggcccgggtgtgaaagcagacaccatgcaacaagggggtggtgactcatcgataagtcattccacatcacaaagaattcagggaattattggaaacgaggacacttgagaccttcgggtgttggtaggatgcgtcaccagagcttgaagggacgcaaacgctatggccaacaagggttagaaaaccggattgacgttcggaacaaacgaaacgtaacacctggagtgttaccggggttgacacggacggggggggaaaagaggacaaccggat

SEQ ID NO: 654830 - DNA, 436 bp, Homo sapiens
attcactggtcctaagagtcaccatgcgcaagattgcccagctattatagggggctgggagacacctgggatgtgcataacatcgtatggccttgatgtgctcatggcgactgctgatgggctgagacagcgctctgggggcttggaacgccccgtttgtcctggtcaggtgtcttgttcgttggatcccagcggtttggagccgtgtggacaggggacaactactgtcgagctgagagcaatgtcgaaaatcatctattcggtatgtgtcgtctagcttggagcttggtgggacttgtctttctgtggggcggatgtcgggtggcttctacaaaaacccagagccagagctgcttgtgcgctggtaccagatgggtgcttaccagccattcttccgggcacatgcccacttggacactgggcgacgagagtcata

SEQ ID NO: 654831 - DNA, 170 bp, Homo sapiens
ttttgcggggggggcccccttttttggggccctttttcccccccccccccttttttggtttgggggggggtttggtttggggggaacctggggggggtggctttttttaatgggttttgaatggggggggggggtttttaaatttgggggtttaacctttttaattttga

SEQ ID NO: 654832 - DNA, 326 bp, Homo sapiens
aaatccatctggaatcagaaaacggtgggttttggcaaatggtccttgtgccctcccccctcatccctgggttggtcccctggtgcctatagcccttttccctgagcaccccccccacagaatgggggccagcccccttgcctgcctgtgtttctccccaaacccctttaaatggggagggaaaaggaggagaggggagggggcctgccccctcctcaggcatttgggagggccccgcccccctgggctttacccttccctgcgggctctctccccggcccctttgtttaaatccaacctgaataaaactcccagttttatatgga

SEQ ID NO: 654833 - DNA, 1211 bp, Homo sapiens
  misc_feature (142)..(142): n is a, c, g, or t
gatcaatcctccatagtagtggtggtggcagtggtggctggttatggcaatcaagaccagagtggtggaggtggcagcggtggctatggacagcaggaccgtggaggccgcggcaggggtggcagtggtggctggcggcggnggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagcttaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagtta

SEQ ID NO: 654834 - DNA, 820 bp, Homo sapiens
aaaacacgcaccaaccaccttgacggtcacgtcgcgtagctcgcctggtttatacggcacgcgggcaagctgaagggagaggcaacggtctcttttgatgacccaccttcagcttaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagtta

SEQ ID NO: 654835 - DNA, 1761 bp, Homo sapiens
  misc_feature (692)..(692): n is a, c, g, or t
atggcctcaaacgattatacccaacaagcaacccaaagctatggggcctaccccacccagcccgggcagggctattcccagcagagcagtcagccctacggacagcagagttatagtggttacagccagtccacggacacaggctatggccagagcagctattcttcttacggccagagccagaacacaggctatggaactcagtcagctccccagggatatggctcgactggcggctatggcagtagccagagctcccaatcttcttatgggcagcagtcctcctaccctggctatgggccacagccaactcccagcagcacctcgggaagttacggtagcagttctcagaccagcagctatgggcagcccccgagttacggccagcagcctagctatggtggacagcagcaaagctatggacagcagcaaagctataacccctcaggctatggacagcagaaccagtacaacagcagcagcagtggtagtggaggtggaggtagctatggccaagatcaatcctccatgagtggtagtggtggtggcggcggaggtggcggcggcggcggcagtggtggtggtggctggttatggcaatcaagaccagagtggtggaggtggcagcggtggctatggacagcaggaccgtggaggccgcggcaggggtggcagtggtggctggcggcggnggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagcttaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagtta

SEQ ID NO: 654836 - DNA, 1903 bp, Homo sapiens
  misc_feature (692)..(692): n is a, c, g, or t
  misc_feature (1774)..(1774): n is a, c, g, or t
  misc_feature (1780)..(1782): n is a, c, g, or t
  misc_feature (1786)..(1786): n is a, c, g, or t
  misc_feature (1795)..(1795): n is a, c, g, or t
  misc_feature (1887)..(1887): n is a, c, g, or t
atggcctcaaacgattatacccaacaagcaacccaaagctatggggcctaccccacccagcccgggcagggctattcccagcagagcagtcagccctacggacagcagagttatagtggttacagccagtccacggacacaggctatggccagagcagctattcttcttacggccagagccagaacacaggctatggaactcagtcagctccccagggatatggctcgactggcggctatggcagtagccagagctcccaatcttcttatgggcagcagtcctcctaccctggctatgggccacagccaactcccagcagcacctcgggaagttacggtagcagttctcagaccagcagctatgggcagcccccgagttacggccagcagcctagctatggtggacagcagcaaagctatggacagcagcaaagctataacccctcaggctatggacagcagaaccagtacaacagcagcagcagtggtagtggaggtggaggtagctatggccaagatcaatcctccatgagtggtagtggtggtggcggcggaggtggcggcggcggcggcagtggtggtggtggctggttatggcaatcaagaccagagtggtggaggtggcagcggtggctatggacagcaggaccgtggaggccgcggcaggggtggcagtggtggctggcggcggnggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagcttaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccagatggcccaggagggggaccaggtggctctcacatggggggtaactacggggatgatcgtcgtggtggcagaggaggctatgatcgaggcggctaccggggccgcggcggggaccgtggaggcttccgagggggccggggtggtggggacagaggtggctttggccctggcaagatggattccaggggtgagcacagacaggatcgcagggagaggccgtattaattagcctggctccccaggttctggaacagctttttgtcctgtacccagtgttaccctcgttattttgtaaccttccaattcctgatcacccaagggtttttttgtgtcggactatgtaattgtaactatacctctggttcccattaaaagtgaccattttagttaaatttttttcctnttcccnnntttnactttcctngaagatcgatttcccgatcaggaaggtagagagttttcctgttcagattaccctgcccagcaggaactggaatacagttttcggggagaagnccaaatgatatccttg

SEQ ID NO: 654837 - DNA, 278 bp, Homo sapiens
gacggaagagtatggtgatgccagcagctgtgaagggagtagaggtaggcagccttccatggttgtgaacacgtcaagacagcaaccagccccaaacagtgaggacgaaggccatcaggtgcagcgctgcatggaggagtttccaggtcagtttgggccccacccatgattggggcaggcggtacaccagtgacgcacttccatagaataccaccatgccagcaaccataagcactgggtgccagttgcacatgtagatgctgccagctatgctcaga

SEQ ID NO: 654838 - DNA, 216 bp, Homo sapiens
ttacaatctggccctgaaaacatccgaggcccttcagtaagtgggatcttttttaaagatcctgggtgactttgggggcccagggtgaccgagcatttctgcccctgtgaatgtggccctaaccctgtgccctgtttcccccaaacaaggtttcccctgagtttcttttcatgttactgggtttgtaaatgaataaacccattttaactactctta

SEQ ID NO: 654839 - DNA, 345 bp, Homo sapiens
  misc_feature (156)..(156): n is a, c, g, or t
ctttttgggaaagggaaaacccccggggggttttttttcccggggccaagggaccctgtccaaaaattcaagggggtgccaccccataatcctttgggaactgggtttttttctggggggtaaaaaaaaaaaggggggtttttttttcccaagaanaagttccttgtttttttccaaaatggggttgaaaaaccccccgcccaaggggttcccttttgtggaaggttaatttaattgggccaaaaaggccaatagtttgttttttttgaaaccccttttttttttttcccataaaaaatttgggggccaattaaaatatttaaacccattccttttttccgccca

SEQ ID NO: 654840 - DNA, 1132 bp, Homo sapiens
  misc_feature (142)..(142): n is a, c, g, or t
gatcaatcctccatagtagtggtggtggcagtggtggctggttatggcaatcaagaccagagtggtggaggtggcagcggtggctatggacagcaggaccgtggaggccgcggcaggggtggcagtggtggctggcggcggnggcggcggtggtggttacaaccgcagcagtggtggctatgaacccagaggtcgtggaggtggccgtggaggcagaggtggcatgggcggaagtgaccgtggtggcttcaataaatttggtggccctcgggaccaaggatcacgtcatgactccgaacaggataattcagacaacaacaccatctttgtgcaaggcctgggtgagaatgttacaattgagtctgtggctgattacttcaagcagattggtattattaagacaaacaagaaaacgggacagcccatgattaatttgtacacagacagggaaactggcaagctgaagggagaggcaacggtctcttttgatgacccaccttcagcttaaagcagctattgactggtttgatggtaaagaattctccggaaatcctatcaaggtctcatttgctactcgccgggcagactttaatcggggtggtggcaatggtcgtggaggccgagggcgaggaggacccatgggccgtggaggctatggaggtggtggcagtggtggtggtggccgaggaggatttcccagtggaggtggtggcggtggaggacagcagcgagctggtgactggaagtgtcctaatcccacctgtgagaatatgaacttctcttggaggaatgaatgcaaccagtgtaaggcccctaaaccattcctcttttgtagagaaacacgtactctcttggaggcttctctccctctcttgttgctgcctggcacgtgctcaccctttcctgccctctgcctcacttaatctggctacctcactctctagtctcagctcatgcatgatctttaggaaagccatccctgacagcttttatgttccttcctaatacccagtgcctaaaactggcaggactcaataactaatattagcaaataagctgttatcaaggtgatcaagatgtctctcagctacagcagggtcacatgtaaggcatgatgtcagtcagtggtagg

SEQ ID NO: 654841 - DNA, 879 bp, Homo sapiens
ctcagcctccaaagtagctaggactacaggctatgccatcggcatgcccaggttcttcgttttggtataagtttgattatttgtagattcacagagttctgtactctgttgcccaggtggcaatgcctttatgatcataatgactcttcactccaggtttccctttagtagtggtatgttgtgataatctttggctttgatgtgtgaattgctatgattaatctagcagctgtttgtttgctaatgtcgacacgctgcagtgcacctgagtctgtgtggcatggagttgggcatgagtagtgtgttgtgtgaaggaggtcaaacgttatctgaggtgggtggcttaaggtagtatataccaagttatgttgcctgaatttgaagatatgtcatgcaggaaaatttatgtatagggaagaggatgatatggtgggtgaacaaatggggagtgaggaatcaaaaggtttgagttctcattgtgctgttgacttgttttctgatcctaacaagttctagattctgcaagcgtccattcatcagatgatatacagaaagcgctctgtcagggggttgcaaggatctaattagagggtattggcgaattgttggacctggaatggtatcagattgttagtgatgtaagaaaacaggatggctagtcagggtgctcaagggaagtcttcaatccagactctataacctggaagaggatatattggcttagtcataagggctggtacggagaagtaggattgggccacaatttagtgtgtgccactagacacggttgcgggggggggagaagacaggggggtcacggtgcaaagaggggacaaggggagggaattctgggcaaagagggtgggggtcaagggaggg

SEQ ID NO: 654842 - DNA, 819 bp, Homo sapiens
  misc_feature (443)..(443): n is a, c, g, or t
gctataattccagctactccagatgttgaggcaggagagttgcttggacccgggaggtggagggtgcagtgagccgagatcgcgctactgtactccagcctgggcaacagagtgagactccgtctccaaaaaaaaaaaaagggtgtcttaaaccttcttggagaagtggtagccgtggcttcttaagcttctcatattggagtattcctaagaaggtggcgtccagagtttccaagagtaaattttccaagaccaaaccaagcgtcagtggggaaatctggcacctctttggggaaacactggccgatcatattcaacttttcctggagtccccttgggtggcgggtggcggggagaatctctgggcctcagaggaacccttgagagggggctcttgtggcgcggcaaaagattgggcctttgtggtaattgcgcagcgccancttaagagacaccaggggaccttctcattctcaaaacggcgcattacattggaagtgtaacccagggggttggacccatctcaacgtaaacattctaaaacgccaccaaaggattcatttggtaggagaggggcttcctttgtgtcaaaagacgtgtgaccgtgggggatttcccaacggcacacacgggtggttgtccacttcattcacctggcattgttagcggacactggcgtggtctcttggtgggaccacggagtttaaaagaacccacacttaatttttcgtgtacagggtggcctgaaagtttcagcggacctccatttgtgtaccctaacgtaatttcctgaaagaaccacgcaaaaaacttccaagg

SEQ ID NO: 654843 - DNA, 151 bp, Homo sapiens
gtgatctagaggacccacactgggtcgagttctagtcaggatctaaataaggatcacatattacaattattgacaaatcttttgtcttgtaataatttaatatattctattttttttttttaaagatggagtccaactctgtcgcccagga

SEQ ID NO: 654844 - DNA, 401 bp, Homo sapiens
acgaaatgcctttggtgagatcgacgtgctcccagcgtgcgttgagcagttcaccaatgcgacagcaggtggagagggcaatccaaattgcagcttcggtggacggaagtaggccggcttcaggagtgagctgggccagggcgcggatctcatcatcgctcagcacgcggtcgcgttcgacatccttgccaccaatcttggcctggcggatgctgggcagtcggatcgtgctcaatcagatctcgatccaactgcgaaccggaacatttgtcgcatcaggctaaagatcagtttggccatacggttgacgccacgagcgaggaagggcatcggtcacttcggtgacgtgccctttttttacgtcagccacggctattttgcctaacaatggcaaaacgtcc

SEQ ID NO: 654845 - DNA, 150 bp, Homo sapiens
gtcgactctagaaggtatccccgcaacacacaatgcagtctgcaaacacactatgcagctgcaaacacacagtgcagtctgcaaacacactattgcagctttcaaacacacagtgcagctgcaaacacacaatgcagcttcaaacacaca

SEQ ID NO: 654846 - DNA, 187 bp, Homo sapiens
tctttcacttagaaggatctttattatttattacattgaactcatccagataatctaggataattttcttatctcaaaatcttaaccttaatcacatctgcaaaggtcccttttgccatgtatggtaacatatgcacatattgcagggataaggacatgggcatatttgggggactagttttctgcc

SEQ ID NO: 654847 - DNA, 253 bp, Homo sapiens
ggacgctggtttccgttcgggcggggaaagatcataggcttatgggagcacctcacactttcctcaggagaagacacacaaccatgaccctcagcctggtggaccgccaactccaggtcctccagccccaagactgcctaggcagtcctgaaaaatgcaagtcttgtacggagtttgacagctaggaacccacgggaactgactgtggtccaggtagagaagctggagggttctggaccacaggaagcggtgg

SEQ ID NO: 654848 - DNA, 1329 bp, Homo sapiens
gtggtggacccaaagggaaggcgaggagtggtgggcatttgcgttggggagcgaaaaggaaaaaagcatgcctcctgccctaggtgcactctgtggacaatgcgtaggatggatgcttggaacgcctgagctggtggtggtgacggatgtgtgcagtgcttgcgggctgaggcacgcgctgctgccatcctgctctgcctctcgcagctgctggtgctttggcaggactgagtcgcctgggtgagctggcaggtctactgctggtggccaccgaatctgcttgtggtgcatcctaatacaactggtttgcccatacgccagcagtatatggacagtcaatcagatgcagatgtaggttgccccatgactgcacgggtgctgagtgatataggacggaaaacaccctgtgtcatgcgagagcgggcatcgtagaccatgtagaggcatgcgacgatcgcaggggcacatgacgtactcaagcactcggaccagcatgcatggactgcctgaccgcacagctcctagacgacctgactgaggccctgtcgcgtccagcacgccaccaaccacaccttccgggaccgacagaaacattccgagatcataggaatacacaacatgcacgctggattcagcacaggccacaacgtggacctgaagcaggactagagacgaatactgattgacattggccaggcctgcaattgaagctctgctaacttgaagacaaggaagctgcaattcatccaaatgagggacgaggaatcttcctcatcagtagcattattacacaatggtcgtaccgagcccgaacggtccatcttggcacagggtcgcatctcacgctcttgcaccaaaaggaccgcaaagagtgcatgaagaccaacgacacggagagaggaatccagacttcccgacgacgcaacactggccaccgagcctcgagagacatctagcagtaatgctcaggaccatctcgcaaccggtcctcacccccccaatgccctacacagatccacaacgcaaaggcatctatacaccacacactaaaccgcgcatacatacagtaacattcatgacagtatcactctctaaagtcccaaaccgaaatgccaccacacaaaccaaccaccacacatctctacctacccacgcggcatcaccacaacatcacccgctattcacctaaacttagccataacaccacccccaaacccccatgcaaataatagaactcagccacccaacaaacctaccgaacatccacataccccaccgacgaaccccctcaccccccccatttttcctcccatcccacaacgtagatca

SEQ ID NO: 654849 - DNA, 993 bp, Homo sapiens
  misc_feature (154)..(154): n is a, c, g, or t
gctcatcttcatgacctacaacgggtacctctgcattgcagtagcagcaggggccggtacaggatacttcctcttcagctggaagaaggcagtggtagtggatatcacagacgcatgccattgacatcaaactctatggcgtggccttatcgantgcagtgggaagttgttgaagacttgaagacgtgattcctgctccaatcatcccttcttgctcctctttgtgcacgtacacacacacacacacacacacacagcacacacccgctgtctcaagcagaggtatgagtatcagcatgctgctgctgaatctagatggtagtaaccctcccaaagttgttttctctaataaggctgagattcccatttctcttagggagaagaccacccgtgagtatgtcttttccttctccatcatcttgagagccagagttatagtgttgcgtgtctaactccagtggtacgcttgtgggcttcaagtggactggtgactcagtcgtggcttcccttttgaggaagtttattaaccgaggatgagtagatgtacatagttggggggggttattcttccctcgttggtgatcgagcgagtgggaagagggggttaacttatcaagccagggagtttgagtggcgagcgtgaggggaaaacttctgtgcccaatattaaaccacaagaacttcaaacttacacattgagaaaacatcaagggtcccaagggcgcgggaacacgaggtgggcccagtggccgtgttaacttccccagcatcttgtggggggggggccaaggggcgagggcttgggacttcactcgtggagaggcacaaggggatgctgcggaagaaaccaaggttcggggcccaaacgagtgggggaaaacacccgccggatatcttacataaaagtattaccacaaatattgtagagccggggacaatgaggatgggatgggacggccgtggaaaatcccccagtattacctcagaaaggag

SEQ ID NO: 654850 - DNA, 965 bp, Homo sapiens
acagagtcttgctctgtcccccaggctggagtgcagtggcttgatcttggctcactgcaacctctgcctcccaggctcaagcaattctcctgcctcagcctaccgagtagctgggattacagacatgcgccactacaccttgctaatttttgtatttttagtagagacgggattttgccttgttggccaggctggtctcgaactcctgacctcaagtgatcctcccaccttggtctccaaagtgctaggattacaggcatgagcccagccttgtttttacttcctattttattgaaaaaaaaaaaaaaaaaaaaaaagcaaaaaaaagggaatttcccaaaatttggccttggcacggctcccggttgattttgtgccagggaccttgggtttttcccccggtaaaggaggaggggtttcggggccctttaaaagggcaatccttttggcgtgactagacatacattggtgcagcacattaccccctttacttgagggatgggccccttgtggataggctgaataacgactggccctgaagggtgtccagaccctggggatttgtgacctacacgttgtggacacaggacttcgcccatggtatacagttcacggctgtgcacgaaccctctacggggatcaatctggggtgggcccagtttaatcccacgtggtccttgtaagaggaagggccggggtaaagggcacgccaatggcgatggcggcacccaggagttgaatgagggggcccaggtaccaggcagtgagcgcctaagtggcaaggggggacaaaccccttaaggcgaaaggaggtacccacgggcgcaggaccataacgggggtagcggttgggtggcaggcccggaccagggtgggcggctcacacaccgggagagtagcaacagaacgcagcgaatagagagaggggcacaagaacgcaaggagcatgagaagcgggcgcagca

SEQ ID NO: 654851 - DNA, 713 bp, Homo sapiens
  misc_feature (39)..(39): n is a, c, g, or t
  misc_feature (104)..(104): n is a, c, g, or t
agaactcccaaatatggagaacaaggtcatatggctttnttgggacatagtctgggagcttatatttcaactctggacaaagagaagctgagaaaacttacaantaggatactttcagataccaccttatggctatgcagaatttatcagatcatgaaaatgggtgtgcttattatccacgaagaggaaagagaaggacttgccaaagatatgtaggcttgccattcattctcgatatgaagcacttcgtagtggatggcttcaatgtgttatataacaagaagcctgtcatatatcttagatgctgctgctagacactggcctgggccaataccttatgtaatcagcatcggcttgcccttcccctgcttgtgccgtgtacccatgtaacacagtgataggatcccagcatcagatggatgttgccttcctggatgaaactgattaaagatgatcattagagcgaggaagactgcccctgttgcttgtcgcacatgcaggcaacgtggacaccacgtagggacaacacagacacagattgttgagatcgacaagaactctgtgaagcggaatggcatatcggcttcatgttgcagcggtgtgaattctggccaccattgggctccggggatatatgtctcctcaataagatgctaggctgaagacaaaatggatagcaagaagaataatcctggacgtggcagagtagcaga

SEQ ID NO: 654852 - DNA, 158 bp, Homo sapiens
  misc_feature (139)..(139): n is a, c, g, or t
gtctcagagtccatgagactcacaggcaaatttatctaaattaaatcgatttttcacattacaggcccaaagtttacgcgaggtcacagtgcttttaaaattaatgaggccgggagcagcgtgtcacgcctgtaatccncatgcacttttggaggcca

SEQ ID NO: 654853 - DNA, 227 bp, Homo sapiens
  misc_feature (98)..(98): n is a, c, g, or t
aaaaaaaccccccccccggtttttggggcccccctttttgtttccccctaagggggggggcccgaggggggaaaccaatttttttattgtgggggggnggggggggggggggttttttccccccccccccccccccccccccccggggggttctgggggcctgggggggggtccccccgttttttttttttttttaaccaaaagggagggccggggggtttttttta

SEQ ID NO: 654854 - DNA, 112 bp, Homo sapiens
ttagagcgccagactggcgtgtgtctgtatgctgtgtgtgtgtgcctgtgtgttgggtgtgtgtctgtatgtatctatgtgtgtgtctgctaggtgtgtgtgtgtgtgtgcc

SEQ ID NO: 654855 - DNA, 235 bp, Homo sapiens
cgcgcgtgaccacagaagcgatctcccacctcaggtttccgagtacgggaccacaggagcatatcaccacacccagttaatttatgtatttttagaagagatagggtttcgccaggttgcccaggctggtctcagactcctaggctcaagtgatctgcccacctcggacttccaaagtactgggattacaggcatgagccactgtgcccgggctagtcctgattatgttgactgc

SEQ ID NO: 654856 - DNA, 233 bp, Homo sapiens
ctctactcttgagatccccctctggccacctggtctcggtgggaactttgcgctcagtatgacggaaaaggagttggacttgtgccctggaccaacgggcttaataggacctagaggcccacctggtgcagctggagccccaggccctcaatgtttccaaggacctgctggtgagcctggtgaacctggtcaagctggtcctgcaggtgctcgtagtccaaaggcaggacaag

SEQ ID NO: 654857 - DNA, 259 bp, Homo sapiens
tgtgcggggtatcaaggatcctttgggtgctttcaagggatgcgatgggaacaagagtctgaatgagtctgtagtgtctgagggttgtgatatgcagtggcgaatgtggttaggtgaagcattataaggatcgggaaggttatgctcctgacacagaattccaccggtgcaaggagatgtctgaatactgaagcactctgtgccgccacctctaactgttcccagtgaaacctcccagatgatgtcacctccccataat

SEQ ID NO: 654858 - DNA, 190 bp, Homo sapiens
ccgagctgtatgactggacaggctatgagtgctttgcgtggaatgacactgagtgaccttagacaagtgcttcccctgtccaaattcctttccccatgtgtatcggtaaagtgaatgacacctcgtctcccaatgggtagacggcaggggaccctccaacatggaggtctccatgaaatgagcttgcttt

SEQ ID NO: 654859 - DNA, 359 bp, Homo sapiens
ggaagatcactaagaggtgatacacctccaactccttgctgccactctaggagtgagaggctggccaagtggagcattttggacattcagaggaggtggctgattctaccagcccaggatcaaggccagaaagcttgctcctgggattggagcaaggtcagtcaggaaatgagtgtcaggggatggggtgggagatgaatcaaagggaacactcagaggcagacatttcacagacgtttgagtgggtgtttatgtcaccacttggcaaatctcacggcagagtcaagacccagagattctgaggtggcaatctgtctcaactggaataagcaagaggactgcctttcatgagaaacaag

SEQ ID NO: 654860 - DNA, 616 bp, Homo sapiens
tttctctctttcctctcttctaactctctataatttttctaaacagagggtcaactgcaacacacgcgttcagggggaggggaaaaaaaatctcgccactcaaccaagtttttttaacactgcaaaggatattttagctcccccgttggcgagccactttcctttaaagggtgcctaaaggtccccatggcttcggcgagggtcttactcctttgaaaggaaagaagggccttcccaccctctgggtggggagcttccggggccaattttgaaactggaagggccctgctccaattcccaaacaaccgaatggtggtacggacgcccacacaagagtccctgcctccaaagttaaaactaaggggggaccttaaggggaaattatttttcttcaaaaaagcccagaactgcgttccccggggggccacagccccctggaggggacggggttaggaaccctcatttttaggggcccaggaccgctaataaacagcccccctaaatgcggccttgttatcgccgcccctggaaggtttaaaatcaacacctgcggccagcctctggaaattcttacagaaaccaccgtgggggttatggaacaccctgttctttttct

SEQ ID NO: 654861 - DNA, 125 bp, Homo sapiens
gcttaagccgcgacgccgaagacagggccttaagagcctcctagagccaaccctcacctgagacaggaagccgggcaccctgaatagccctttacccagagccctgagcccaaaagcctgtttta

SEQ ID NO: 654862 - DNA, 341 bp, Homo sapiens
ctggggtgggggtgggagcccagcccggtggtgagccagttgagaaaatttgaatgtggattagattttgaatgaaattggacaattattggtaattttatgagctgtgagaagggggctgcagttcataaaagcctgtcttaatttgcacacttaagcacttaggaatcaaagggttaaagggtcttaaaatgtttcaaatggtttacccaaatgtatgtgaggcgtatgtggcaaaatgttacagaacctaactggtggacatggctgttcattgtactgtttttttccatcttctaaatgtttaaaagtatataataaaaaaatttaattttttttta

SEQ ID NO: 654863 - DNA, 1401 bp, Homo sapiens
ggcgggatccctcggtccagtccagcacttgctcccagtttcagcgagcgtgctcctgctgcccgtgtgcccacaatgcgcacaaatccatgactcagctcgctgatcgagtctagtgggacgactttgtatccagagatcttgatcgacggaaatcatagcgtttctctagctcgagggagcaccgaagcgccatggcacgaagtgcctggtgggtcccacgtttcctagtacgctcggaggcagccgcgctctatgtatcacctccaagtgggttggatcctatttcgtggtggggagacgagtcgggcgtccccacgttacaagtgcatcgtgcgcctccaacagatggggagaccgggaacgggaagcggcaccacggaccaacgttccacattccagggtcgttgggactccttccgtttgattctcctcgtgagaggacgatttcgacaccctcattcgtgtcaccggtcagtcgcggtcccgtctagtgtgctccccttcgagcacctccttgtggggtatcgagacacaaatcgcgcgagctgagaccaggattgtctttggcggcggccaccgaatcagaacactctttttgcggctaaccccaagcgttgattcccaagctaggcctgtcgtgttgttgttggcacctcttcggcggcgggaatcttttgccaagagagcgggttcacattgtgagcggagtaggccccctaaggggaataaggacaaacgtcccagggaagggaaagggcaacgaacgggcgaccaaacattagtgacccaattcccgcccaacaggagagaggtaaggtgttcgccccccatattgcgtttagcccatccgccacaagctatcactttggaagttgcggcaccttctacttagtggaacccgctctgctattgtaagcggtaaccggtcaggcaggaacaaccgttcccgtttggaacagcaaaacaagtttttcccctttcttggcgccaaaactacccggtggcaataagcgttgagaatatggcggccctttgcagattattctttactaacgagagggacccacctggcaagttaggtcgggtctgccactgactcccgccatgtattcagttgtgctccaatgaagacgagcccagcttccaaacatgtccggaaaacgggcgggatttccctcagacacccgggatttacttttttgggccgctatatgagcgttccctaagaaggcgttccggaacacattttctgtcgcggaagacgggaaattctttcctataaaggaggggccaaaccgcccccaaacgttttttttccgggccgcccctataatttctgcgaggcgcgtgcccttctcccatattttcgggccaccaacacgggggaggatatttagg

SEQ ID NO: 654864 - DNA, 360 bp, Homo sapiens
cacgacacgggcgactccctggcccctcccctcttcacggggtctacatgccatcgtgttaggaggggagattcagtgttggtgggggactgagtgtggctggcactcccctatgcagtgagggtctctctcttcctcttgtgctcttgcctgtggctgctggtccatgggtcttactccttggcaggcccctgtgggccctgaggtccaccaccctgttgctgtatcctagttcgttgttcgtaccactgcaaatgagcttgcacaactgtggtcttcgagggcaatgccagcctctgcgtcccttgtggaggagtgggactcgcccttttcgtctggtaccgagctctccttcgtagt

SEQ ID NO: 654865 - DNA, 1311 bp, Homo sapiens
gagctcgagttcactgaaccaggatatgctggatcgagacagaatctaaaacacggtctcccgacatcttgagtgaaacctatcgtactactggcaatgacactgctatgagtatcttcctacatgaccgtctcaccctatattcagtgtaaacattcctgccatccaatgtcaatactggtatttgcactttgtctcaatgcaagagcatcatatttacaaaaactaggcatatcatacacactacccatacccgcagaagctctcacgagctctatggtcggtacaaccctggtaccaatcgtcgttatggcctaaaggcatgcattgtatgcctttaaaacacagagatgaggtctcacgtagcactatctttcttcactttcttataagcactgatggatggtggttatgcacgtcacatggtatccatccttggcattgtcgatctcaattagaaacgacaagtggttgacacatggtggtgcaaattctccgggcgatccataactcccaggacattataatgaaagggcaaggcattaactttgatgcagatcccgcaatagtgcgtctttacaacgtatcttccacgccaaggcgcccaggcattggcatttgccagtggcctctattgccacaggatatcgcgtgtgttccaggaattatggcagcataaccatgtaagggttctaggtcgtacagccacacccctattgtagactgaacaacaacaacatgtacatggaccccacagtatagacgagtggtatacacctatacaatctaccctatgcaatagttattatccaacacggaacctgggccccagttggacttccgtactattacatccttacctcatcagcggctaatatttcctatcagataactagctgcgatagttgctcggaacatgtatctcaagaacaggcacgacgcgcattactatatgacatcagcctcgtgtctttggacgcagacgttctgacatacgtctatccttcatcggcgtgaaggtacgcatcctgcataacaggtcccgtggtaccctgattgcgtgctatatgcgcaatccctttcggccacaccgtgtatgtcttccagcaacaatttctcccacattcagaggcgccactccaatacactactgtgacaaccacagcactcacgtctgaacactacagaccgccactcactcgatgcacccactactacatgcttactaccttccgtacccaattaccatcagagtgtctcgcatatccataatatgtcataatccttctttccaatcaatccattactgat

SEQ ID NO: 654866 - DNA, 417 bp, Homo sapiens
tttaaatttgggatttggggggagtattatgtttaactgggggtgtcaagtatgagtcccccaggaaaaaaaaaaaattctgttttaaaaagccatctgatttttagctcttgaaactattgctacttaaatttcccataattaaaaatttaaaatttttaaattagaattgcccaaacttctccctttgagaaggggttttttagaaaaacctttagtaaagtccccccagcccttagtcttccctttaaacttttttctttaaaacaggggtttggggggtaacttttacccagttttggggactgttaaaatttggaaaggatcttgagaaatcaggggaaagctaaccagtttaaattaacatgaaatacttccttttgattgagaaaataaaatcagattttttcaaagtca

SEQ ID NO: 654867 - DNA, 731 bp, Homo sapiens
  misc_feature (19)..(19): n is a, c, g, or t
  misc_feature (85)..(85): n is a, c, g, or t
  misc_feature (191)..(191): n is a, c, g, or t
  misc_feature (278)..(278): n is a, c, g, or t
  misc_feature (423)..(423): n is a, c, g, or t
  misc_feature (444)..(444): n is a, c, g, or t
  misc_feature (455)..(455): n is a, c, g, or t
  misc_feature (475)..(475): n is a, c, g, or t
  misc_feature (486)..(486): n is a, c, g, or t
  misc_feature (525)..(530): n is a, c, g, or t
  misc_feature (537)..(538): n is a, c, g, or t
  misc_feature (548)..(548): n is a, c, g, or t
  misc_feature (572)..(572): n is a, c, g, or t
  misc_feature (621)..(621): n is a, c, g, or t
  misc_feature (623)..(623): n is a, c, g, or t
  misc_feature (636)..(636): n is a, c, g, or t
  misc_feature (661)..(661): n is a, c, g, or t
  misc_feature (723)..(723): n is a, c, g, or t
tcctgcccgcccgccggtngcggctctcttgggccgcttccctccccttcctcttcctcctctccctcctctctgcctgcccggncgcccaccgttgttggtcggccacatgccatccccaaccatgaacaactctcaagccaaaacggtttggtccaaaagatctcaacatattttatccaatgactgtnaagagcttcactgagttggattttgatattgccgatgttgtgtttccccagggtggctcttccgtgcaccagcggggcctgcttgtnggagatgaggcctgagcgcctgcgggggacctctttggcctgcttgctagtcttggggtttaagtctctcagccgggccacccgttcccactcagtgcctggggacgactcgtccatgtcatttacaaagagcttcttctgctgncctgttgtttgcttttgtttnctgtagctgcncgtcctgtcttgcataccantcttctagctnctttattgccttttctttccactctgcttcttgcttccnnnnnntggcatnnagggcttccnagcgttccatttgttcttctctcnatttacggatactttcaggctctgactgcaatcgatccacttgtgaaananctgcataactgtntgttggaccattactttcctggtantattcaccattcattactccatcaacagcatccggaccccccggcggctcgcgtgcggctgnagaacggg

SEQ ID NO: 654868 - DNA, 331 bp, Homo sapiens
ttttgagatggagtttcactgttgttgcccatgctggagtgcagtggcgcaatctcggctcacagcaacctctgccttatgcgttcaagcgattctcctgcctcagtctcccaagtagctgggattacaggcatgcacccccactcccagctaattttatatttttagtagagacggggtttttctatgttcatcaggctggtcttgaactcccaacctcaggtgatccgcctccctcggcctcccaaaatgctgggattacaggcgtgcgactgtgcccagccaactttccttttctttgaacatcactcgtaattatcacaggtcgacg

SEQ ID NO: 654869 - DNA, 715 bp, Homo sapiens
  misc_feature (173)..(173): n is a, c, g, or t
  misc_feature (248)..(248): n is a, c, g, or t
  misc_feature (319)..(319): n is a, c, g, or t
  misc_feature (337)..(337): n is a, c, g, or t
  misc_feature (343)..(343): n is a, c, g, or t
  misc_feature (392)..(392): n is a, c, g, or t
gggtagactttccttcggtggcttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgtnctcttctacagagaacctggcggctgggtcttggaaggagcctgctgaaggaggtgggctgtcttctgacaggcngctctccgaatcttccaccaaggactccttgaagtctatgaccctgccgtcctaccgacctgccccactgntcagtggggacctcaggnaaaacntggtccccgcaaactcagaggccacaaaagaagctaaggagagcaagangccagagagcaggaggtcctctttgctgtctctgatgacggggaagaaggatgtggctcagggcagtgaaggtgaaaaccctctcacggtcccaggaagggagaaggaaggcatgctgatgggggttacgccgggggaggacgcatcggggcctgctgaagaccttgtgagacgatctgagaaagatactgcagcttttgtctccagacaggcaggtccttgaactctttgaagatgtgcgatacgaaccagaactggaccgatccagtctgaacgagactcaattcctctccgaggctccccaaacaaattgtagcccgatt

SEQ ID NO: 654870 - DNA, 486 bp, Homo sapiens
  misc_feature (99)..(100): n is a, c, g, or t
  misc_feature (103)..(103): n is a, c, g, or t
  misc_feature (106)..(107): n is a, c, g, or t
  misc_feature (461)..(461): n is a, c, g, or t
gccccagacactacagctggatttcttgataaaatcttgccaaattaccaccacctaaaaagactataaaggagctcactcagtaaagactaaaaggannaanaanncccacgggttttggggttttaataacccatgaagataacattttgtctttgaccactgtcttttgaatgggcccacagtgtttatgtactcttaacaactcacagaataatacatgttcactttattttgtaaaattgggttgagaggaaactaatggagtttcattgtaactgtcctttgtaatttatataaatgtattattttcctatatccttggttcttttctgataatttacagatttagcttttcttttgttatataaactgctagccacaaattttagttatgtaaaaggctacccttgacaagaaaagacatactgtcatgtatttatattctagcatagactaanctgaataaaaatactgataacagga

SEQ ID NO: 654871 - DNA, 184 bp, Homo sapiens
gaaaagtctgtaatatataaaacctttgaatcagtcgttcttaaaattatttaatcccacaacttcccctgcaataaaaacacacaggcttacactttttttttctcagtttctacttagtaacaacacttgggaatatggtttcctgaaatatagtattaaaatacaattgtattttatgtcc

SEQ ID NO: 654872 - DNA, 163 bp, Homo sapiens
gatctgagcaagcgatgaggctgaggttgttccccgagcacagttccctttgcagaatgcagctcctggaagcacgttttgtgccttttcggagctaggccctaggtgctccctcccgagctggctataggtggttagtagggccatggcccgcttttgtgtt

SEQ ID NO: 654873 - DNA, 353 bp, Homo sapiens
tccattgatatagcaggaccactgagcgtcctgctgcggcttctccatctcgatgattgccttccagacgcttggcatagtacactactcgagaggagccaggtctgtgcaaatctgggtggctgctctcgttccttgtgaaattgctggttttacatcacctcgtcttttggaagcctctcgtgatcatctaactggtccatgggctccacagtcacaggacgaggaaatgtggttagcaggaaggagccttcactgcatctgtccagagctttccgagcagctggcttccctgagaactcaacaatgccttttcctgagggccttcctcgatcatccacaatgactacagc

SEQ ID NO: 654874 - DNA, 439 bp, Homo sapiens
  misc_feature (16)..(16): n is a, c, g, or t
  misc_feature (437)..(437): n is a, c, g, or t
  misc_feature (439)..(439): n is a, c, g, or t
cacttgaactcggggntttttggggttgcagtgaactgtggatcacatcactgcactcccaccccgggcaacagaagtgtgattcccatcctcaaaaaaaacaaaaatgcctcagtatcgattttatattacaaattattaaaattttggcccaagtgcagtggcacatgtgaggcctgtaattccagcactttgggaggccaaggcaggaggagtgctggaggccagaatttcaaggccagcctgggcaacatagggagaccccttctgtatgaaaaatttaaagattagccaggtataatggtgtacacctatagtcctagctactcaggaggctgaggtgagaggattgctcacttcaggagttggaggctgcagtgagccatgattgcaccactgcactccatcctctgggtgacagagcaagatctgtatcnan

SEQ ID NO: 654875 - DNA, 262 bp, Homo sapiens
ttacagctcgggaatctctgaccacaccccaaccacatggctcttcacccagccatgacagcctgaactcggttgatgccaccatagatggggcaccatggccagcataccagcatgaggtttcagatcttcttcatcctcttcatcttcctcctcttcttcttcatcactgccctctgagggtgtgggcttagtcccatgcagatggtgcatccaaagcatcatcagtctgttgctctgggcgctctcagagggcagtgat

SEQ ID NO: 654876 - DNA, 829 bp, Homo sapiens
gatcgttgttcccgactgagtaccagctccccactgccctgagggcgtggcctggcctgcggcggagtggaaaactggaagaggagaagtgaaattgtcccgaatccctgcagtgaggtccaatgcctcatccctgtggtggccatgtcttatctatgtaggttgcgagcacaacagccatgagcaaatagaagaggaatgtgaactttaatcactaattctggtgagaggtctgatattagagtgagtctgcatgtagcacgggtgtgcatcctgcgtatgaaacgctgaaggagagtgacaagtttaccattccgaatcacgcatatgaagactattggaaaaagactttgctatgagagacggatagtgcacaaaccacctacagtgtgtaaaacgaaacggacatgcgagtggcgatatcataagcatttgttcattatgaagtgatgggtcaaaaacaacgcgccagggaaattaccatcggcgtatacatttaggctagtggcccatatatgactgtggtatgggcgttagcacacagaaactagaactacgacctctcatatacccacaatcaatggggccataatggaaagctacatcctgaaagtttcacactcaaaataaatggtacaccgtatacgcgcattctcacccagcaaagtgcgcacgatgatagggatgtgaaccttaaacgttcagtaaaatatatcaaccgtaatggagatctacgccgacgttgcgctatactattggatccgacgaagggcaccagaacgattatggacaattgtgggagtattaaacaaggaccccaaatgtggag

SEQ ID NO: 654877 - DNA, 160 bp, Homo sapiens
tgaaacctggggaagtgactgcagaggtagatttgaggaagagaacgagaaagggagaaggaagggagaggcaggagaaagcattgtgggcactaaccaagcggaaagtgggcccacgagaggtgtgctgaggaggggccagagtgtgcaaccaagtctt

SEQ ID NO: 654878 - DNA, 431 bp, Homo sapiens
tctaagggtgctgcatcaacaattttggccagttaaccatttgcacagaagtatggcctgcaatccaagcgtgtggaaattttggcacatgaaatgatgactgatttgccaagctcgtttgaagaaaaaaccattttttggttggctttcatatgactaaacaacctgcaacccaccattgcttttctaccaaccaactccttacttatgaaccactgccactttgtccagaaggacaaggtgcaaccctggttgctacaggacataatccatctcgaggaaacgtggccataaatcctcgtggtggactgattctaaacggacacccactaggcgctacaggttttgctcaatgtgcacaactctgttgccatctgaaaggggaaccctccaggcaagttcctggtgccaaggtggcttcgcagcttttc

SEQ ID NO: 654879 - DNA, 355 bp, Homo sapiens
tcaggtgattggtcctcctctgatagcatcattagttctgtggttagcaagagtcaggctcccctttcaccctccccaatcttctctgcagtggtgagcccatctcattcattcattcattcattcatttcctaacttgcaatgaggctgcacgcgaggcccacaagacacaagtgcagtccagtgccctgcagcatcaggagcggacatgtggacgacacgagcagagctacactgctaagggcttgatcaggcatcaaccagccaattcaccgtgaagtgtttcacgcggtacccgaagtcgaaatttcgtaaatccatgggtcataagctggtttccctgttgtgaaaatcg

SEQ ID NO: 654880 - DNA, 470 bp, Homo sapiens
gagtcgagggtgaaaaccgcctccaggtggaggctgtaaaatgtgacatggcgagtcagtgtaccgttagcctaacaaggatttgctttcctatttctgactggtgcctttcccctttttaggagcaacgaaagctactctcttagttatgttctggtgatgtgacaaaatgtcaagaagataggagaagagaatattttatttcgtggatgctttagttcccaagtgtgaccctaaacttaagctctgtaggagtggacattctttcatgtcccttccctttactcatgccgaaactatcaactgggacattttgtgctttcggtttaaaagttaattgatattatacttgggttttatctaaaaagtaaatgtatttgcctttgacaaaagactggcacaagagcaaataagctttaaaatcgggttttaagtctaaggcagtctggagagtctgaaggcagtctgga

SEQ ID NO: 654881 - DNA, 571 bp, Homo sapiens
acggctatatctgtaagcactgaagtactaaaagcactgatgattcgtattataatttttcagatattagaacctacacagatgacatagatcattcctttgataaaataatcaaaagtaatttgcttatctggcaaaaaaaaattcttgaaacagagccctttccaggtatcttcaatctcggtaaaagcccaaaccccaaacagagtagatgatgaaatatggatttctcagttgcccaagactgtctgaaatttaaggttgagacatggactggccttttcatgtaacctgtgaattcagagcttacaggtggcatcagaactcaaatctctgggatggctttacatggctttcactttgattagtttcattttcatttgcttcttttccaacttctttggctcacgcctcaatgcagcctcctccagccgtgcgctgtaactcaggatcttcctcattcatgattcgctccttctctgctcttaatttctcctcccgacgagactgtgctgattcctgtctaagcacatgtgtcaagtacaagaagttctcttctactcgggcacgg

SEQ ID NO: 654882 - DNA, 1079 bp, Homo sapiens
  misc_feature (258)..(258): n is a, c, g, or t
cgcaggagacaccaatgggagatctacacgacgacttcacgtgcgccgagccgacatcgaagaacgtgcagttcgtgtttgacgccgtcaccgactgtcatcatcaagaacagacctgtaaggacttgcgggtcctcttctgagtgggcatggcgtgaggacctgagcgggtatagtggtcgcaaccgttcgagcatatttgtatcactccgccaacactccttgatgggaacgatgggcgagcaagaacgatcacgnctcacctcggctggttccgcccgtccgtcttcttctccttctgtcctctctttgttctctagctcccccgtgtcccctcagctccagaacgtaaggggaaggggttgacacgaggcctcacctgtttgaaggcctgcccttgtcatgagatgctggtaattgtgccatgtgtactcccccttctgggcatctgtatctggtttttaacccaattgtcttgttctgtgatgacggggaggggggcacatgctgagtctcaccaaggatgcggtctggagggggcccctgcttctccagcctggaccccagcttatgcccaaaaccagacccatgacccagaccaaagtccacatgttacacggacgcctcctgcccaagtcccccaaccccatacggcatcggaggaacccgaagggaaccaacagcaccaagaagcgtgagacgccacctgccctggaacacccaaagacaaactgggtccatcccggtaattttacaacaaatgaaggtcaacggaggacaacaatggattctacacgttccagagcaccctctacgggcaaccgacacacgccccagacaaaagaacggcgcccacgggcggaagcaaggcacaagaaattgacagtagacgactacctccgaaatgcgaagcgagcggccgacccggaacataaacacacaggaccagacgatcgattagctcacacagcgcgcaaaaaacagagagacaaagaacaaccagtcacacgagctgagatcgcccgagaatagcagcaaggaagaaagcgaagaaccacagcgcagaaaacaaaaacaaa

SEQ ID NO: 654883 - DNA, 192 bp, Homo sapiens
taggcggacctactctcaggccggacttgggcctggcgatggcgcaggacaggccgagccagaagatgacgctgagactataggttggaaggcgggttgcatgccgggtgccagaagatgatgtggtgactccaggaaccagcgaagacagctataagtctggcttgacaactctggtggcaacaagtgtca

SEQ ID NO: 654884 - DNA, 1123 bp, Homo sapiens
  misc_feature (61)..(61): n is a, c, g, or t
  misc_feature (64)..(64): n is a, c, g, or t
  misc_feature (69)..(69): n is a, c, g, or t
  misc_feature (79)..(79): n is a, c, g, or t
  misc_feature (82)..(82): n is a, c, g, or t
  misc_feature (86)..(88): n is a, c, g, or t
  misc_feature (91)..(91): n is a, c, g, or t
  misc_feature (95)..(96): n is a, c, g, or t
  misc_feature (114)..(114): n is a, c, g, or t
  misc_feature (120)..(120): n is a, c, g, or t
  misc_feature (125)..(125): n is a, c, g, or t
  misc_feature (146)..(146): n is a, c, g, or t
  misc_feature (149)..(149): n is a, c, g, or t
  misc_feature (182)..(182): n is a, c, g, or t
cttttataataaaaaaaagaagctgagtaaaaaaaaaaaacacacaaaccggttagtttcnaanatganatgctggctnaanggtnnngangtannggctggtaagtttctctnagtttngattngaggcatcccgtaaagttgtngtngcagaatcccaaactaggctacatttcaaaatncagggctgtttaagatttaaaatcacaaacattaacgggcagtaggcaccaccatggtaaaagtgagctcagacgtctctaaaaaatgtttcctttataaaagcacatggcggttgaatcttaaggttaaattttaatatgaaagatcctcatgaattaaatagttgatgcaatttttaacggttaatggatataaaaaaaaaaaacaacaaaattaggctggtaaaattgactttttcattaacgggggtttggaaatctagccccagaaaatacggggtggagcagatacttagaagggagggagtaggtttggaagaggttgatggtaggtggggagggaaggcctcctgaatggagttggatgcagagcttttaagccatgaagaatcttccagtcatagtactaatacttacactttccagatttaaaaaggacaacagtattctggccattggaagaattcgtgcacttccatgaaaagttccacttggggacgctgggggccaaaaagcgggttgattttcctaaaagcttgacggtggtcacatatttttcgaacggggtcccaaattaggtccaagaatgtttcaaccttacatgataataaaagggggcactggcgcgttgaattcgaaacagaggggtcaaaaacacacactgggcgacataacgacaggaccaaaacagagaaataggcccggcgcccccccatagtgtccgcgcaaaaaaacgcgaaagtggtaaatcgccgacaaagaaggcaaacaatcatcataaaactggtcccgcaggaagaacagagacagccactaatgtaaacgaaaaaagacaacaaaaaaaagggggggcaaaacacaggcggagaacacaccaacagaactgaaccagcatagaagaccgcacgcccgaccaagcatagcaacacactacgacgaga

SEQ ID NO: 654885 - DNA, 139 bp, Homo sapiens
tttaatattttatgtttagcaaattatagctaggtctgtgtataaccagaagagcggtatctggggggtcaggatatctaaattctagacttacagccgtggcctgaatctaactatcaatgttgcctttcggagaaga

SEQ ID NO: 654886 - DNA, 826 bp, Homo sapiens
agcggacggtgtgtacgtctacatggttgtgtacaggtaatgtcctaggccttcagattcattcaccgctcattcacccatagtcgagtgttccacggcttgcaagttctattcattggtccgacaataggaactcatgttgtgaacagacgttgattcagtggaatcagtacttccttatgaatacacagcgtctgatttatgcgcggcatcggaaggaaagcgcccatctgagaatcttggtccggtactattcggggaaacgaattgaaccgttcatccactataacgtcttacggtataagtaagaacggaagaccctgtaagcttggatacgtacaagatatcagtaccagtacagacgaaacgctgaggacaaccgatatgtgagactgcttgataaccaagcatgttcattcgaattatcaagcattcagctggaattgtaggagtaactatgcctgtagatcgtggtcgttactgattgtcgaacgatggtcacgaaggttcgtagtaatcctggactttcgctattggctggttacattgacatgataactcggccatggcaacaacgatgcctgtgtgtattagtgtcagatttgccatgaaagagatacatttttacgatcttgcaatcatgatgaagatcaaaatatacataatcatgtcgtagaaactggggtccactgggagcaaagattagatggtgtggttaaatttgcaacggaaatagcttcaaagatagcccaatattaggataaagcagaggtgctcagaggccccatgtaggataaggtaagcaaggttctggggaggattgaaa

SEQ ID NO: 654887 - DNA, 1197 bp, Homo sapiens
  misc_feature (239)..(239): n is a, c, g, or t
  misc_feature (254)..(254): n is a, c, g, or t
  misc_feature (1197)..(1197): n is a, c, g, or t
gctttttgcgcaagtgggctctgtggtgtttggccagtcatgcagcagttcgtcacattggcccgcactagttgcagtgcagggggcagccagggtgcatcccaacggcttgcgctgcctttgctgcagccagcctggcagggctggccaactgatcgctgtgccttgtgcattggcggtcaggcagcaggtgctggtaccccaagattgcaagtattggggattgcacactaacctgntatagcaactacttntgcgcagatatatacatcgagtagttacttattggcatttggcacacattgcaccctcagacttcgatggacacggtgggcaacctcggcatagactggaccccacaagcccctgctgactcaaaacaactgagttgtaagacgttcatctgccgtgttatccttgagtaaagaagcgggcttttgccatgtttgtccaggctggtctctactcctgggctcaagcagtcctcctgcctcagtctcccaaagtgctggaattacagggaatgaactctggaagcccagccagggacaatgcaccttcaccagagattctgcactaatctgagtgcaggtctaaggtatggaatctccccctcatgggagagaagctaagaatggatgtcatgcttagacagtgattcctgcaaattgacctttcaggctgggacgactgttggacgaagcattgcctggttcttcctatccatggtattgggaatctgctgacacaaatatctttcggcctgggtgctgggcatattcctaaagaacttcaccatttccctgatttatccatgtgtgcagcagatgtcaccttatgggggcaaaaatgcctgcacaactacgaggggacactccaagaagcataggccaaagtgcccactaagggcgaagtacaaagcgaattgggggcaacacagaaaagagcacaaaagacggttagccaaaaccagcgacaaagaaacaaaactgatgtgagcgcgcggcccaaaaaggacagaaacaacaagggtggggcgcagcagaagagacagcaacaaaaccaaggcacgccgcgatggtgtgtgcacacacagcgggcgaggggagaccaccagtgcgaaggtacgcgcgacaagactcgggagccgaaacaagagcagcaaccgcagagacagaggagcaccccaacccgcan

SEQ ID NO: 654888 - DNA, 221 bp, Homo sapiens
  misc_feature (2)..(2): n is a, c, g, or t
antcaagtgtcattatgcacctccgtgagttatcatcagcacctgctgcctgccagctactgtgacctgctgcacaatggcctgccgcccatctgggctgttggcagaatgtgtgacccagctgctgtgctccaacgtgctgcagcacccactggaatctcctcatggccaggatcacctcggaagcacatctgagctcttggtgtccattgatcaaggct

SEQ ID NO: 654889 - DNA, 156 bp, Homo sapiens
gtgatctagaggaccccagcgaaatttgcaaatcgccctggaggcaaaatcaccctggccaagaaccaccgtttaggtcactttgtattctgttttagttaaaggacttaggaaattaaaaaagatggacattagtgtattctggtattggatagt

SEQ ID NO: 654890 - DNA, 223 bp, Homo sapiens
gaggggagcatgtacgcccctccagaccttcgagtcgttcttgctcttcgatgggcgagaagaagatcaccattaacaaggacagcaaggtacccaatgcctgtgtatgcaccatcatcaaagaagatcacacatgtgggaatagatcattaaatcacaactcctaaaggacccgcaagtgctatttgctggctacaaagtcccccaccccgtcgggtggagg

SEQ ID NO: 654891 - DNA, 127 bp, Homo sapiens
ttactggtgcgtgggcgacggttctgcgccagattcctccggacagatggtgaaacctctgattgttgccacatgaatgcagcgtaaaacgtgctggtgtggcatgatgaaaccaacattatgtgcc

SEQ ID NO: 654892 - DNA, 1095 bp, Homo sapiens
  misc_feature (890)..(890): n is a, c, g, or t
tattgtgcgttcataaggaccctttgtgtatagacgcccctctgtcctatggggggatatattgactcccgatgtgtgccgcccctctctgtatggcgccttttttcgcgcctttcgggggaaccgccgcgcttttgtcccgtgcccaccccctttttaatttttccccccacatccccaagggctcattcttcaaagggttagcaatgacccatgtacccgaatagggggcccaattacgtggaccgcctgccctttagaccgcttgtccctcctaggaaaaaatgggttttggcaccagttgtacccctgcatttccctcacccccctcggcaagccaccaatgccttggtctcgcgttttttaaatcgtccccaagcctgtttgtcgctcagagacagagaatgactaagtaccggggaccagactcccgttgggcagactcctgtccccttggtttccgtgtttgtctctctgccatcttaggttgccactgagccactggtgtcaaaaatgcttagccccctctgtaactgcctcccctcttagttcacatggacacgacctcccccaggcccaaaactacccttctgaacttgggttgaggctgggttcccctgctaattgttcccctcatcacataaagaggctatggccacaagcctaatgggagccctgagagtcacatgcacaggaatgggaatctgtggtcacaaaggaccacaggcgaaggagagctgtgggcccacagggcctgccgccaccgtgccatacactcttctctcttccccactcttgcacttggaggttcccacgaaaaccacattagctttctggccaaagggggtaacccaccttctttgccctcgttgagactttgcctgtttccncacggctcctcttttgtggtttttataagctgtcacccacgttagccacctgtttaaattgtaaatattgtttctgagggcgcctggcctgtcccttcacgtgaggccacatgcccaccccttgtgttgtaagtgaaaaagctgttgtcacgactaaccttctgtctctgaaattgtttgtttcaaataaagagttaaaattgta

SEQ ID NO: 654893 - DNA, 367 bp, Homo sapiens
aaaaaaaaaaaaacccccgggggcccccccgaacccggtaaatttttcccacccgggaatttggttggggggggggtgaaaccccaccccaaaggggttgggccccctttgggcaggggggccaaaattgaaaatggggaaaaaggcttttcaaaccgcccttttataagaaaaccaccaaaaccccgtggggtttcccctttttctgggttttccgggcccccccttttttaaaaaacctgggagggatttaaggggttttcccttttttttaaaaaggcggccaaagtttaattttggaacacaccccccccccccccctttttttccattggtttttttttctttaaacccccccgggggttga

SEQ ID NO: 654894 - DNA, 797 bp, Homo sapiens
agctcccaggaggtctaccccagaaggacccacgttccttagcagtactcccgtttctgctgtcacggtggggacgtgcatcgagccgatagctggaatgccattagtgaactacagttcgtgtgttgaccactagtatgatagccacgtcgccctgaggtcttgagagagtaccctctggagatcagagagccaagctaaggtggtagtgaaaatcgaggaagcgcctctcagtcccctcagagaatgatcagacctgaagtatcattgtgctctagtgagaggaagaacctgtcagagagatgacctcgttccggagctggagtatcatcagagatcgagcttggcatccagccactgactcaaaagaccaatcgttcgcttgcctatctgagattgctctacgaggtgagctgtggattacgggggttctccctttccccattcagtgacatgtcctcttcttgcattggtgtaagaccagttgcttgggaggacacatttagcccgaatgaacgtccatttccccagactgattagtgtcgtagaggaatgatcgcggatacctgttgcccttgtccccttgactattagcactgtcgggaggatacgcagagaaggcctgtctgtactgctgttcaaaaatagtcaaatagaggagtgtaccagtcctagaggaatgcctctatatgtgcagatctcatagatgaccccgggtatagtcgtcgagatccaagaagtccaagctattgagaacatatacctggacgtaaggaaaattactttaattggggaaa

SEQ ID NO: 654895 - DNA, 728 bp, Homo sapiens
cgaactaccgctttccccgtaaccagggagactgcagtttgcagtgatgtggctaagatacccttgtgctattaaaggcacatttacgtatctttcaacgcagtttgtacctttgtttagggttctattgaactttctctgtgctctttagaaaaccgtcgaataaaggtaaccatctttttgggtgcctgggcatggtcattgtcccagagttttaacataagtctctactaaagtatcctgatttgcaagggaggtcatggaccaagtacaaagcggcaaaaggatggaattaaggtacctgacattgttgaacccatgcctgatgccacattagctcaggactacctacatggacatggatatttccagtgaaagaaagaagaaagcatgcttttctcttgactgtgcagaaaaaaaaactatgtttctttgattctccattttactagatgccatacctttgcaattacttcatgtggagtcttgaccaagattcaggaaatactagaactttcagtcccagaaggttactctgggcattactagtccccatcattatgagttgagttttactagttaatttcagacgaaaaatatttgtttttccccaaattctggggttacgtacttttactacctatgaactgacaactgtatcttcagtaattacaatttccaacaaattgttataggaataaagaaaagatgttagttcattaaaaaaa

SEQ ID NO: 654896 - DNA, 508 bp, Homo sapiens
tctggaattggttgcatatgaaagaggaagaatatgaaggatcacggagggagtttttacgtgccagacctagatataatgtgtatcattcctacctgcatttcatcacctggaaaccaatttcatggcagcatgcaattggatatttccagtgaaagaaagaagaaagcatgcttttctcttgactgtgcagaaaaaaaaactatgtttctttgattctccattttactagatgccatacctttgcaattacttcatgtggagtcttgaccaagattcaggaaatactagaactttcagtcccagaaggttactctgggcattactagtccccatcattatgagttgagttttactagttaatttcagacgaaaaatatttgtttttccccaaattctggggttacgtacttttactacctatgaactgacaactgtatcttcagtaattacaatttccaacaaattgttataggaataaagaaaagatgttagttcattaaaaaaa

SEQ ID NO: 654897 - DNA, 118 bp, Homo sapiens
tagtaaataggcaggtaccccaccgccccgttgaacaggtaggaatgtccagaccatgcatgggaactctcatcagtcctgcccccagcccccataaaaattccaatccataaaaaat

SEQ ID NO: 654898 - DNA, 671 bp, Homo sapiens
cgaactaccgctttccccgtaaccagggagactgcagtttgcagtgatgtggctaagatacccttgtgctattaaaggcacatttacgtatctttcaacgcagtttgtacctttgtttagggttctattgaactttctctgtgctctttagaaaaccgtcgaataaagaactcaaatgatgctgtttttggacagggaggtcatggaccaagtacaaagcggcaaaaggatggaattaaggtacctgacattgttgaacccatgcctgatgccacattagctcaggactacctacatggacatggatatttccagtgaaagaaagaagaaagcatgcttttctcttgactgtgcagaaaaaaaaactatgtttctttgattctccattttactagatgccatacctttgcaattacttcatgtggagtcttgaccaagattcaggaaatactagaactttcagtcccagaaggttactctgggcattactagtccccatcattatgagttgagttttactagttaatttcagacgaaaaatatttgtttttccccaaattctggggttacgtacttttactacctatgaactgacaactgtatcttcagtaattacaatttccaacaaattgttataggaataaagaaaagatgttagttcattaaaaaaa

SEQ ID NO: 654899 - DNA, 218 bp, Homo sapiens
ctacacagacagcaaacggcagagctgactctcgaattcagactctgggacgctgagttcagtgctgatcctgagtggccctgcgttgctctcagagagaggtaggacgacctcagagatcattttctccaacccacacattctactgattataaaatacagggccgcattatctgattggcccaagctaaatggctagatgactctcctgttcagga

SEQ ID NO: 654900 - DNA, 344 bp, Homo sapiens
  misc_feature (332)..(332): n is a, c, g, or t
gctgaggaccagccatgtctctgctgccccttcagtgatgccaccttgtgagagccctcatcctgacctgcatctggcctggggtggcaggagcctccagccaccagccccagaccaagccaagccctggccctactgggacagagccccagggaagtggaacaggagctgaactagaactatgaggggtggggggaggcttggattatggctattttactggggcaagggagggagatgacagcctgggcacagtgcctgtttcaaatagccctctgctcccaagatcccagccaggaagctgggccctactgtttgcccctctggctggngtggggggaggg

SEQ ID NO: 654901 - DNA, 183 bp, Homo sapiens
  misc_feature (72)..(72): n is a, c, g, or t
  misc_feature (89)..(89): n is a, c, g, or t
ggagcctggaccacaagagcgcccacgaggcacctataaggtagatctcgacgaggagcctaaagcctcctnaggaggctcagaggaanaacgaggacatttcaatcatcccgcctctggttacaggcagcggggccatcgggcacttggaacgggcctgggtgccactgaggggctgctgcg

SEQ ID NO: 654902 - DNA, 184 bp, Homo sapiens
  misc_feature (165)..(165): n is a, c, g, or t
ccatgagtgaggcaggatcaaccacatcctcatgatatagtcagatcttttgtggcacacatgaatccaatagtagacactctgatggtgtgaagtgatactcattgtggttttgatttgatatctctcatgattagtggtatgagcttccttttttatgcttgngtacttagggtttcgggta

SEQ ID NO: 654903 - DNA, 1187 bp, Homo sapiens
tcacaggtttccacccgttttttggggaggtttggtttccgggaaaaaccccaaaagggggggaaggggagccctctttccctcttggaaaatagggtgttcccccccactcaaaagtgagaaaggcgttggggccgggcgcccctgcggggtgtggggtgcccggtttcccccctctctctctttctggcgtgggtccccttttctctttttctcctcacagcagaagttccccaacaagacaccaacaaagaacacaaaacaaacaaacaagagcaaatatcaaccgctcccacaaggggggcccctggcccacaagctcctatccccacattccccccagaggctggggcacagagggctcgcggaagagggggcgggggggggccactctccactccgcaaaaagcctcctcacagaggccccacgcgggggaagaggtccggacaaggcccacaaaaaaggggggggcggtgcccaacaattttccatataaaaattcacacatacaacaatacgagggcggggggggagagaaaacgggccacactccgggcgagcgagacaagaggcgccccctttctcttctcacaaaacagacgaggaaaaaaatggagggcgagggggagaaagtgtgggggggcgcaaattcccccaaagaggcgcccaccacaacgcgaggggcggagtaaaacaaaccgcggcgggagagcgaccaaaaaacaccccccactctcagcccccacgaggtctatcatgccccaaaccagaggatgacaacacaacatccggcgcggtatggggagccacacaaagtcccccccacagaggagagaaagaaaacccccttctaaacccacggcaaacacagcgacggcccccaagacacggacggcgagtcaatcaaccccccccaccttcccacaaaagcactgccagccaggggaccaaagagaaatagggaccagacggaacacccaaacgaggggagaacacagcacacacgtgtgcggcaaaccccagataatctctgtgccccccccagcgaaaactaacgacggcagggcgaacaacacacgataacaacttcgcacctggcacacaccgttcccagagccccctcctggtacaagcgagaaaaaccaccgcacccaataagcggcaaaattgaaagccgacgtactac

SEQ ID NO: 654904 - DNA, 462 bp, Homo sapiens
tgtgtcgcttactcctgtaatcccagcactttgggaggccagtgaggtgggagaattgcttgaacccaggaggcagaggttgcagtgagctgagattgcaccactgcactccagcctgggtaacagagtgagactcttgtcctcaaaaaaaaaaaaaaaaaaattctaaaataaaggttgggtcaacagtgcttaataataaataaaaaccctctgtgccatctaattttccctgctgcaccccattcccccacacacccctcacgaacattggatataagcagtattaacacagttataaagaatgtccacctgtgcatgtgtcattccaggcacatggattcaggagaagcacagtgtgagtggaaaaaatgttagacttgtgaggcttgcccaaggccttgtgtacacgcaaaaagtgggtgacccaggggtctcctcccgacagcgcctcccccccgg

SEQ ID NO: 654905 - DNA, 129 bp, Homo sapiens
gagtggaatgcttgacagcctggcggctggcacttgctggccgcgatctactccaccttcatgatctgaatggagtgggctcgggcgcggtgccgggcacacctgtctcggtagcacatgggtaacagc

SEQ ID NO: 654906 - DNA, 343 bp, Homo sapiens
acacacgagttgtctcattcctagtaaacagaaagtagaatagtagttgctacagactaggggaaaggggaaatatggcattgttgtgtgatagtacacgatatcagttttgtccccagaaaaagagttctgtggatcgacagtggtgatggttacacaacaatgtgaatgtacttaatgcccctgaatcatgcacttgaaaaatggctaagacagtaaattttatattctgtatatttgaacaccataagaaaaataaaaaagaaagtagatcaattatattctgggctttattattattattattattattattattttgagacagggtctcacattgtta

SEQ ID NO: 654907 - DNA, 1129 bp, Homo sapiens
  misc_feature (124)..(124): n is a, c, g, or t
  misc_feature (127)..(128): n is a, c, g, or t
  misc_feature (149)..(149): n is a, c, g, or t
  misc_feature (244)..(245): n is a, c, g, or t
  misc_feature (322)..(322): n is a, c, g, or t
  misc_feature (337)..(337): n is a, c, g, or t
  misc_feature (374)..(374): n is a, c, g, or t
  misc_feature (418)..(418): n is a, c, g, or t
  misc_feature (423)..(424): n is a, c, g, or t
  misc_feature (431)..(431): n is a, c, g, or t
  misc_feature (440)..(440): n is a, c, g, or t
  misc_feature (446)..(447): n is a, c, g, or t
  misc_feature (451)..(452): n is a, c, g, or t
  misc_feature (456)..(457): n is a, c, g, or t
  misc_feature (459)..(459): n is a, c, g, or t
  misc_feature (464)..(465): n is a, c, g, or t
  misc_feature (473)..(473): n is a, c, g, or t
  misc_feature (478)..(478): n is a, c, g, or t
  misc_feature (480)..(481): n is a, c, g, or t
  misc_feature (629)..(629): n is a, c, g, or t
  misc_feature (646)..(646): n is a, c, g, or t
tcgtcgtactgaccggagcggggaggctgtcttgaggcggcaccgctcaccgacaccgaggcggactggcagccctgagcgtcgcagtcatgccggccggacccgtgcaggcggtgcccccgcngcnnccgtgcccacggagcccaaanagcccacagaagaagaagcatcttcaaaggaggattctgcaccttctaagccagttgtggggattatttaccctcctccagaggtcagaaatatnngttgacaagactgccagcatttgtggccagaaacgggcctgaatttgaagctaggatccgacagaacgagatcaacnaaccccaagttcaanctttctgaaccccaatgacccttaccatgcctactancgccacaaggtcagctgagttcaaggaagggaaggctcaggagnccgtnncggcgcncatccccanaggtcnntgcnngcanncnagcanncagaccanccagnanncagctgccccagaaggtccaagcccaagtaatccaagagaccatcgtgcccaaagagcctcctcctgagtttgagttcattgctgatcctccctctatctcagccttcgcacttggatgtggtgaagctgacggctcaggtttgtggncaggaactgggcgccangtttctgacccagctgatgcagaaagagcacgcgcacatctaccagctttgactttctccgcccacagctacagcctcttcatcctacttcacgaagtctagtggaagcagtacaccaagcatcttgagttccacccaaaggttttacttttcaacacgctcataggtaaagaggctgataaatcccccggagcaagtttgggatcaggtgtgttgaccgagtggaactgggccacagttccaggaacgtgacaggaagaaggaaagaagaggagaacggatgaaggatgcgggtggcctagtgctcagactcgacgtggcactgattctatgtgagctggtaggaaacagtggacttccaacccaatgagcaagggaacttccctccccccaacacgccagagctgctgggggcccgaatcctcattcaggagcgctatgaaaacgttggggagagtgaggaccgttgagatggaggtcgag

SEQ ID NO: 654908 - DNA, 537 bp, Homo sapiens
agcccctgatgctatcgcccaacactgggaattctagttctatatgagatttgggttataactaagatacaaattatatcattctcccgtggcccctcccaaatctcatgtatttcttacatttcaaaataaagctatgccttttcaacagtcacccaaagtcttaactctttccaacattaacttaaaagtccaaactccagtctaatgagagacaagcctagtctttcttgtcaattaacctgtaaaataaaaaacaagatagttactcccacgatacaatgggagtacaggcattgggtaaatgcttccattccaaaatggagaaatcagccaaaacaaagtttggtgaatgagtacaggcctcatgcaagtccaaaatccagcagggcaattattaaaccttaaatctccaaaataatctcctttaactccatgtctcacattgagggcaaactggtgttggggattgttatcgcccaacacaacatcatgtagcacttataggaataaaaggacttatggtattagaattac

SEQ ID NO: 654909 - DNA, 112 bp, Homo sapiens
cttagctggttttctctacacaataagagtgaacagaaaggtggcacttaactagtggacttggatacaatatttctttatccccagacagagtcttgctctgttgcccagg

SEQ ID NO: 654910 - DNA, 680 bp, Homo sapiens
  misc_feature (34)..(34): n is a, c, g, or t
  misc_feature (159)..(159): n is a, c, g, or t
  misc_feature (680)..(680): n is a, c, g, or t
taactatgtccaacgggtaaagccgcaccatggntcctctttgacacttggtctaacagcgccttctctgcactcccacctcgcacatcaggcgctaattcaaggaatttcttaacttcttgcttctttctacaagtccaccagcctccccactcccgngccttaggctcttacttttttttaactaacatgtccttcctactttctctaacttgcatggcactctgctgcgtcaccactttatgcctttactccctaacagatctctgccagaatagttttggtcttccccccctttccccccacccctccctccctcttctccccacttttattctatttttttatattctccattcctcccccttccatactcgcccgcctctcacgccaccgccccacttccgctcatctcaccgtcctctgccccttctctcctctccttcctacccgctgttctttctcagtttttcctgtccgcctcctcttttttccctttttttactcctgcttctcttctctcctttctcgcctcccctccacacgactacgcccgtctctccccacccttctctcctcacttttccaactaatatcattctcctctccgtaccactctcctcccctcgcatcttctcttcctcttcctttccttattcactccactcacctttttactn

SEQ ID NO: 654911 - DNA, 203 bp, Homo sapiens
  misc_feature (8)..(8): n is a, c, g, or t
  misc_feature (18)..(19): n is a, c, g, or t
  misc_feature (56)..(56): n is a, c, g, or t
  misc_feature (64)..(64): n is a, c, g, or t
  misc_feature (83)..(83): n is a, c, g, or t
  misc_feature (88)..(88): n is a, c, g, or t
  misc_feature (92)..(92): n is a, c, g, or t
  misc_feature (96)..(96): n is a, c, g, or t
  misc_feature (100)..(100): n is a, c, g, or t
  misc_feature (102)..(102): n is a, c, g, or t
  misc_feature (104)..(106): n is a, c, g, or t
  misc_feature (115)..(115): n is a, c, g, or t
  misc_feature (117)..(118): n is a, c, g, or t
  misc_feature (121)..(121): n is a, c, g, or t
  misc_feature (123)..(124): n is a, c, g, or t
  misc_feature (126)..(126): n is a, c, g, or t
  misc_feature (130)..(130): n is a, c, g, or t
  misc_feature (138)..(138): n is a, c, g, or t
  misc_feature (140)..(140): n is a, c, g, or t
  misc_feature (148)..(148): n is a, c, g, or t
  misc_feature (153)..(153): n is a, c, g, or t
  misc_feature (155)..(155): n is a, c, g, or t
  misc_feature (159)..(160): n is a, c, g, or t
  misc_feature (169)..(172): n is a, c, g, or t
  misc_feature (176)..(176): n is a, c, g, or t
  misc_feature (180)..(182): n is a, c, g, or t
  misc_feature (190)..(190): n is a, c, g, or t
  misc_feature (192)..(193): n is a, c, g, or t
  misc_feature (195)..(195): n is a, c, g, or t
  misc_feature (198)..(198): n is a, c, g, or t
cttggagntgccacaaanntaaaaccatgaaacatctattattgctacgagttgtntgtttttntgagtgtgaagtcccaagntgtcnactnagcnattntnannntttcttcantnnccntnntnatcnaccccttnanaagaaganagaanangctnncagcctgannnnttgnccannncccatcantnnangtntcgat

SEQ ID NO: 654912 - DNA, 380 bp, Homo sapiens
gggggggggcccccccaaaaaaaaaagtggttttctccccttttgggtggggggaaaaaaatttaaaacccccccccccggggcccttgagcgtcccaaaaaagtggggctcccccattgttctcaagtaaacaggttttaaaaaacccgggttggaaataacaagtcccccgggccaatcccctgtgagggggacgttagcaattaccccccccccttaatttagttgcctaagcattgccgggccttcctgtttagtttttcctgtaagccaaaaaaatgaacattccaaggagttggaagtgaagtttataatgtgaaacactttgcctcctggggactgtgtcataaacaaatgaataaactgaatttgtacttta

SEQ ID NO: 654913 - DNA, 902 bp, Homo sapiens
cgtcgcgtgtgtgtgcggtttttccgcggagcctctggtgggtttcgttgtacaagggggtgtgcgttggcgtaggggttgtgcgaggtgtgggcgccccaggtggttggtggggtggtgctagcggtgtggtgggtggattggcgcccggcgtcgaggtgtggccccactctggggttgcatgccgggggcactggtttcgacgagggcccttccttgagtgcgccacgttgtttactaggcccgcgttttgagtagtaggagcgctggggtttgtcgccctcgagttgagtgtgtgcgtggagagaaggcgcgctggtgccccgcgtattactaccggcgggtgggggtggtcacaagaagtgagatgggttcatccacctgcctggggtggttctcacgagaaacaagttcgtgtaacgggtgcactattggggtggttgtgttgcgcgccggaattgtggttattgtgtgtgccgggaggagtgttggctagcctgtcttaggtatacggcggcgtcatttattgcgtgtcagaggggtttttaaataattcactttgtgagcctcggtgagcaaggatggcgcaccactgtctgttgttgtgaaacagcacactgggcctgtatgcagctccccccactatcttgttgccagttgtgtggaggaggctggttagaacgtccctcggagtagtgggggttgtttggtggggtgtcaacaccacagatgtggtggaggagttgtgtaagtgtttgtgcccccctcgattgtataatgctgattccaggaagtttagttgctacatggggttggttcagtcgcacggtcactgtgatgtgccccggatgtgagtaaagtgtgttctcccagaccgcgggtgaaaaccaaaaaccaaaaca

SEQ ID NO: 654914 - DNA, 304 bp, Homo sapiens
cttagaggatccctgttatcgccaacacatgaatgacactacacaaacctctaccacagctgatcacgaaaccttccatcatggataagagtgcaggattttattggagaaagccaagaaaaggtggacccggaaaaatatcaaagaatacaaagactgattcattttggagacatacaggctatgtgatggcacaaatagatggcctctatgtaggagcaaagaagagggctatattagaagggaccaagccaatgacccctgttccagattcagttcctgaatagtgttggggataacatac

SEQ ID NO: 654915 - DNA, 930 bp, Homo sapiens
gccgccgaggattcagcagcctcccccttgagccccctcgcttccctgacgttcctgttcccccctgcccgccttctcccgccaccgccgccgccgcacttccgcaggccgtttccaccgaggaaaaggaatcgtatcgtatgtccgctatccagaacctccactcctttcgacgctccttttgcctgagttgctacaggtaaacgtgggtgagtgaccctgcgtttccctgcatggcgacgtgaagcgattatagtccagtatagaggaagttcaagcagaacgaaatcggcagggaaatgacccgttacctaacttggtcccaaacggggaaatcggctgactgagtttaacggaataagaaacatgaaaacgtagctgaaagtgccggttttaaatgcaaacaataccgtttgtgtgccccgtggccgaaagttgaggttaacctttgttcagaattcttgaagggcaatttccgtgcaaaccttatcgtggaccgcaaagtttaaattttgccatggcttaacatcgcggtttgaccccacatctggccccccattaaagaacattaattagctccaagtgttttccctttcgttaaagacgtacttttgtgaacctttgggcacattagagagccgaatctcggaagttcccaagcattcgaaacaagcggaggtattccaacatatggggccggctatttaataacaaagacgggtttggcgaattattgggcttacgaggccattcccaccttgttgaaaagctgcctttgacagccgttagaacaggtgaatttgctccccttttttaggctagacctgcgaattgtaaggaaagtatctccccattttcttacattcgccactttggttccaccaactgggtttcttaaaagaaacccttcaaccaagctgttgtattaag

SEQ ID NO: 654916 - DNA, 671 bp, Homo sapiens
gaatggccataactggtgttgataacctattattgtcacagcaattaggtgggtagccccacaggccgatggcttgccaaacctctgtccaatcaactaattgcaaacgcgttcccaaacactcactctccaaatcttacacgcgtctagcatattatatacaagcattcacgttcatatcaaatatgtagcatttcaacttgcacagtaaaccaggggccacatgtgatcatagtgcagtcaatatcacatttagcagcattagcagtgctagcatagcatcctccacccagtcagtcataggcagcatagtcatagccaaaggaaaaacaggggcaacgacctccttcacaggcatatatatagtctcaacacacatcacattcacacatgcaacgcatagtgactaagtgttccaccaatcaactttcttccttaacgttaaataacaccaatccaaaagctaaagcagcactgtagacaatcaccacgctacttttgacctcacctgtcaagatgatggctatcagggacagacaactggatccttgggacatccaggagaggtgatgataagaggatgactaattagggcacgccactgactcctcggggcctcccaacagggcgatacaggctgatgcataggctccacaaataacttgcgtgag

SEQ ID NO: 654917 - DNA, 209 bp, Homo sapiens
cgctagaggcctgaagaagagcctgcaggatgtggcagtggagcagactgtgcagagcttaatgagctcgctgaaaaaacaatgccactatagggtgcagaaggtgccctctggggaggtcctgtgtgacaagacgccgactgtgggatccagtcagcacaggcgccaggcacagggccttgactgaattgagatgcatcacactgtct

SEQ ID NO: 654918 - DNA, 420 bp, Homo sapiens
tcgctgttcttgaggaccccagcactgtgagactccatgtgagaatcattagatgtatttgactcaggcacagtggctaacgcctgtaatcccagcactttgggaggcgaaggaggcagatcacttgaggtcaggagttcaagaccagcctgaccaacatggtgaaaccctgtctctgctaaaaatgcaaaaattagccgggtgtggtggcacatgcctgtagtcccagctactcaggaggctgaggcaggagaatcgcttggacccaggaggcggaggttgcagtgagccgagatcccacccattgtactccagcctgtgtaacagagtgagacttcatttaaaaaaaaaaattccaacctggacttggaaggaagtacgggcggtgagtggcctcagtctgggccaaaaagaggctta

SEQ ID NO: 654919 - DNA, 441 bp, Homo sapiens
caaggacctgcagagggttagttaatgtcttggagagctgttctttcacttgactggcagagagacagtgtccagaggtgcagacatatgtagctaccacccccacccctgtgtcctcgcagtcacaatttgtgactgagttctcataacatcctatgtggtaatattagtgtctcattgaggatgtagtggaggctgagggaccaggcaatctgcttaagaacatccagcttgtatgtggcaaagtagtgatcaaccacatcttctggtcggcaagctgttcacactccagccagccctgtgtccatgagtgtctaaccaaaggagtatttgtcctagtttatttagggtgcatttcaatcaggattaccatttgggagggaagcacatgccagcatgagttgctcagcctagcattcaagaggactgagtcttccttca

SEQ ID NO: 654920 - DNA, 275 bp, Homo sapiens
gaactggtcgggcagactcatatatcgtgcgatgctctagatacgaaaacaatctcaataagcacctaatatcaaaacagtcttaaacttattgcccaatgatcttactccttatctgtttctcagtcagctcatttcagtcataacaatccatttttctagtgctggacagaagcctggagatgtcttaattctctccctgctttcacatcctgtctttgcactgaaacttagagaatatatcaggaatctcaaccatttctcaccacgacaca

SEQ ID NO: 654921 - DNA, 195 bp, Homo sapiens
cagctacaaactgggcaaattatggcagtggtcagaattatttatggttattataaagatatctagatatatgtgcaagaataaaaaccttatgttttgttcttaaaaataaaaattaatggtcaggtgcaatggctcacacctgtaatcccagcactttgggagggatgaggcaggcagactgctgctgagctc

SEQ ID NO: 654922 - DNA, 221 bp, Homo sapiens
caggtagacctaaccccatcacactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacttcttgttttaaacaagaatgaatcattactgtgtatgttaggtctacctgg

SEQ ID NO: 654923 - DNA, 218 bp, Homo sapiens
aggacatctaggtgctgggtcctgcggatgccaccatatcagtcccgtatatcacagttgatagggtcctgtctcaattctcgtgacactgggtagacatgaggctcctgttttcaatgggtcgctttaccctgggactgaccgggaggctctgacccattaagccaccaaatagtaggtagtaagttctcactcttaggttcaacaggtgaagttaa

SEQ ID NO: 654924 - DNA, 389 bp, Homo sapiens
atcatggtccgcgcagtggtaagcttggcactttttcacttctgccatgtacttggcccacgcgtcaccttaactgtgttaatccctcatcctcgtgtcttctgcttcttggaacatattccgtgtcttaagggtatagtttgttcccgcttgtgcgtttgcccacgaagttaagtgtgaagcccgaacggcctttcctcttggaatccccgggccaagcggcggcgccggtctgtgtcgggtctctgcgaacccgggggcgcgctcttctgtgccgctgcctgtgctcttcttctatcttcgcgcttacacagctacagaacgctgctgtcgttggagcacgagttcaccgcgccacacagcgcgctcgaacgcgcgccacacacctc

SEQ ID NO: 654925 - DNA, 936 bp, Homo sapiens
cgagagaaggagagatcgaagaggggataaagtaattcgtgaaacggcaatcatgtgctggcgcccgcgagtgtgaagccccagtctggtgtttctagagaggcggtatgttgcgaacaactttgtgccgtgaattcagtgttcggggccgctgggtttgtgtgatgccctggggcgcgagaattccgaggggggccaaaaacagagtggtgccaccgaagggtctgatccggtttttcggggcccacaatatgggtgttacagggccaataatatctggcaaaggcaagcacttccccctggtgaatgttgtgaggaggatcccggaaccaagtgggcggggaccaataacgaacagggggcgaaaaaccagtgtccccgaacgtcgtccgtgaaacgttgggtgcccccccgggaaagtcccgcaaaaggtcgaaaaactgggccagaaagagaccgtgagacgaaaccccttctcccagagcttgtgtccaagcgttgccccccttttcacggtggcagtatctatcccccggcttccgtggtaaaattctttcgcgtgggaaaagtactctgtgaagacaagtagagcgagggcagaacaagttcagtgtagaaaactggttaaacaccggaggcagggaggggggagaagatcgggcgctcgggggcaatcggggccccctctcggcccccaggaggggtctcaacccccccccgggggccatcctccctccgtgggaccccgagttttcccggccccaggtggtcaacccgcaggggtggatgacccttgcactgtccccctgggcagaggctgcatatccacaatcacgttggccgacgacggcgtctcgcagagcttctttgtgtctgttgtctgtcgcacgtttttcattttccccgcaaaaaaaaattctcccaaaccccataaca

SEQ ID NO: 654926 - DNA, 1147 bp, Homo sapiens
tcaggtatataacctatttattaacaaaaaaaggcctacagatcttatttctttttggacccccccacggtgcggccccgggggccagtagtctgggtggtgctggcctcggacacagaaggccccagaatgtgacgcagccctctatgggcccagaatcttcttacagtcagctccaggtcttcagggagcttgtgagtccagaccatggtgtataggaccctggctgtattatttcacatccttatacaatcctttctggtcctggttcaagaaaacccagttctgggagacatctgagtactgggcagtaggattctggcatacatgggtagatcaccagctgttcacacctagatacctacaggagagtttctccccagccactactatggagtagaggtcaatgtgtcgtgacttatcctatcaacaaaccccactgtgagacaatatcttagcggccacaacacaccttataagtggacagttaagtgtgcacacaggcataaatttacgcgcgcgacccaatcagaatgatgggatgttagagataccatcgaaaaaagtaatgcccagggcaacactttctccaagaggacaatacaacgatagaacgacaagtggcgccgtgacacgaaacaaaaacgacagggatgggcacgactgtaaaaacagaagtcaccccccgggacccacaacagaagaggagagggtgtggcaacgaagacaaccccagagaagaagaccacgtgagggcaacgagccaaaacattaccgggtggaccagcaaaatctccacggtacactaccaagtggtttatgcggggacaagcctctgagcaataattgtgggaacaccaccagttgtagcacgttgccccaagttgaggcgtattatacgacacaacaccaagcaggtgtgccagcgtagcacaaaaaaccgactgggcacacgacaggcacctcccacaaaggaccacgaaaggaaaaaagacgagacaacaactaacccacaggaagagactagcaacaagcgccccacgtgggaacccacagaaggcagagggcacaaccaagcaaatgagcgagactccgagacaaaaaccatcacgcgggggaacacaacaaacacaaggaggagtgatca

SEQ ID NO: 654927 - DNA, 648 bp, Homo sapiens
  misc_feature (440)..(440): n is a, c, g, or t
  misc_feature (485)..(485): n is a, c, g, or t
acccactctaccttactaccatacaaccttaaccaaaccatttacccatataaagtataggcaatagaaattgaaacctgacacaatacatataataccgcaagggaaagatgaaaaattataaccaaacataatataccaaggactaacccctataccttctgcataatgaattaactacaaataactttgcaaggagagccaaagctaatacccccaaaaccagactagctacctaataacagctaaaagagcacacccatctatgtaacaaaatagtgggaagatttataggtagaggcgacaaacctaccgagcctggtgatagctaatgtccaaaataaaatcttacttcaactttaaatttacccacacaaccctctaaatccccttgtaaatttaactgttagtccaaagaggaacagctctttggacactangaaaaaaccttgtatagagagttaaaaatttaacacccatcatangcctaaaagctatcaccaattaataaagcattcaaacttaacacccactacctaaaaaatcccaaacatataacttaaactctcacacccaattggaccaatctatcaccctatataagaactaatgttactataagtcattcattctcctccacatcctgct

SEQ ID NO: 654928 - DNA, 395 bp, Homo sapiens
tttgcatggcaaggaattcagtttgtgtttacagctgaagctctcttgaaataatgtctcagtcacagcttatacattcgggggacccctgccagtcagacacggagtattgcggaactgtgatctggcgtcttttcaccattgacaatacattcagaacttatttctgataaaactgggcagtttctaaggatactgtacttatgatttaaagtcataactccatgatgcaaaagagaacaagaaatatgtttcaatgactgccttttaaattagcggtactccagcacttagggaggccgaggtgacaggatcgtttgaggccgggagttcaagacagcctgggcatcatagccagaccttgtatctactaaaaataaacaatacacaaattt

SEQ ID NO: 654929 - DNA, 857 bp, Homo sapiens
caaaatagatacatatgatgaatggagcataaatagtaactcctatcctttgtaggggtagtgtagtgtagtagtgtgtagtagtgtagtgtgcagcagcagcagcagcagcagcagcagtagtaatcatagcaccatcattgtgtcatatcagaatcatagaaacaactctctagcaagttgagcagcagcagagcatccaaatagtgtactataaaccggggggagcgtcataacaacaaacagcaagaagagcacaacaacaacttacgaaggagcataacgcagcggcgacataagaagtagcacccacaaacatcaaactcaattaatataataaacgaacaacaggcaacaaagatagcaacaagacaaataaacacgcccaaaggtagacaaacacgaccaagaagtagctaaacaccgcacagcgacagaagcgggataacacacataagaagggagaggagacaacacaagtcagacgaacaccacagaaagagatgacaacaaggaaaaacacaacacagtaaggaagctaggaacacgacaccaaggaacatcagatcggtaagatacagaaacgaaggagagaaacacgacaaaagaaaccaaaagacgaagtggtaaagtacagaagaacaccaaaccgcgacatggatagaaaagctaaggggcaagaaagcacacccgcaaagagagacaggacaccacaattaagacctaatacgcatagactggaaccaacagcaaccttagacacaaaaaaacaggacttacacagcagacaaatacagagggaccagaccagctaagacgggagacgcaagaaaaaaaaaaaccgaagaaaacatgcg

SEQ ID NO: 654930 - DNA, 351 bp, Homo sapiens
ctacaggatctttactagttctcgtgaggtgctccacgctatcgcagcaagaacagaagcagctattagagagaggtcagccattgcctacggggactctaaccagtgtagcccaatccaaggtgctgcgacttgatgggtaagcccagctaccctaacttgagtccggaacacaggatcatcccattttagctcaaagcacgtaaaaagcaaaataggatgagacattgtcttggttcttgaacagttagctatgttcaactaagctggtgagcaatagaaatagatatattttggtcgcatactcacaacatacaagagaagccaggtagtcgtgtaccgcgctcgcat

SEQ ID NO: 654931 - DNA, 926 bp, Homo sapiens
tggagagcatcacagtgtgtgaggtgtcagtgattgtagaccctccccagcccctcctgcttctttaagtgatctgtgtgcgtgcgcttcctctcgatcgtctattgctcgctcattctcttatattctgctgaactccgatgatataaggaagataccttacgtgcatggatgaagtttatctacatagatgtaagtcttattcagtttatagcagtgtgccaggcataagactttaattaggaatcatttgtctggtaatatgtcatgccgggaatgcctattgtagtaagatgtcacggtattttgtgaaatataacctttgaaaatgtgtaaccatttgagcgacttgttgtggtctagcattgtgtacgacagttctaagttgtgttgtgggttctctttatgtaactatgtatatatattgtgaagaagttgactgtgtaggcaagtaagttaagttccatagattatcactttctagccattagtggggatatgagtacccgtaaatacttgaccgaaattcttattcaccgtctggagacttctggggtaagggctagtttctatggtatcgttttctatccacccttgtccggttgcactgtactttgtttctagacgaataataccctgtatgatacttatctagcgcagaaatcagtctcatgagagctattgctgagtatagtcggtgtaacactacagcctgttgagttttgggtaataactttccaaggttgaatcccgtctaacaggatatattccaggtttgatttactcatggacttagactatgccttttcctgaaatattttggacccttttgttcttggcgttgaacacgttgtggcgctcggccggaacgctggggttcacacgcggcctggaaacaacaacagggtgccggggaaggccccgcg

SEQ ID NO: 654932 - DNA, 355 bp, Homo sapiens
tccgacatggactgcacattcgggaaaatcagcaaaagaactcatgtgaaatcattgggggctggtacccctgcatcatctctttcaccagttctttgcaactccactcttccctgtagcacactaagtccacctattgtctctgcttcctttactgtcccagactggctagtgggactcatcacttctgctcaccctcttaccagtgtttgatgccatcttccttgttcaccagttcaccatctctggccgtaccttgtcagtctctttatccacatccttgttctcctcaaaagttcatattcatagggccttgctctgttctagcctcttttctcattttcatacctctctc

SEQ ID NO: 654933 - DNA, 120 bp, Homo sapiens
actattcttcctaggtgtataatacttcctagtattgcatcgtctaggagatatcagagtgtgccagatatacaattagactgcataaacagattactccactaacatacatggttacag

SEQ ID NO: 654934 - DNA, 272 bp, Homo sapiens
cggagggagcccgcggcggcggcaagcaagctacagcgaaatggcggagaccgtggctgacaaccggcggctgatcaccaagccgcagaacctgaatgacggctacggaacccccagcaactttctcgagatcgatgtgagctacccgcaaacggttggggtcggccgcgggcgctttcaacacattacggaatcagggtcaagacaaatctttctattttcaagctgtgagagtctactcttatgaggaggatactacagactctgagatg

SEQ ID NO: 654935 - DNA, 822 bp, Homo sapiens
gcgccggacgcaaaggcggccgcggttctagtgaacttgactgtgatggggcttcctgaggagcgggtcctggagcggcagcgtggagccggggccaggaggaagctggagcctggagtgcctgggcgctggcagttggtctcctgcctgcccgaggtcagccgctccgcgcacgtcccctcgctgcagctgctaccgcgagctgcacctggcgctcctgtggaggagccgcgggaattctggggacgacacttgccaaggaatcttacctggaagactccattgccctggcccattccttcggtacaaccttttgatgtgactaacgggaaacactcttcatcgacgtggatgaaaggagcaactaccaacatctgctacaatgtaactggatcgaaatgtccatgagaaaaagcttggagataagttgctaatacatgggagggcaatgagccaggggagaccactcagatcacataccatcaagcttctggtccaagtgtgtcacgtatcagcaaatgtctccgaaaacagcgcattcagaatggtgaccggagtggcatctacatgcctatgatcccagagcttgtggcggccatgctggcatgtgcccgacataggggcgctttgcccctcaatatgtgtatgcagagctactctttcggagtctctatgtgaacggaatcttcggattcccagctagcgccttctcattcactacagattgcctactaccggtcgcggaaagcttgtgaaccctgaaggagttgcctgacgagggcctgccgcaagtgtcacgaaaaaggttaccccagtacgatg

SEQ ID NO: 654936 - DNA, 880 bp, Homo sapiens
  misc_feature (126)..(126): n is a, c, g, or t
  misc_feature (146)..(146): n is a, c, g, or t
cgagccaggatgatccgttgggcccccagcgcatctcctggaagagcccattcaccctgggagcgagctcttcggtagcctcagaccgtccttgaagaggatgactgagacattatgggccacgcnctgtgtgtctgctctcgggnaactgtcatcattgacaataagcgctacctcttcatccagaaactgggtgtgagggacgacagtccatgtgtacacgagcatgcaggacgctggagaggagggccctagactgagcaagcctgacatgtcatcgccgtcttctaactcacctcgcaacagtccttcggcactcgctggactattactagtactgagtggagacaggcgttgtagcgtaaaggcatggagcgcgctgtgctgcattgcttacgcaatatcctctctaagacgatggtgtacgcctgatggcaatgaagataggatagaggcgtgacaggacgaaacggcaagcttccctgacgcgagggatccaaaatcctgttgggcatgctgcatgagggcatcttgccacggagagccttgcaggaccattcatgccaaaggggttatgccacactagagaacgttgtaagtcgcactcagatatattgtcttggcagatgaaggggcagccagattctaaatggactaggggtatccatggaatcaccgcatgtcgagtccatgtggagaggcatcgccggccagtgattctagaccactgtaggacctgggggcagttccaggcggtgtcaccaatcctccttaaaagaagcccccagaaggctcattctcttgtggcacaggtcaactgtgctcatccgattgagcggaactgatggctgggtaccataagctgcgtgctatatgccat

SEQ ID NO: 654937 - DNA, 522 bp, Homo sapiens
  misc_feature (126)..(126): n is a, c, g, or t
  misc_feature (146)..(146): n is a, c, g, or t
  misc_feature (299)..(299): n is a, c, g, or t
  misc_feature (327)..(327): n is a, c, g, or t
  misc_feature (419)..(421): n is a, c, g, or t
  misc_feature (450)..(450): n is a, c, g, or t
cgagccaggatgatccgttgggcccccagcgcatctcctggaagagcccattcaccctgggagcgagctcttcggtagcctcagaccgtccttgaagaggatgactgagacattatgggccacgcnctgtgtgtctgctctcgggnaactgtcatcattgacaataagcgctacctcttcatccagaaactgggggaggggtgagtgtttggaagtcagttaactagtcctcaagtttatgatcattgaaggacaggggtgtgcatatgcttggggcacaagggttttatccctatccntgtcctctctcacctgacagaacctagntaaacagaatcaagaaggtggattctggagccaggccgggtaaatccacctggggtgaccttgataaacgatgtttttttcataaggtcaannnagagggttaactaatataacaaatggagncgtgaggatcaaaagaacaaaagtgaataaaatgtctccccccccccggggggggcaagtaaaaaaaaaaaa

SEQ ID NO: 654938 - DNA, 143 bp, Homo sapiens
ctgtgtattattgcctctgaggttcttgggcacactctatagccatactggacaggaaccatgtgcccctgtgtaggcatctgtcggtctggttatgccgccagagatggcagcatctctgctgcatcccccagagagtacac

SEQ ID NO: 654939 - DNA, 190 bp, Homo sapiens
ctctgggggctgaaaaccactgctttaaatccctttacatttactatcacataaggttattgtaaatgagaaatattctattgatgctacaaatggaaagccaatgcctttaccataaatagaaaaacaaccctaagaaacaagcaaaacaaaaacaaaacgggctgggtgtggtggctcacgccctgcc

SEQ ID NO: 654940 - DNA, 212 bp, Homo sapiens
  misc_feature (11)..(11): n is a, c, g, or t
  misc_feature (21)..(22): n is a, c, g, or t
  misc_feature (133)..(133): n is a, c, g, or t
  misc_feature (139)..(139): n is a, c, g, or t
  misc_feature (191)..(191): n is a, c, g, or t
  misc_feature (193)..(193): n is a, c, g, or t
  misc_feature (197)..(197): n is a, c, g, or t
cccagggaagnagtggatcannccacaaaagccacatccaccgggcctattcccaaattattggcatccatccagccctcaggaggcccagaaccgaggagaaacatgctcatactttctgggtaggaacttngatctncaagaattctgcctctcgggccagcacctcctaggaagaacagggaaccagngnggcngggacacccctcgtg

SEQ ID NO: 654941 - DNA, 960 bp, Homo sapiens
ccggtgaagaggctgcagccggacttgtgggatgcgtcgctcaatattcgagagcgagagggtcaaggcggcgcgtctcgtgggtgtggagcctggaggtgaccgcgcctgctgcgagtgcccccaaccctgccgcggtctgcagtggttcatgcccgtaagaacgtttttcattcataataggactggactccgcacggtcgcgggtgagtcgagcaaccccgaacatgcggtgtcctccccgtctgagccgtctagccctcggtgcttgatttctgagaacattcgagtggtataccgcagtgcactcgaggcatccgtcgtaacggcggacgcggtaacagagacagggacccgacgctagatcctccaggatcgggcaattcggcgatgggcatgtccaagtcgagagagattccaacatggatgccaagcagttcatggaccactcgagatggtaggtccaaggagcttgccagatgtgatggatacagcccgtctatattcacttgagagagacacccgaaacaagattaccccacagggcatctgaactacccttcaggtacaggggcctccaacagacttgccaggctcaggagtacattcgtagccctgcgtgtgccgagcatcctagggtggtactatggaatgcctgtgatggagtccagagtccatgcccggagcgaaagaagggagccgccgactgagctaaaagtgcgctgaagtggaacaagctggtctgcgggtcgatttgcaaggaatccgtacggaaggtgcctgaatcgaccttcttgctaggagtggaacagttgacttgatctggactagttgagcaaagcctgggctgctgcagcgaccattttgggagcctgtatactatcaagtgatgccccagaggtggtgcttacattcccaccgacctgtttgcaaggtccctgaggatcgggagggggaccg

SEQ ID NO: 654942 - DNA, 175 bp, Homo sapiens
  misc_feature (22)..(22): n is a, c, g, or t
  misc_feature (39)..(39): n is a, c, g, or t
  misc_feature (41)..(41): n is a, c, g, or t
  misc_feature (47)..(47): n is a, c, g, or t
  misc_feature (137)..(137): n is a, c, g, or t
cgagatgagctctactttatcnatactctcttccttccntntccatntatagcaagtattattttcgaaaccatgagagaaagctgcatacatcacagtactttacttctaaaaacttcattatgtattttctaagnataaagatacttcagccgggcatgtggctcccgcctgt

SEQ ID NO: 654943 - DNA, 150 bp, Homo sapiens
  misc_feature (64)..(64): n is a, c, g, or t
  misc_feature (109)..(109): n is a, c, g, or t
atttctgatccctccattcagggcgtttgggagccaccccttcattttttaaaaaaagtatttntttgtgaccgacggccggggccttctgacggtccgaggaaatgantgggccatttacctactgtcacggtccgtggaggggggaag

SEQ ID NO: 654944 - DNA, 362 bp, Homo sapiens
tttctcgaatacgacggtttctcacaactgttaagcttgcaaatgacaatgcagactacatgaagatgaacaggacagagaagccaaaagccaccagaagtgcagcaagtcttgcgatcctggggaagactgtgcaagttgtcaggcaagatgagatagatgtggtgccagagagtccattgtcagatgttggctctgaggattgtcggtactgtgccaaaaaaatgacaacaaatttgactagacaagacagttgcctagggaaattctcctccatttgagcaaggaaacagtgaacccgagtcaccgatggatgtggataattctcgacaatagttgacaaggactcagaagcagatgag

SEQ ID NO: 654945 - DNA, 925 bp, Homo sapiens
acttccatgccgtgggccgtgcaccatatcgccgtggatctccctgtttcttgtactgttctgttgtcccatatcgtgttatcccccgcttctctccagtcatctgctgttcgctgctttgttcgttttaccatgtcttgacggctctttctcgctgacggtgtgtattggatcggtggtctatcgagtttccctccttgttgcaagttttacggtactgttgtcgacgtattttcgtgaggctcctggcgtaaataattatgctccgctactccgcatagtatgaactgtcaaatcttatctaaatccttgtgtgtgtagtatgatagtgtatgattagtagtcttctgccaattccactttgttgccagtaccttttgcatgtttcatgtcgggtcctgttatcccaccttattggttcattgggtttatgagttggggcatggctctactgctgtcctgtatttactggtatcccagcagtaagcagcatgcatgcttgaagtccaggtcactggtggtcacattgttatctatatttcacttctctaggccctctacctgactctagaagtgcccatcccacatatattcagtttctggaggggtttgatcttaaaatctggatccgaagtcgatacacgtctgagatgattgaacaacatagaaattggccgcggtcatggtggcttatcgcctgtaatcccagcatctttggtaaggccaaggacgggcagatcatgaggtcaggagatctgagaccatcctggctaacatctgtgaaaccccatctttactacctatgctccaaaaattatcggggcacggtcggtgggcatctgtagtcccagctacttcgcgagactgaggcaggagaatagcaagaacccgggagaatacgccgggagtgagctccgaggacctc

SEQ ID NO: 654946 - DNA, 100 bp, Homo sapiens
gcaaagtagcagctactgaactgaccagaaacaaacccaagacactgaattagacaaaccaacctgctgaagtataggcactttttctaagatgaaatgt

SEQ ID NO: 654947 - DNA, 85 bp, Homo sapiens
aaattttcccccccccccccccccccttttttttaacccccggggttttttcccccgggggggggaaaaagttttttttggggga

SEQ ID NO: 654948 - DNA, 856 bp, Homo sapiens
  misc_feature (3)..(3): n is a, c, g, or t
  misc_feature (63)..(63): n is a, c, g, or t
  misc_feature (86)..(86): n is a, c, g, or t
  misc_feature (102)..(102): n is a, c, g, or t
  misc_feature (110)..(110): n is a, c, g, or t
  misc_feature (112)..(113): n is a, c, g, or t
  misc_feature (119)..(119): n is a, c, g, or t
  misc_feature (131)..(131): n is a, c, g, or t
  misc_feature (133)..(133): n is a, c, g, or t
  misc_feature (141)..(141): n is a, c, g, or t
  misc_feature (153)..(154): n is a, c, g, or t
  misc_feature (158)..(158): n is a, c, g, or t
  misc_feature (161)..(161): n is a, c, g, or t
  misc_feature (177)..(178): n is a, c, g, or t
  misc_feature (181)..(182): n is a, c, g, or t
  misc_feature (187)..(187): n is a, c, g, or t
  misc_feature (191)..(192): n is a, c, g, or t
  misc_feature (194)..(194): n is a, c, g, or t
  misc_feature (196)..(196): n is a, c, g, or t
  misc_feature (198)..(199): n is a, c, g, or t
  misc_feature (202)..(202): n is a, c, g, or t
  misc_feature (205)..(205): n is a, c, g, or t
  misc_feature (211)..(211): n is a, c, g, or t
  misc_feature (215)..(215): n is a, c, g, or t
  misc_feature (218)..(218): n is a, c, g, or t
  misc_feature (221)..(221): n is a, c, g, or t
  misc_feature (226)..(226): n is a, c, g, or t
  misc_feature (230)..(230): n is a, c, g, or t
  misc_feature (235)..(235): n is a, c, g, or t
  misc_feature (239)..(239): n is a, c, g, or t
  misc_feature (241)..(241): n is a, c, g, or t
  misc_feature (243)..(243): n is a, c, g, or t
  misc_feature (246)..(246): n is a, c, g, or t
  misc_feature (249)..(249): n is a, c, g, or t
  misc_feature (255)..(255): n is a, c, g, or t
  misc_feature (258)..(260): n is a, c, g, or t
  misc_feature (264)..(264): n is a, c, g, or t
  misc_feature (276)..(276): n is a, c, g, or t
  misc_feature (285)..(286): n is a, c, g, or t
  misc_feature (308)..(308): n is a, c, g, or t
  misc_feature (313)..(313): n is a, c, g, or t
  misc_feature (323)..(323): n is a, c, g, or t
  misc_feature (329)..(329): n is a, c, g, or t
  misc_feature (331)..(331): n is a, c, g, or t
  misc_feature (346)..(346): n is a, c, g, or t
  misc_feature (361)..(361): n is a, c, g, or t
  misc_feature (414)..(414): n is a, c, g, or t
  misc_feature (424)..(424): n is a, c, g, or t
  misc_feature (450)..(450): n is a, c, g, or t
  misc_feature (470)..(470): n is a, c, g, or t
  misc_feature (497)..(497): n is a, c, g, or t
  misc_feature (839)..(839): n is a, c, g, or t
gtnatctcttaaagaatcgagaattgcgtcaaaaaaaaaattaaataaataaagaatgaatanatttacaggggtaaatggaaacngcttccaactcaaagnaagtgacngnncagggngttctgggcaangngatcgggnaggagagggggnngggnggngggggttggggtttgnngcnntgggngggnngnangnnggnggnggtggntgtngcnagngtctngggngatcncagngnantcngcnctgggnggnnngtgncctgcacagatnagggggtgnngggcacacagactcaccaagcnacagngttgtgttcnacaagngngtgcttaccttagcnacgaaggaccaagcnacaggtactaaaggttgaactcaaagatatgtgcagggtattaaacaaatacnagggggaacngttaacttcaatacaaggtcaaaatnaacaacaagttctacaatcnagtgctgatatcagatacaagcttcanggacaatttcttttcgaaggcttattccagtttcgtgaggctagcatgaggtgtgtgcatttgccaggggcaaatttctattctcaattaacccatgcagcaaatgctacgcatctgctgagtccgtttagaagcatttgcggtggacgatggaggggcccgactcgtcgtactcctgcttgctaatccacatctgctggaaggtggacagtgaggccaggatggagccacccgatccacaccgagtacttgcgctctgggggtgcgatgatcttgatcttcatggtgctgggcgcaagggcggtgatctccttctgcatcctgtcagcaatgcccggatanatgggtggtgcgcccga

SEQ ID NO: 654949 - DNA, 719 bp, Homo sapiens
  misc_feature (377)..(379): n is a, c, g, or t
  misc_feature (393)..(394): n is a, c, g, or t
  misc_feature (540)..(540): n is a, c, g, or t
gccaggatggaggagccccaggccggcgatgctgctcggttctcttgtccccccaactttaccgcgaagcccccagcctcagagtcccctcgtttctccttgagaagcgctgacgggtccagatacggagctgtggcttattcaggcccctgcagactttgccccatgaatgcttcaactgggcggcatgtgcctctctctggctcccagaatcgtcaagggcaaattggcaggcaagcggcaccgctgatcgaggtcctcagcagctgtccccaagctggtagaagcgaccctgctggccccctcaatcggaggcaggaggtggactcacctgtgcctcagccccccatgggtcaacccgtagaggcactccttgnnnaggcgtcacccganngcaatccactagtcagagtggagctcctctgtcatgctccagtcccacgcaagtcccccagccacagatccctcctggtctgaggcctcggttctgtgcctttgtggtggcaagccaccagtcactgggcctaggtcagccttggnccccaacctgctcagcctcagggaagaagaagaaaggagatgcaggtgacagaggccccagtcactcaggaggcagtgaatgggcacgggggccctgtgcaggtggacatggctttggggtcgcagaaatggatgtgcggaagaagacgaagaaacgagatcagcagtctgagagaaac

SEQ ID NO: 654950 - DNA, 273 bp, Homo sapiens
aaaaaaagtttaattttttaaacccccaaaggaggggggttcctttcaaagcaaaaacagccccctttttttttcccccctaaaaaaccctgccttgttgggggttataaaatataaaaaaaggggcccctaaggggttggtttccaaaattaaaaattttttgtattcccccctgaaaaattttttttaacggaaagttttaaaaaattggggggggaattcttaaaaccaaagttttttttaaaaaaaacccccccctgcttggcccctga

SEQ ID NO: 654951 - DNA, 265 bp, Homo sapiens
gagagctgcacagagcaggagtctgagagctgcacagagcaggagtctttatttggttcacttctggtctgcagcaaccacttgctactaaaagatggaaaagatgtacaaaaatgtcacagccctttagaaagcgacattatcagaaatgtatgaccttcagtcctccctccctctcctatgcccccaccagaccaggcggcgagaaggaacagggagtgaacatgtaacggaaaacaataaaactgaatttaactggaaaaaa

SEQ ID NO: 654952 - DNA, 190 bp, Homo sapiens
gatcccgtctgggagctgtactaagctgagactcggggcgcagtccgggcaggtgcagcgggagccggccggagatgccctgtattcaagcccaatatgggacaccatgcaccgatctcgggaccccgtgaccaccttgcaagcgatcccctgacccctgagttcatcaagcccaccatggaccttgcca

SEQ ID NO: 654953 - DNA, 254 bp, Homo sapiens
ctaccagacatcacacatctgggaggatggtggtgcccatcatcaaaaggccaatcagaaagatggataacttctctctccacaagagttagtgtccataagtagcttcacatactcttactatagtggtacctcccatactactaaagttcctctgtaaatttgtttaaggtctaattagatgcatagtgtgtaataacaaatctcttgtgcttgtatgtgacttcctcaggagctgggcatattccatcgag

SEQ ID NO: 654954 - DNA, 644 bp, Homo sapiens
gagaaggatgtgttgaaagcaggagtgaaccagtgtgctgctggtagctgggtctctcgtatagaggtcgcctgatgtcctctgtgatcgctgttccgtcgtgtcgtgcttcgtatgagactctgatggcacgaggaaagcctggaacatgtgggagtgcaatttagaccaccagcgtggtgagcatagggctggatgagaagtttcgcagcgaggatctacatggcttggccgcatggaggctgtgcgcatcgtccattgaccgagacaatcgtcgggacaggagaaatgccgttctctgggtcaaatcgtctagccccgcaccattccggctggcttctaggtaacacatggttgttatgatgcgatctgcggggagacaaggtcacaatagaaggcttttgtccgacctcgagagccacgtctggatcccattcaaagaggtggcagtgaccctcatttaccaactggccagagggccccgacagtgatctgtgcccagatattgcagggctgtgctaaaagcatggccctggagaatgctagaagagaagcagaaccagtcaggaggacccgaaggagtcccccgggaatgctccccactttcctgttgatgaacctgctgtccctggctggggatgtgg

SEQ ID NO: 654955 - DNA, 1146 bp, Homo sapiens
cgcatctgtatcgggagccgagcgcgccgggctgggccggggccggagcggagcgtgagagggagcgcgcccgtccctgccccgagttccgcgcgcttccctcccgtcgcagcgctgggcgcactggccggcgtcccagccatggagcaagacaactgcccccgatagatccagttccggtcccgctgctggagccgcaccttgacgcccgagtgcggcgtgagcagattctgagtgcgccgactcaccgcctgccagccgtcgtgcttgaccagtgaccagtcatccccagagattagatgaagaccgtgatcctcaaggccacaatctcagagtccaacttttgcgcaagtgtctaccacggccaaacggaacatgtagagaatgatcacagggatcagcactccatcatattgaaagaatactttgcagaaatggcatccgctaagaagctcacgagagacggcagtaaggaacccagcacataaagaaccgctcaacccgatataccagccacgtggattccaagggagccaactcggtctgagagaggaggaggtatcttgggatcaagactgcagtttgggaatgcatggcacaccggatttgtttcttattccttcacttttggggaaaatctcttgtacttaagcacgctgactcactttgggtgtcaggtccttggcacttttccttcttttccaagctgggagaatcctttctccctgacttcttgcccgtggcctctctggagggccccacgctcctgccagcctgcctctgcgcaccgacctgaaacagggagactaggagaagccttgcaccacgacgagcttcttgccttagccctgcatttagtagctgttggcaagagacaatacggtccaatcaactgcgcggcgatacttcaaggggtggcaagaaggcagaaaagacgcccaagagcgaacacgattatctatgaaggaaaaaactaggaagcacgctctagaggccctttcctgcagagtggaaacaccacggcctcctacgccactatcccgtcaccacgtagtgaatatacaagtggggactccttgatgtgaccaagggacagatggtggagggccttgtccgtgcaacaagattatggcgtcgacacaccac

SEQ ID NO: 654956 - DNA, 426 bp, Homo sapiens
tgctgttctcctcctcgggataaattcaacataacgtagcagataatatccaaaccacatcattccacctctggccctcccaaatcttatgtccttttcacaatgcaaaatataaccatgccttcccaacagtgccgcaaagtcttaactcattccagcattaactcagaagtccaaagtctcatctgagacaaggcaaatccctgccacctatgagcctataaaataaaaaacaaattatttacttccaacatacaatcagggttcaggggttggggaaatattcccattagggaaaaacctgccaaaaaagggggctataggccccatgcaagttcaaaacccagcatggcagtcattaaatcatgaaactccacaatgatctccttggtttccatgtggcacgctgatatgagggttgggctc

SEQ ID NO: 654957 - DNA, 856 bp, Homo sapiens
gcccggtttccgatgtgcagcctggacagtgcatgtgagctgtctggcctttagtccttgatccttggtgttacatggacaatgaccaaccagtacggtattctcttcaaacaagagcaatgcccatgatgatgccatttggtcagttgcttggtggacaaacaagaaggaaaactctgagacagtggtcacaggctcccgtagatgacctggtgaaggtctggaaactgggtgtgatgacgaggctggacctacagctgagagtctggagggtacatcaagctggtgagtggtgtctgtggacatcagtcacaccctgtccattgctgcatccagtctctcttgatgctcatattcgatcttttggagacttctgtgcataaccatggacaacagatataacgtccatagatgcaggatctgtggatgcctggacctttggaccatttgtcttcctgatttcccagtatctggccactaggtaactcatgtctgggaaagtgaacattattggtgtggaaagtgggcactcggaatattctttggacacgagaggaactttcattcttagtattggatatagtcctgatgggaactagctaccgccaagtgtgagccataatattggatatcatcaatatcttttgatagttgcagatggatacatattcgtgcatacacctggaaggccaatgccatgcccattcgctccttgagcttttccccggactcccagtcctttgtgactgcttcagatgatggtacatcaagatctatgatggtacaacatggcaatttggggtggcacggctgaacggcatgcctcctgggtgctgaacgttgattctgtcctgat

SEQ ID NO: 654958 - DNA, 127 bp, Homo sapiens
taccatggtactggcgatgacgataaagcggtgccacgaggcggtctgagccatgatcgcggcgatgtcgccccccccatacctgcagccaggcctcggcagcagcagcagagtggccgccgaagcc

SEQ ID NO: 654959 - DNA, 434 bp, Homo sapiens
  misc_feature (7)..(7): n is a, c, g, or t
aagatgnatgttaacacaaggtcctattttaataaataaggtgttgaaatacttccatgtaaattttattgaatactgtaacattaccctcaaaattgtgatggttttgccatcatccgtaaagttgaaaaattggggcccaggtgtggtggctcatgccctgtaatcctcagcactttggtaggcccaaggagggtggatcatttgaggtcagaagttcaagagcagcctggccaacatggtgaaaccccgtctctactaaaaatacaaaaattagccaggcatggtggtgcgcatctgtaatcccagctacttgggaggctgaggcaggagaattgcttgaacccaggaggtggaggctgcagtgagctgagatggcaccattgcactccagtcctgggtgacagagcaagactccatctgaaaaaaaaaaa

SEQ ID NO: 654960 - DNA, 1358 bp, Homo sapiens
  misc_feature (517)..(517): n is a, c, g, or t
gatagcgtttcctcttctgtccaaacccactaggccttaggtggtacgaatgcatagtgggtcatcccttgatttcgccgtatctattgttctcattttagattcgcgcttaatatccagagggtgctgtctcggtcgcagatcgcactaccagagcactgagcgttggctcatcgcgtgttgaaacgcacttataggcgacgatacgacacagattgttcagaaggcgctatgcgttggttcgagtgtggaccgttttggcgtccatgttgatacttgcgactcgatggtagtcccactatttggcaacgcaatcattggtgatagacactgtatggctggaattcgacagctcaagcgtcgagatgttgtcaagatacaccatttgttgttaagctttagactgcgaccttacaggccctagatatagattttggctccgaggcacacagtccaccactatcagtgacacccgttcttgttggagatgactaagtatatgtaatcgcttcccagngcttcgcaacaacctgcgtttcgggttcgatacatcctccataacatgaagctagaatacaggtggcggctagatcgttcgctattgggctggctacaaatcacaaatgggaaaaccccttgtcagcaagtcacaacgttgtcacagtgccgtatctcgtgctagccttaatgggaacgtacaacatggaaagtgtacaccaaaagccccaaaaaacaacttgcgctcaccccagaagtatggggagtgggaagaaatcgcaaaggaaagtgctttcggattcggcatttgcactaggtttgacagagcttgcgccatttgttatgccatttggcaggccaatattgcaagagcaaagttagcgctgttgtggtggatcgccacacgacattgagatgtgaccctgctacgtaattgtgcaccaccttttggcgccatggccaaattgaatccggcgtcgcttttttacctgttttttgagttggcgccactctgaggaaaatcgagcccgttcttgttgccttagtggggccttaaagaaacggtgttagttgaaacacggccgttgctaatgtcgtcgaaccgacgggaacactgtgattttgcccataagggcaatagctgtggtaattaaatggggcgttgaccctttgacacctttgggttgggtccccataccacaggccatcccggaacctggaaagctcttttcgggcgggtacatggaacatggtggggtaaaaggaaggcggttctcaagggttcatatggcgcgcaaaaactatgaaaggtacccctacataaggtgggtatgcccatggggtcagtcccacagaagact

SEQ ID NO: 654961 - DNA, 322 bp, Homo sapiens
cccagactgtcattcttcattgatggagatgatggatgatggatgatgaatgataggtaagtggatgggtggatggatggatggataggtaagtggatggatggatagatgggataggtgtttgagtggatggataaatagatgtctgagtggatgaatgcatagatgaatggatggataggcagctgggtagatgtatgaaaggagtgacgggactgacgtggtggttggatggctacgacgacctggactggatacgctcggcggagggttgcgatgggtaggtgaatgagtggctcgatgggtggatgcatggctgcat

SEQ ID NO: 654962 - DNA, 256 bp, Homo sapiens
acctgcgactattacacaggaaactactaatcaccgtttttgatcgagtcacccccacagttacatattacttcaacagagatcctttccctcccatgagatatgaacaacctccggtttctcatgaacgtatagttcggtatagcgtcgtatacgaggataacatatgggccataggaaggcatctaaatggggactcctcttaggaggtcgatcctagcgaggcatgctaagcctttggcactgtgccgtcgat

SEQ ID NO: 654963 - DNA, 296 bp, Homo sapiens
ttttttttttaaagagaaacccggctcactttgtttcccaaggttggaatgcaaatagaatactaactgcattattcagcctagaactcctaacctcaagtgattcttccacctcagactcctaagttgttgggatttcaggtgagagccaccatacccggccaactacccttttaaagccatctcctgcacctggccacctcctctcccccagtccagttgaacttgtcagcaggctgcctcttcctcattaccacaccactgaaaagtcttgtcctgccataactgagcccaag

SEQ ID NO: 654964 - DNA, 146 bp, Homo sapiens
tgctctgagttcccaatcatagaggccacgcaataactgtctgctataccagtcagattgagcagcatctgtcaagagtttcagtcccacttgcagaggaaaggctctctggcttcggtccgtggcctctatgggtaccgagtctc

SEQ ID NO: 654965 - DNA, 456 bp, Homo sapiens
tatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacttcctgcagcagatattccacctgtaatagccctttggcactgtgggcaaaacccaaaggctagtgtttccatttattccatgttggtgtatggggtttccctggcaacttcccttaggccagactcactggcctaattcagagaggggattctcaatcactttatgcatgaatgattttgtgtatgtgtgtcataatattccgtcggatcttccgcagttttgtaagttatactgtaaggcccgtttttaaatatgg

SEQ ID NO: 654966 - DNA, 189 bp, Homo sapiens
gcgctacatgcggatgacttacactcacacggacaaccctgacaggaaataccagacagccttaggcaccactcgctctatactagaacagcaaatatcagtagtatcaccacagaaaggtgatggcaactgtagcactccgagctcacacagttcagctcctaacttctacaacaccaaacggagaaa

SEQ ID NO: 654967 - DNA, 154 bp, Homo sapiens
  misc_feature (27)..(27): n is a, c, g, or t
tcagttactaagtctcagcctctagcnctggaatatggctagagaacctcctccctggctatatccccatttgtctaacaggcccttagatggatctgtctcccactccgtgcgccatcccatcccgctgagagccacctgtacccttcaatga

SEQ ID NO: 654968 - DNA, 329 bp, Homo sapiens
ggtttgatcccaaaccccccccccccccctagttctcaggaaaaaaacccctctaaagcccttcttgcgcttgcccgaagaccaaaaaaggcggcccgatgcgtgtatcatcaagaaaggagaagaaccctggtggacatttaattgaggcccccaagggaatgcatgagagccctaggatttaaaatatgaaatggtggtttgctgtgtgaataaataattcctgaagaatgaagaagattaattttgggagttttttggcgaactttgatatgtggaaaaaggatttataatttattgtaagaagaaagttaaatattactagtgga

SEQ ID NO: 654969 - DNA, 227 bp, Homo sapiens
attatttgaatttttaaattatttgtttataaaaaaaaaaaaagcccaattgggtgggctgtcctgtgttgtgctgggcccccagtttgtagtttgcctttcctgtgttggaaaggttgtgagtcctgctggtcaccccccagcctggtccggcctccccttttaaaaagggttgagccttttggggtttcaaacggggaaccgttccaataaaacaaaggggcaga

SEQ ID NO: 654970 - DNA, 357 bp, Homo sapiens
catagcgcccttttccctgtcgctgtgctgctcgccgtgcccgccatgctgtctctagactttttggaccatgtgcggcggatgagacaagcggcagctctattatcaaggcctaaattttggaatgagtggctcataggcactaatgatctggaaggggttaatggtaataactggaagtgaaaggccgaatgtagtggtgctcagaggcagcatggaacctgcgtttcatatgaggagaacttctctttctaactcgagttgaagataccataccagtgggagtggtggttttaggatagaaggaagagagagtcctataggtcaccgagtcttggattcatgatgccgcggcct

SEQ ID NO: 654971 - DNA, 115 bp, Homo sapiens
tgaacattcgtgtccccatggcgggagaacatgctactgttcttgtcccccttttttttagatatgtcaaaaaaaattaagttttctagtcctgttcttttttttcttttaaacg

SEQ ID NO: 654972 - DNA, 715 bp, Homo sapiens
caggccgcccgccgggatgcagtgggccgtgtgccggcggctggcgcgtgggccgcgctgctcctggctgtctgcatcggtgctgacccaggtctgtctggctctggcgtggtgtacgcaccacgccttgcgtacttccacgcgcggaagcatgcatcgcctgcagctctcgcgcgcggccacgtagcgcctgcgtgctgggaccacggaggctggccgttctctcgatctgattctgtggagggctgctggcgtgctgctgcccagtgctcacggtgcttgtcccgaccgaggtagctgctactgggtgttcgtgaatgcgggtggctggatgggcgccatgtgccttctgccacgccatctgctggtccgacgtagtgtcgctgctcttacggcacccggcttgggctcccgcggccactcggggcgctactggttctgacgactctcgcgcatcccatcactctctgggacctttccagccattggcgacgacgcgcgtaccaccaagaagtgaggtcttctagcctagcgggagacggtacgtacacgggcctggtgattgccacagctgtgcgagtggtgggccaagacatcactggatggtggagtacggccggggcgtcatcccatccaccctggccttgcgctgctggtccgacactgtcttcagtcacccatgacttcctcatgcctcttctatactcttcggtct

SEQ ID NO: 654973 - DNA, 115 bp, Homo sapiens
aacagaggatcaccacgcatctccccgacaagcaatctcgcactgtcataagatgtcggtggacttatgtgacctttgaatcgaacatataagcaaatctcaaaacacactgtag

SEQ ID NO: 654974 - DNA, 356 bp, Homo sapiens
tgtggctgggggggaagattgggccatgaagtggcagcagagggcgtctcacactgcgggcacggccccctctgagggcgagttcatcgacgtgttccagaaaatcaagctggctgattaacttgcttggcaaatgctgcagacagcacatccatgaaccccatgcgccgctggagctctgttgccacttcctcttcgtggcctcgtggaccctggtgccttggggccgtgtgtggcatgggtgctgctgcatgggtggttggcccaagatggcctcttgcaggcatctcccctgggggtcgggggtttggggcaagaagtgttgcctgcctttgggcaggccccggttcacggct

SEQ ID NO: 654975 - DNA, 1108 bp, Homo sapiens
ctggacctgtccatgccccgtggaccagtactcccccagctttcccgacaccgcggatctctacgtgctcctcaggggaggattccgtcttctctcatgagccgctgccctgaggagccctgcctgtcgccctgacatcccgagatccagacttgccaattggcgtgagctcaaagctgcctgcgtagacgtgccagctccagcactgccgctccccagactccagccgtacagctgtagagcctcacccagcagcccctgctgggcccacgcacctgtcgcgtccctgtcccctttcctgctggcaggagccggctgcctaccaggggccttcctgtgtggcctgccttctacccactcagctcacctctccctccacctacctctccacctgctggtgagaggtgcaaagaggcagatctttgctgccagccacgttcatcccctcccagatgtcggaccaacagcccttccctgccaccaggcactgcctggagggcatggcagtgggagccaatgaacaggcatgcaagtgagagcttcctgagcttgcgtcctgacggatggactgatatgccttcacccataagccccgtcgcagtctggtggcaggtgccttgtcgtcagggctacagcaagtacggaggtcagggcttcgtgcctcgattgaaggtgacctctgcccagataggtggtagcagtggccttataattccgataactagtatggcatcgctgaccaaatgccctggtaccagcacgcaggccgccgccacatgccaggtagggcgccgcgttgtggagcctggggcccagccaaatgggcgtcagactatagcatcacacaccacactgctaccagccagaacacctgctgccacttacaagggccgctcccaggaattaccctcgggattagacggaccgcaggcggcaagacaagcggcgaactataggccacacaaaaagccgccaccacaaccagagcaagaaaacaccccatgaccaggccacagagcccaacgcggcgcccacagacaaagcaagagaacatatgtagcaccgccacaacatgacaaccacacaacacgaccagccccacaggaaa

SEQ ID NO: 654976 - DNA, 298 bp, Homo sapiens
ggagtgctcccggtgtcgcgagtacagtgctgatgttattgaacataaacactggtatgcaacgacagaaggcatgatcagtggaagatgtatcgaagaattttagatcccatctatccagaccggtgctcctcatgtatccactggccgagcgcgatagtgtccctacctcttctccagagcatcattcctttctatctgctgccagagccacaggtgccagtggagctccaaggactcactttctaaaattccacacctggagtgacctctagtcgctcagcattcctcgcaacag

SEQ ID NO: 654977 - DNA, 892 bp, Homo sapiens
  misc_feature (108)..(108): n is a, c, g, or t
  misc_feature (111)..(111): n is a, c, g, or t
  misc_feature (142)..(142): n is a, c, g, or t
  misc_feature (151)..(151): n is a, c, g, or t
  misc_feature (186)..(186): n is a, c, g, or t
  misc_feature (213)..(213): n is a, c, g, or t
  misc_feature (354)..(354): n is a, c, g, or t
  misc_feature (357)..(357): n is a, c, g, or t
  misc_feature (379)..(380): n is a, c, g, or t
  misc_feature (410)..(411): n is a, c, g, or t
  misc_feature (425)..(425): n is a, c, g, or t
  misc_feature (428)..(429): n is a, c, g, or t
  misc_feature (432)..(432): n is a, c, g, or t
  misc_feature (440)..(440): n is a, c, g, or t
  misc_feature (445)..(445): n is a, c, g, or t
  misc_feature (465)..(465): n is a, c, g, or t
gaagttggtgtgaccggcgggggacgccggtggtggcggcagggcggctggggggcaccgggccgcggcgccaccatggcggtgcgacaggcgctgggccgcggctgnagntgggtcgagcgctgtgctgcgcttcacgggnaagcccggncgggcctacggttggggcggcgggcccgggggggntgtgtccgcggggagcgtccaggctgngccgcaggaccgggcgcggagcctcgcaggttcgggctcgggctccctaaccgtctccgttcttccgcagtcggtggccgggctggcggcgcggttgcagcggcagtcgtggtgcgggcctggggctgcgcgggcccttgnggncgggcagtctttctggccttcnnggctagggctgggctcatcgaggaaaaacnnggcggagagccggnggnnggngtctcggnctgtncaggagatccaggcaatttntacccagaaaagcaagccggggctgacgcgtgtggacacgacgacgcttgcagggtttcggtggaggagtatctgatagggcagtccatggtaaggcctgcaagtgctgttgtgtttgaagcaccaatgcctacttggtcccagacactggggtgacaaagagcaccgggttgttccacggaggggccagtaccagtggcccaggagagggaggagcgactcgggggccggcttccctggctcagatgtgtgacttccggcggtctcagcgagcacttgaacaatggcagaattgtccggagcaatgcttggtggaagtggaccctaaacgaagcaggaagagcgcacaaacggcgcccacagcggcgggtcaactcatgcaccaaacaaccccaaaaggctcacccagttatcactctgtcttgtc

SEQ ID NO: 654978 - DNA, 266 bp, Homo sapiens
cgtctcaacagagatatctgtctcccatgttatataggtacccatgtcagagcagcactattcacaatagctaaacatgtggaagcaacccaggtgtccatccacagatgagtggataacaaaatgtggtatatacaaataatggaatattacacagccttaaaaagagaggaaatactgacacatgctacaccatggatgaacctggaggacattatgctacatacatttagccagtcacagaagaacgaatagtatatgattct

SEQ ID NO: 654979 - DNA, 111 bp, Homo sapiens
ttggtgatgatcattataagctatggagctgaatacgcggtgtggcacagattgcctccatggatctcgttaagtggatcatccagcagacaagcagtattaagtggatca

SEQ ID NO: 654980 - DNA, 121 bp, Homo sapiens
tggatgctggccaggccctacttttagccccttcatcatgtcatttcccttatgctggaactgcccccatgtggagtgggcaggaaggggcctggaaaaaataaaggattttggcagttta

SEQ ID NO: 654981 - DNA, 308 bp, Homo sapiens
  misc_feature (305)..(305): n is a, c, g, or t
ccccctgtcttcctacgcgagctggacgcccttcttactcacttgcttcttaaaaattcttacttctcttttacttacttacttcgtttatttattttctgagacgcagtcttgctctgtcgcccatgctggagtgcagtggcacgatctcggctcactgcacctctgcctcctggattcacaccattctcctactcaggaggctgaggcgggaggatcgcttgagccccaggggtttgcggctgcagtgagctgtgattgcaccactgcactccagcctgggcgactgtgagaccccgtcttanaga

SEQ ID NO: 654982 - DNA, 1207 bp, Homo sapiens
tccccggggtgcgtgttttcgcgtgcgcgcatgtttataacggtccccctttttgtcgcgggggtttttttctccgttttctcatgcgtgttgtgggttgtgccggtgtcgcattcgggtgttgcgtcgttttcccgggggttgttcacccgctgccggcgtggttgtgggtgtcccaccttgtgtgggtggtttcgctctcctcgcccctgtggtgttgcaccgggttgtgtttttttgtgttgcggggggtgtgtacccgctcttcgtttttttttcggcggtgtgtgtttggctgggggcacctccccagtttttttttggtgtgggttggccctctgtctgtgtgtggtgttgttctttgtgttttgtcctgtcgttgtgtctcttctgtccttgtgcgggttggggggcttcggtctttggtggcccctcttttgagttctctggtttttttttggttgtcctcctctccgtttggttgctggttggcctcccccccggttgttttgttcgtcgttccgcgtgctttgttgttgtctccccgtcgcgctgcttgttttttactcgctattgtctgttgtgtggcgctcctccgtgttgtcgcgcttcgtttgtgtgtattattttttgctccccgccccccagcgcggggggtttttttttttttgtggtgtcgctgacgtcggtgcgcgcccaccgctaattcactgcctctctcccccccgccacatcgttattatacatgtgcgtgcgcgggtgcgccccctctccccccgcaaattttgtccctccgctctcttcttttgtgttcgtcccctctcggttgtgggcgcggtcccttcctgcccgcctctccccctctcggtttctctcgtcctcctaacccctctctcgttcgttttctcctccgcgcgcgcggttgtttgtgttcccggcgggcgcccaccccaccccccttctctcttcttctttttctctctccccacatatatattttttttcccgcccccccgccgcagagagcatatatgtgtgtgtgtgtgtatatatttttgtgcgtgcgccgcccccccccctttttttctctctctcctctctctttcccccccccttttttttgcccggggggcccccccccccgctgggggggggggcgcgcgcgcgcgcgcgggggggggtcgtgttggcgcgccgcgtgcgtaga

SEQ ID NO: 654983 - DNA, 117 bp, Homo sapiens
aagtcccaatccgaaacacatagcgattactcacatcaggagtatcaatcacctgagctcaccatagtctaatagaccacaaccagcaccaaataattcaggcactgcttattacaa

SEQ ID NO: 654984 - DNA, 599 bp, Homo sapiens
  misc_feature (89)..(89): n is a, c, g, or t
  misc_feature (148)..(148): n is a, c, g, or t
  misc_feature (213)..(213): n is a, c, g, or t
  misc_feature (232)..(232): n is a, c, g, or t
  misc_feature (253)..(253): n is a, c, g, or t
  misc_feature (261)..(261): n is a, c, g, or t
  misc_feature (407)..(407): n is a, c, g, or t
  misc_feature (430)..(430): n is a, c, g, or t
  misc_feature (472)..(472): n is a, c, g, or t
ggagaagtcgccctcatcatcaggttctcctccccctttgacatcgctgtacctccacggccttttttgttattatgtccattactggngaaaaaggaggaatccaacaggtcaaaggccctttcagaagcaactccatttcattggntaacttatttccttccagagtgtcctgtttacatgttcaggcacaactgctttggttcaaaagtnacatctttagagtcgggcntttaagcaacatatcttgctncgaaacantggcagatgcctccactgagcttcagcaagtcatcctgatctccgtgggaacattttcgttgctgtcggtgctggctggagcctgtttcttcctggtcctgaaatttagaggcctgttttaatactggtttcacactccaccaagncttccctttctggtggaagagtntttaaaagacccaactcagcccatcttataggccttgggcangggcagctcccccaaggatgacgtctgggactctgtggccattttctcgtttccgggataggggccagaagatgttcttcacacgcttttgtccaaagcatgggccttgcccactggctccctggaa

SEQ ID NO: 654985 - DNA, 416 bp, Homo sapiens
  misc_feature (6)..(6): n is a, c, g, or t
  misc_feature (11)..(11): n is a, c, g, or t
  misc_feature (405)..(405): n is a, c, g, or t
ataaanggaanatgctccccaagggacctatgtgcagctcttggcccttggaatcctgtggctgggagtctgaatcctgtcctgcccatggccccctctttaaaaaaattttttttttaattaaaaacaatttaaggcccaggcacagtggctcacgactgtaatcccagcactttgggaggcccaggcaggcagatcacaaggtcaggagttcaagaccagcctggccaatatggtgaaaccccacctctacttaaaaagtacaaaaattagccgggtgtggtggtgtgcacctgtagtcccagctagttgggaggctgaggcaagagaattgcttgaacccaggaggcagaggttgcagtgagccaagatcacaccactgaactccagctggggcaaaataanttatcctactc

SEQ ID NO: 654986 - DNA, 129 bp, Homo sapiens
gagtcttatcaacctctatattcgtgaagcataagtcacaagcgttggattgttcaccactaatagggtttcgctgaggtcatttaaccctacgagcgcacgtgttaggacccgaaagatggtgaacta

SEQ ID NO: 654987 - DNA, 1718 bp, Homo sapiens
  misc_feature (1654)..(1654): n is a, c, g, or t
cgtatgcagcgccgcctttttttttttatattttggtggcatgcaaactttatttgggctatggatagggttacttacttggggttttccccccttatttattaagggagtgtttttgtggtgactcacaggcgattgagcgcattctcaggaaggaaaggtttagggaaaagattgcctcgcattttactcttagccattgtgtattcaaagtgtgagagcgcgcaggcgaagctatataagatttaaagaggtctccatataagacctcctgtgcctgtgtcttcgccacctctccctcttaaaggcagatatacacttgtgtaaccgtgtttctccctcaacgcaggagaggccttgtgaagcacttttacagccagatgtgtaaaattccccagaagtagaaaacacgggagaaaaagtcttcacaattaagagttaaatattttcgacgcaaaaaccaaaatttatcacagacagaataccaaaaccgacgaaacttttctccttgtgctttggtaaccgcccctgttgtcccccacaccccgttattaagggctcttcttttctccaccgatgattccccccgctgttgtggaggaggccccctgttggtgctaccacagaccaaggtgttgtgtgtgtgcgataaaaaatgcttgttgggaaacaagcaggcgcgacaacacctgtttattaaccgtcgggcccagatggaaaaaaggtccttgttgtaccccggggaaggaaaaatctttcctcccaatggccgtgtgttggtccgaaaccccccccttggttggtggcaataaccaacccatacgtgggggcagaaggcggcactacttgttggtggccgaagggagaaggcccccatttttacagtccggagggaggaaaaaagggccgtgtttgggcccactattgtgttggccgattcttccttttttcataaaggggtcggcccaaccaatgtagaacgagctgcccacaaacacccacatatgcctgttggtgtgctggtttgggtgccaccgaccgaggaaatgcattcatttcacccaacgactggagaacggggcgaggggggggacaaccccccctctcttgttttgtttcttttcacagcggcgacccacatgggtgggggggggcgacaagatcaatttaacgagcacatctgtttgtaataccccgagcgggtggttagtagagttataagaacaagcggctccgtttgtgagtaaataaacaacctgatcgatgggtttgtgtggctcctacatgtgagtgtgactcacctcgacggcgtaacaatacgagacgtgcgcgacgaaacatacacgcccaccgcctgttttgtggaaataacacacattccttttccccaacaggcaacatcatctcttattgtgtggacgctcctcagtttgtgtgagtcgggtgcgacaacacaccgagacaaacagcgatattttctcctcgtatggatccccccccacaaaaaggggggggtggccccccataagtaaaatcagcacatcggtcgtgacacgcacaaatcattttggcgaacggcagcagaaagaggtgctctccctggtgagggaagaggaacaaacaaacagtgtttctacccccatagttgtgaggngggaggggagcatcccaactataaaaactatcgcagatgtgggagtcgacgggggggaacaaaa

SEQ ID NO: 654988 - DNA, 109 bp, Homo sapiens
tctcatggagaccaggctgagatgagaccaggctgagcaagaacggaaacagacatttccattaagctaggtccagtgggatctggctaaattctatcaagagcctcat

SEQ ID NO: 654989 - DNA, 353 bp, Homo sapiens
gaggggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttg

SEQ ID NO: 654990 - DNA, 1369 bp, Homo sapiens
tggtttggtttggaaatggagtttcgttttggtcgcccaggctggagtgcaagggtgcgctctcttcggcttcaccgaaaccttctgtgccttcccgggtttcaaggtgattcttccgtgccttcagccttcccgagttaaccgggactacaggcgcccaccaccagcgcccagcttaattttgggatatttcgtgattaaaaatgtggggttttcaccatgtgttgggccaggctgtggctctcaaacttccgggccctcaagtgtgattccacccaatttcggcctcccaaaggtgcgtgggattatacaggcgttgagccgccagcgcccgagccttagaattgcaagtttattttataataagtgtgataaggtgccactctcggtatactcatgagggtctcataggaacacagcgggccatttctctttaagaaaaacaaaaacaaaacacaaacaacaacaacaacaaaacaacaagaggggcggggcgcgcgcgcctacaaagagagatatcccacagagaaagagggggagcacaaaaaatataatacacggatatatcacccccgcagatattctctgtgggtcaccaaacaggcggggcgcccccaataagaggagacgccgacgaataacaaaaaacgcacagacgcgacatgggcgccccgacagagtttcaaacaccccagcgcctccgcgacagcgtgcgacacacaacgcgtctaacaaccagggagcaaccctcttgggcaaagaagagcagccccctatacaaccacgcgggggcgggggccacccaacatggggcgccacaaacacccaaacggacagaattaaaggccccacaggggaaaactataaccatttcacagctagatcaaaggggggtgtcaacccccaagggggaacaattcaccgcgcccacctgaacaaacattgtgcgccacaccgagactagcacatctcacacactatttccgcgagagacgtaatataacatcatacagaacgcgccacaaacacacccagcaaccaccccaccccagacgacacaatccgagccacgaacatcaccaactcaacgaggcagaacaccgaagacgcacgaaacacaccgccaccaccaaccaaaacacagaccacacaacacccacacagagcgagaacgacgacagaaacggacccgacgagcagaccaaacacaacaaacgaaagaacaacaaaacaagcagccagaaagcacgaaaacgcacaagcacaacacacacacaagcaaacacaacagcgcagacagacaacacaaaacaaacgaacgacgaaccaaagacacgcagcagcagaagaacaaagatagacagaaaca

SEQ ID NO: 654991 - DNA, 366 bp, Homo sapiens
tccccccccccccccaggaaccccatcccagaatccttttttcctggggagtccttaaagcccctaaccatcccacactcttcactttcctttccccctttttcattctctgtacttaccccagttttttgcccttggttacatatccttcactctttttttttcatcccatccccccctaaataggtcaggtggggggggctgggaaaaggtgggggggggggccgaagtgaaggaagaataggaaggatattcccccttctgttttttttttaagaaaaattttttggggggagcaatctccccgtccctatcactgttgggggcctaattttttttctttaaatttttttaaaagcaagtcca

SEQ ID NO: 654992 - DNA, 132 bp, Homo sapiens
ccgactagcccgacagcgttcgctctgtaggcaagctggagtgcagtgcattgaggcctcgacagcctcaacctcctagggtcaaacatagcccacttcagcctctcaagtagctggggctacgggtgccca

SEQ ID NO: 654993 - DNA, 172 bp, Homo sapiens
acctacttcaccatactaccagacaacctagccaaaccatttacccaaaataaagataggcgaatgaaattgaaaccgtgcgcaaatgaatatgaccgcaaggaaagagtaaaaattataccaagcatataatatcaaggacaatccccatatcccctgtaatggtaaaaca

SEQ ID NO: 654994 - DNA, 241 bp, Homo sapiens
atgatccctgcgatgaggtaccggaaaggtagccgttactggtcaggacagtccctcctctggagaagtggtgagcccagtgggttgcctctccagtcaggatcctgtagagaccttactctctagcaatgcacacatccacacacttgctcacattgagcaaacacgttattgtaacgtgtcaccgctgggcctcattccagggttaggggacataagggattgaataagaacaagggtc

SEQ ID NO: 654995 - DNA, 323 bp, Homo sapiens
ttgttactgctagcacatcaatctgagatcaacctgtgatgctgcagattggtggggggaggggcacccaccattgctaaggcttgagtagctcacactgtaaacaaaaaggcagggaagcatgaactgggcggagcccaccacagctcagcaaggcctactgcctctatagattccacctatgggggcagggcatagtagaacaaaagacagcagagagcttctgcagatttaaacatccctgtctgacagccctgaagagagcagtggttctctcagcaaggcatttgaagcctgagaatggacagactgcctccttaagc

SEQ ID NO: 654996 - DNA, 106 bp, Homo sapiens
gaaattcttacagcaaagactattccttcccaaatttaattggacagactgctgagcaattgatgccctggaacattgtcaaaaacaatagaactgcaattaatgg

SEQ ID NO: 654997 - DNA, 242 bp, Homo sapiens
tgtaatgtcgcgtgagtatagtatgatgggcagtgaggcggcgcatatgatctaggcctataatattcgggagtatagtagccggtaaggtaaaaacggtacctctagaactatagctagcatgcgaaatttaaagcgctgatatcgatcgcgcgcaagatctgtcatgatgatcattgcaatgggatccatatatagggcccgggttataattacctcaggctcgacgatttatggcccat

SEQ ID NO: 654998 - DNA, 564 bp, Homo sapiens
ccaattcttcagcttccagtggagaagctgagcagagctggcgctttcctcatggatgcaggctctgtactgatgcttcgggttggaacaatctgtacccagacttttctcacccaagttctaggtgtccaaaactatgcatcaatcccacagcctatcacagaccttccagaactcgctacaccagactctgccagaatcctacctttcatctcttggcttagagcagccgagcccattcttcccaatactttatgtaataagggctgagagtcccatgacagcaaacttccttcaacacatgatagacgacagcacagactctgcattaccatactatgcattcctgttgcatataccgcacacaagtcgcctcactgactgaatgacgcaatttgactcatttttcaggaatgtcacgatagtgcagaatacctggaaatgcctaataccttctctctctcttatgtctgtggactaatgtgcatcattgagatgctctcactgtgatttcaccaacctctagcaactaacagaccccaccagagaatcacaacatgccac

SEQ ID NO: 654999 - DNA, 1902 bp, Homo sapiens
gagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaaccccca

SEQ ID NO: 655000 - DNA, 1455 bp, Homo sapiens
ccatgcagcatgatctgtcctaggctcatcaggactgcgtgcttcctttctgcttccagagagaacccctcctccaaaccttggcgtgcgtcctcaggccagacccctcacctgcacatctcccagccagtaactgtaaagggaagggcccctgatggacgcaagatgacgcatcttgctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgagatgaaacctatttgtaaggagatcttccccaggagcatttctgttgccttcttgacatcaatgaaaagtagcatattctcttatgaaatagcatgagaaaacacagggcatttctaggacagtaaaacgttaaagtactggattaagaaaacaacaacaggctgggcgcagtggctcacacctgtaatcccagcactttgggaggctgaggcgggtggatcacctgaggtcaggagtttgtgaccagcctggccaacatagtgaaatcctgtttctactaaaaatacaaaaattagctggatgcgatagcacgtgcctgtagtcccagctactcgggaggctgaggctggagagttgctcaaacccgggaggcggagattgcagtgagccaagatcgcaccgctgcactccagcctgggtgacagagcgaccctctgtctcaaaaaataataataataataaataaaacaacaacaaaatgcatcagagagccaaaacattcagtattgcattttcacataggtgatgaaatgactttggaactttatctgtgttatagttatgagttgctttgggagacttggagctctctgtagctattgttcataacactttgctccataaccctgatgtccgcagtatctaagtatctcagccttcatccattaactctactagggagcccacagccaccatttccactaggaggtatcaatatttgtggtatgacataaggctcccttgaaataacaagacttttgagcaatctgaattaaaaatacatcaaaaaagtaatagcgctcatttgctaaatgcaaaaaataatcacctttgataccaatgtgcaccaatatgcctaactagctagccagctggagataatttaccagggaatgtttcaaagccctaaccttgaagtttggaaacaggtggtcttctatgctgcagagaaactatgcattaggtctcttttcaattagaaacctttactatttccaatgtatgtttgttaaaaataataataataaaaccaaaagcctttgtggaaaccccca

SEQ ID NO: 655001 - DNA, 1135 bp, Homo sapiens
gagccagccaagatcacccaggagcttgtgcccccagatgggccaaagaaagagcctatgaaggagaagcagaagcagacggctggcctggctcaccttcccacgccagtggggcaggggtctgcttcaggaaatggaagctgtccaggaaatgagcagagattcacaagacagcactttgattctatgttgagtttgtttctatattagaaaagcagcaagtcagtaatcccccgtggcatcacagctaagtagctgtggccaccggcagtttcacagcatcctgaaagctggcactgatcgtgactatcagtgaaagaagtttaattttcaggttagaaaatgtgatctggcagtttatgcattcttcagagtaatgtaataatacctatgtgatgctgtaattttacttttcaacataagttgaacccgtagcagtctgtttaccttgtaaagggattacttagaagacatttttgtacatgctcttccccaaggattgtacgtattatacaaatagatggaaagaaaagtgaacacgtttgtagaactttcataagcacacagttgctgtgttgagttctctttaaaaacaaggacaaaaccaaccagcgttcaaaggaacctcccatcagagtcccctaaagtattttaggttcagtgagcatttgcctgaataaaacctaaaagagtagtcttaacacattactaactttttctaagagaaattgattcctgttttgtcatctgatgcaatttgctcttataaagagacattttcataggttcagagtaactcacctccatgggctgaccaaaggcttttctaatttttgttactgatgggagtcttctcccatcagcctcctgagcagctgggactacaggcacctgccaccatgcccagctaatttattgtatttttagtagagacggggtttcaccctgttagccaggatggtctcgatctcctgacctcgtgatctgcctgccccggcctcccaaagtgctggggttacaggcgtggcccactgcacttggcctttttttttttttttttttttaaaaacaagttctccctttttcccccgggttgatttggattgggccaattctgggcctcccaagagatggt

SEQ ID NO: 655002 - DNA, 182 bp, Homo sapiens
actgttgttcatacctgcactgtgttcatactggtcgctgtatcgcgggggtaggggtatgaacaacagtgcaggtatgaacaacagtgcaggtatgaacaacagatgcaggtatgaacaacagtgctggtatgaacaacagtgcaggtatgcacaacagtgcctgtatgaccaacagtgca

SEQ ID NO: 655003 - DNA, 405 bp, Homo sapiens
  misc_feature (74)..(74): n is a, c, g, or t
  misc_feature (330)..(330): n is a, c, g, or t
tttcacctgagttcaggagttcgggaccagcctggccaacatggcctaaattccgtctctaacttttaaatacnaaattagctgggcgtggtggcgtatgcctgtactcccagctactctggaggctgaggcaggagaatcacttgaacccaggaggcggaggttgcagttagccgagattgcaccagcctgggcaacaagagtgaaactgcatctccaaaaaaaaaaaaaagaattgcccatatatttgaaagtcaagaggctgggcatggtagttgcctgtactcccagcatcatggtgggtgcctgtactcccagcactttgggagnccaaggcaggaagatcacttgagcccaggagttcaaaaccagcctgggcaacatagtgagacccaatttctacca

SEQ ID NO: 655004 - DNA, 583 bp, Homo sapiens
  misc_feature (9)..(9): n is a, c, g, or t
gaatcccgntgcggcgaggggggaggtgtaaatatctcaccgccggtccgattagccttttctctgccttgcttgcttgagcttcagcggaattcgaaatggttggcggtaaggctggaaaggactccgcaaaggccaacacataggcggattcccgctcgcttattgggggggggcatctcccagtgggccttattcatagacacctaaaatctaggacgaccagtcatggccctgtgggcgctactgacgctgtgtacagcacagccatcctggaggacctcaccgcagaggtactaggacctgcaggaaatgcatcaaaagacttaaaggtaaagcgccttacccctcgtgacttgcaacttgctattcgtcgagatgaaaaattgcactctctcatcacggctacaattgctggtggtggtgtcattccacacatccacaaatctttggttgggaaggaaggccacccagaagactgtctaaaggttgcctggattccttgttttcttaggactatataaacacactttttcctttttggattttttttaagcaaggtgcgagtttattatgcttccaa

SEQ ID NO: 655005 - DNA, 689 bp, Homo sapiens
gccgggcagtcaggtgacaatggtgcaggagacctcgtggccctccccgcgcgtgccgcccgaagccgccgctgagcactgggaagaagacgcatcctggggccccgcactcgcctggcgagtgctggtgcccttcgcgcgaactgcttcgaggcagctccgtggtcttcgctgccccagcatgcgccgcgttcctgagcaggaagaccgatccggcaccacatctacgtgctccacccaggtggaccacttcaggttcaaccgggcagcgctcatcaaccgctgggacttcctggcagagcagcaacagcacaggacatacagttgaccatgcaccgaacgtttgacccttgctatccccttctcaaccataggacgcgtggactactgcgcattatccatgaggcatgggcccattcccacgtggcactctccactggaagcgtccaacccgtctctaccacctacaacgacctactgtctggctgcgcaactccttgcattgcgtctccaaggacagcacgtaccgtgcctgtgccaactggggcatggtcccaacccgcttccgtgtggtgcctggcggccgcgaaggcaccgaccgagctttcttaccgggccgcccttaacgggagccctgcggcctccatgcatttctcccgccccctcggcgcaatcacaagctgggttac

SEQ ID NO: 655006 - DNA, 286 bp, Homo sapiens
acatgatagcttttttcatgtcagccatactcagagataagtgggaaaaactcctgtctagttctcccacatctgccatgaaagttactagggttcttataggcttttcttctgaattactatagcatatatttaggattatccctatttcatctgaaagtttttatttaaatgtactgcttgtttgcacatgtttgtttaagttttgctgaaatcttaagtatcattctaaatgtactgcttgtttgcacatgtttgtttaagttttgctgaaatcttaagtatc

SEQ ID NO: 655007 - DNA, 112 bp, Homo sapiens
tttagtcttatgatgtatcccctacacactgcacacacactgctgaacacagcacacaaacgcacagcacactgcacacacatgcacacacatgcacagacactagcacact

SEQ ID NO: 655008 - DNA, 220 bp, Homo sapiens
tttgtggtatgcccgtgcagccttcaagatgggtttgcaattcggtcacctccagccaccacaccaatcacagctctgttggctgaggagataaccttcttggagccggtagggcagcattcacacgtgggtcttcttggatctcagggctcttggctgatgcgaagtgtgtcatggtgagtgagggtctatggtgagagggcgagaagcatggaagctg

SEQ ID NO: 655009 - DNA, 116 bp, Homo sapiens
ccagtagtagggagagtgacgggagagagaggagacgtcgacatcagatcttcaatcaaagccatgactgtcaattacagtgtttagccttcagaaacactggagttaccctctga

SEQ ID NO: 655010 - DNA, 921 bp, Homo sapiens
  misc_feature (51)..(51): n is a, c, g, or t
  misc_feature (344)..(344): n is a, c, g, or t
  misc_feature (352)..(352): n is a, c, g, or t
  misc_feature (355)..(355): n is a, c, g, or t
  misc_feature (362)..(363): n is a, c, g, or t
  misc_feature (367)..(367): n is a, c, g, or t
  misc_feature (369)..(369): n is a, c, g, or t
  misc_feature (371)..(371): n is a, c, g, or t
  misc_feature (374)..(374): n is a, c, g, or t
  misc_feature (383)..(383): n is a, c, g, or t
  misc_feature (385)..(385): n is a, c, g, or t
  misc_feature (390)..(391): n is a, c, g, or t
  misc_feature (393)..(393): n is a, c, g, or t
  misc_feature (396)..(396): n is a, c, g, or t
  misc_feature (402)..(403): n is a, c, g, or t
  misc_feature (406)..(406): n is a, c, g, or t
  misc_feature (409)..(409): n is a, c, g, or t
  misc_feature (418)..(418): n is a, c, g, or t
  misc_feature (439)..(439): n is a, c, g, or t
  misc_feature (454)..(454): n is a, c, g, or t
  misc_feature (522)..(522): n is a, c, g, or t
  misc_feature (534)..(534): n is a, c, g, or t
  misc_feature (540)..(540): n is a, c, g, or t
  misc_feature (543)..(543): n is a, c, g, or t
  misc_feature (545)..(545): n is a, c, g, or t
  misc_feature (556)..(556): n is a, c, g, or t
  misc_feature (580)..(580): n is a, c, g, or t
  misc_feature (592)..(592): n is a, c, g, or t
  misc_feature (679)..(680): n is a, c, g, or t
gtgaaaagccatctttgcattgttcctcatccgcctccttgcccgcgcagncgcctccgccgcgcgcctcctccgccgccgcggactccggcagcttatcgccagagtccctgaactctcgctttctttttaatcccctgcatcggatcaccggcgtgccccaccatgtcagacgcagccgtagacaccagctccgaaatcaccaccaaggacttaaaggagaagaaggaagttgtggaagaggcagaaaatggaagagacgcccctgctaacgggaatgctaatgaggaaaatggggagcaggaggctgacaatgaggtagacgaagaagaggaagaaggtgnggaggacngangaggagnnaagnangnacngtgatggtnangcaannangcntggcannatncangatgcaggnacgctgagtcagctacgggcnaagcgggcagctgangatgatgaggatgacgatgtcgataccaagaagcagaagaccgacgaggatgactagacagcaaaaanggaaaagttaanctaaanaananaaaggccgcgngacctattcacctccattcccgtntcagaatctaancgtggtcaccttcgacgtagagaggcccgccgcccaccgtggcagtgccccccccgcagatgacacgcgctctcaaccacccaaccnnaaaccatgagcaactttcgcaaccagggggaggacacacaaagaagctccaaaatcttcccaaaggccccggacttttttctttacacagttcctctccccccggcaaacttgcttggacttcgcattccacttcctctacttctggtcacgtatctggttagggccacccctttcaatgatctcgtatgaccatcctgcttcgaggcttccctgccctcctcgacttaccttgtgtgtac

SEQ ID NO: 655011 - DNA, 210 bp, Homo sapiens
  misc_feature (25)..(25): n is a, c, g, or t
  misc_feature (30)..(30): n is a, c, g, or t
  misc_feature (53)..(53): n is a, c, g, or t
  misc_feature (58)..(58): n is a, c, g, or t
  misc_feature (74)..(74): n is a, c, g, or t
  misc_feature (87)..(87): n is a, c, g, or t
  misc_feature (93)..(93): n is a, c, g, or t
  misc_feature (95)..(95): n is a, c, g, or t
  misc_feature (101)..(101): n is a, c, g, or t
  misc_feature (106)..(106): n is a, c, g, or t
  misc_feature (121)..(121): n is a, c, g, or t
  misc_feature (125)..(125): n is a, c, g, or t
  misc_feature (135)..(135): n is a, c, g, or t
  misc_feature (140)..(140): n is a, c, g, or t
  misc_feature (149)..(149): n is a, c, g, or t
  misc_feature (157)..(157): n is a, c, g, or t
  misc_feature (168)..(168): n is a, c, g, or t
  misc_feature (179)..(179): n is a, c, g, or t
  misc_feature (181)..(181): n is a, c, g, or t
  misc_feature (184)..(184): n is a, c, g, or t
aatccatttcccagtcatctgtgtnttttntaaggccagccacttggtccctngttgnaggcctggactatggnaactaaatacagntgcttngntcttgncctgntccttccaaaatcancaancagcacttgntctcntcggctccnagggaggntgtcaatttcntatagacaatntnagnaagcctttcctgcatttcctagcatg

SEQ ID NO: 655012 - DNA, 126 bp, Homo sapiens
tggtttttttttttggggggggggggtttaaaatacttggtttttaaacccggggttttttaggggaaaaaccttggccaaaattttttcctaaatttttaaggccctttaaaaattttaattaga

SEQ ID NO: 655013 - DNA, 901 bp, Homo sapiens
  misc_feature (206)..(206): n is a, c, g, or t
  misc_feature (213)..(213): n is a, c, g, or t
  misc_feature (625)..(625): n is a, c, g, or t
  misc_feature (722)..(722): n is a, c, g, or t
  misc_feature (726)..(726): n is a, c, g, or t
  misc_feature (737)..(737): n is a, c, g, or t
  misc_feature (755)..(756): n is a, c, g, or t
  misc_feature (763)..(763): n is a, c, g, or t
  misc_feature (815)..(815): n is a, c, g, or t
  misc_feature (817)..(818): n is a, c, g, or t
  misc_feature (841)..(841): n is a, c, g, or t
  misc_feature (896)..(896): n is a, c, g, or t
acatgtttttggcattgtgctcaactgaagtagtacaaattcttaactatgttcaggaattctcacaaaggcaatgtgatcagcgtggtgttaagattcatatatctatgaagaaacgaggaccagtggtgtttgtttttacgcttttcattttaaatttatattttatttattactttaatttttgtgagatacgtagtacctanactcgtntctatggattatatcactgattttgatgaaggcatgaaatgcacaaaaataacatcagataaatggttattaattgcctcaactattctgttctttattttacgaacaatactaataacattcttttagttacttaaaaatgtacaattaaattgctttgactatagtcactcccgaccagagaaaaaccctgtagacattagtcactcctcattctgtctcaaaccctctccctgaccctcagccctaggtagcaactacctagtgcgatcaatcccatatgcatagattaccatattgtggacatttcctataagcggaattgcacaataggggagctgttatgactgacataacacgtagcacaatattttcaagattcgtccacattgtaggcttacccacagggggnaaaccattttattgggggcttttagtaacaccggtgttttctccttccttacgtccttctttccttccttccttccttccttccttccttccttccngaantccttctttcntccctccttcctcctatnnctctctnactccttctgcactctctctttctatgcctaggtgcatccacattctgcgtntnnttggggaatcctcgacaggtgcngaaatttgtgtattgtaacatttaccgttatctctcttcacggctctcatcagtngtgag

SEQ ID NO: 655014 - DNA, 179 bp, Homo sapiens
tgcgcctcaggtatggcgagatgtagcgagaaactcgactacacgcacggcgtgttcacggttgaacaacacatccgtggcaagtgggtctgtgaggactgcgagaccctgatccaggcacctgttcctgcgcaggtcatcgataaaggcacccccggaggatcctctagtcgtcgacc

SEQ ID NO: 655015 - DNA, 609 bp, Homo sapiens
  misc_feature (609)..(609): n is a, c, g, or t
ggcccatcatattttttatagaagggtttttttcacaaagaaaaatcctgccaaacaactacaaatcaagaatttgggggcaaaaagctcaatttatacaatgtaaacccattgaaaaaacaaatgcaaaataaaaaaagctgttgatccatcaccttgaaaaattaacacaactaaattaggggctttagaaaatatgttcagcttatatatcatacacgtcatttaacttgaattttacaatttttaaactaatagaattcagatttattacttgaaataagggtatccccagctgtttcttataagggcaggcatattccatatacaatacaatttatttagcatagttttattcttttaagtaaaaattgttaggggttaaaagcctaagggaataaatatgccaagcgcaaaaattaataatggaaaaaacttatggggggattaaaaaactggataatggccaatactggattaaaacaactttccttttattcaaaacccatatatttggagggaaaactggtcctatgcccggtttttttttttggaagaaaaaatgggtttaaccatttttacaaaatggggggcgcaatttctttttcn

SEQ ID NO: 655016 - DNA, 1116 bp, Homo sapiens
  misc_feature (324)..(324): n is a, c, g, or t
  misc_feature (886)..(886): n is a, c, g, or t
agcgggacgtaggacaagcgccgtgccacagcgtcggaaatcgagccgtgggagatccacggggcgcgagtgagcacgcgtggagggaggagcaggtgcttctggtggtacgcgcgagtgccggacaagccatgcatggtcttactctcaggagtctcagtggtctatcactatgttatcatgtgggagccatgtttgtactgcttcatgaggacgaccgaaagcaggagaggcacgcgaagaacgtggaaaatagacagttgtgcatcggtccaatgaaagactggctgctagacgactaagcacagaaccggaggaccgtgnaccaagatcgccgcattgagtgaccgggctagcctggtgcctacaaaggacttggctcgagacattctacctagcagccatttaaggagccaacgattcccaacctggatgcataccgtatgcatttccagcagattggaactttgatgcctcgtgacctaagaggaaccgacgggatgccactttgatggacctatttaactacataaatatgaagccgatggtacaactgtacagcgcaagctactctagaaggcccgaggataaatattctcgtatctttggcgacagggatatctcgagagaaagcatgacgagagcccaccgtgaacgaatggtctattactcacggaatgccagatgttcttagaaagactacttttgtaagcgaagagacatgagacaatgactgggtggaatgcgctgtacagatttcgtggcccaaggggaaatacagaatgtatgtacgcaacactgactggagatctagtagacatgatgtggtaattatcgtacgttttcaataccccaaaacgcgtaattctacgcttgtcacgttgangagttcttaagggacaaacgtggtccacccgtttgtacctcacgaaagactggggatttcgggcgctagttatataacccccattattgtgaccagcgagtcattttcggggacgtaccccaaaatcccgctcggacctacgcggaagtacaaacatgtggtcaggctttggtatgcgcgaaatgttagccttgtccgcgcgaatgcagactaccagcggatacctaacg

SEQ ID NO: 655017 - DNA, 83 bp, Homo sapiens
gtcgacgactggaccctttggaagagaagccttgccagctttgggcctcctgaagaatgcagattacctggagcagggacttc

SEQ ID NO: 655018 - DNA, 189 bp, Homo sapiens
  misc_feature (7)..(7): n is a, c, g, or t
ccacgcngtcggggatgaggtgctgggagggatagaggggggctgcctggaccccagctgtgggtacagagaggtcaagcccacgagtatggcccagggaggacggagggagcccgacggagaactgtcgaggtggagggaagaggcatggtggtaggcatatcggacgggatagcgggggacgcgttg

SEQ ID NO: 655019 - DNA, 469 bp, Homo sapiens
tgcccccgggttggtccacaagaaggtgggcccggcccgggttcagcttggagaagctcagggggcccccattcaccaagaaggtggcccggccctcggcttttctgtggaccaagaaggcggacaagtccccggagtcctgcaggccaacgtgcagcgggtgaaggagtaccgctccaaactcatccttttcccaaggaagccctcggcccccaagaagggagacagttttgtttaagaactgaaactggccccccagctgaccgggccggtcatgcccgtccggaacgtttataagaaggagaaagctcgagtcatccctgaggaaaagaagaatttcaaagcctttgctagtttccgtatgggccgggccaacgcccggctttttggcatacgggcaaaaaaagccaaggaagccccagaacaggatgtttaaaagaaaaaataaagccctcctgggggcttggga

SEQ ID NO: 655020 - DNA, 236 bp, Homo sapiens
aaggtctgagcgtcacttggccaaacagtttaatacgtgtaaaacgcgagtgtgagagcacatcatcaccacagagcacacctcagtgatttgtacacttacttggtagtgtaattatttactctttccaaggtataagatcccacctggcaaaatcttcactcaatgaaccaaaaacactgtaattaacaaaatataataaagttccaccattgaaaactaaatatacacgaacc

SEQ ID NO: 655021 - DNA, 400 bp, Homo sapiens
tcgagctcggtacctattggactttcttcatttaaaaggagaaaaaaaaaaacctatacagtagtctttccttatgttcatggcacaaaaggagttcggcttttagaaacttggacactcaagggttaattttacaatttaagattccaactctataaccttttttctactccaaaacaccctgttaaagtttttctttagggatggtgtaaaaaccagcatttctggcacaattcacgggaatttttttcttggtaataaaaatctcttctcggtaaaaccaaaaacaaaacaaaacaaaacaaaacaaaaccaaaagaaaagtcctctacctatcagggtttcggcagctatgcttgtatttctgttttatagcaactggggggaagaaagtccatta

SEQ ID NO: 655022 - DNA, 767 bp, Homo sapiens
  misc_feature (25)..(25): n is a, c, g, or t
  misc_feature (89)..(89): n is a, c, g, or t
  misc_feature (98)..(98): n is a, c, g, or t
  misc_feature (115)..(115): n is a, c, g, or t
  misc_feature (159)..(159): n is a, c, g, or t
  misc_feature (174)..(174): n is a, c, g, or t
  misc_feature (176)..(176): n is a, c, g, or t
  misc_feature (178)..(178): n is a, c, g, or t
  misc_feature (189)..(189): n is a, c, g, or t
  misc_feature (199)..(199): n is a, c, g, or t
  misc_feature (207)..(207): n is a, c, g, or t
  misc_feature (211)..(211): n is a, c, g, or t
  misc_feature (214)..(214): n is a, c, g, or t
  misc_feature (218)..(218): n is a, c, g, or t
  misc_feature (233)..(233): n is a, c, g, or t
  misc_feature (235)..(235): n is a, c, g, or t
  misc_feature (238)..(238): n is a, c, g, or t
  misc_feature (255)..(255): n is a, c, g, or t
  misc_feature (257)..(257): n is a, c, g, or t
  misc_feature (268)..(268): n is a, c, g, or t
  misc_feature (276)..(276): n is a, c, g, or t
  misc_feature (279)..(279): n is a, c, g, or t
  misc_feature (322)..(322): n is a, c, g, or t
  misc_feature (324)..(324): n is a, c, g, or t
  misc_feature (328)..(328): n is a, c, g, or t
  misc_feature (345)..(345): n is a, c, g, or t
  misc_feature (359)..(359): n is a, c, g, or t
  misc_feature (384)..(384): n is a, c, g, or t
  misc_feature (386)..(386): n is a, c, g, or t
  misc_feature (408)..(408): n is a, c, g, or t
  misc_feature (436)..(436): n is a, c, g, or t
  misc_feature (524)..(524): n is a, c, g, or t
  misc_feature (548)..(548): n is a, c, g, or t
  misc_feature (700)..(700): n is a, c, g, or t
  misc_feature (720)..(720): n is a, c, g, or t
ggggaggggtcacaggatgctattngggcacctagaagccgacagctgccctccactgggcggctttgcaccatgcgcaggtatgtctngaccttgtncttgtctttcctggggntgtggggcagcccgtagttcttgggcagtgcgtcttggttgtgngggtttgtgtcagantngntgtaggtctgnttgggggtgngcccagtncggnggntgcngtcttccagggtccncntcngggtttggttgctttcntntgggtcttttnggaggtgntantcttggttgtcgggggtgtcttataccaggttgttggcgaacntnttcntggggagccgcacgggntccagccaggattngttgggcagcagggagttgcggagngntctagggttggatttttgttgngtttcctccatgttggagggtgtcggtntagggtctgggaggcagaagggggtctgggagtcttgcaggattgattacttctggtcctttggtgttgtaggtttcttcaaactccnggtaggtgtcaatggccagctggngcgcgcgatgggcttggagcatagcgtggtcaaaaagcctggataacggaacggtttggacggcaccagcctcttgaagccagggcaggcagagcagggcaaaagccaggagcagggacgtccgggagcctggagccattgccactaggtgngctgtccacaggaccctgantggttcggggagttgggccttgggatcctagagccggtctcttgtgg

SEQ ID NO: 655023 - DNA, 131 bp, Homo sapiens
gtagactttataaacaccgaacacttacgtgacactaaaatttatacaaaacatgtttctcttctggttggacatggtgccttatgcctataatcccagcattatgggaggccaaagagggtagtcacaga

SEQ ID NO: 655024 - DNA, 178 bp, Homo sapiens
  misc_feature (42)..(42): n is a, c, g, or t
ggtcatctagaggatcccgctcgaattcgacggtttctcaanaactgagccgagaatagggtctgatagcccagccaagtttaaaagcagaccacacacgaatgtagtataggttggtgcctgaaaatggcccatttcctggggttggttaagaaatccccggaatccatcccagaag

SEQ ID NO: 655025 - DNA, 297 bp, Homo sapiens
agatggggtcttgctttgtcacccacgctgaaaatttttgacttaatctactgagtaaaccaatgtaactgttgtagactattttgctgtaataattagtcttgaatgctttttgtataaccaatattttaacatacctaatacaatttgtttactcttcttggggctatcgcaatacagataacttattaacaaaatatcaaaccattgctatagctgctgttaaaacaggctgggtgtggttgctcacacctataatgccaactcttaggtgggaggccaaggcaagatgatccc

SEQ ID NO: 655026 - DNA, 350 bp, Homo sapiens
  misc_feature (16)..(16): n is a, c, g, or t
  misc_feature (36)..(36): n is a, c, g, or t
  misc_feature (60)..(60): n is a, c, g, or t
  misc_feature (103)..(103): n is a, c, g, or t
  misc_feature (105)..(105): n is a, c, g, or t
  misc_feature (111)..(111): n is a, c, g, or t
  misc_feature (113)..(113): n is a, c, g, or t
  misc_feature (154)..(154): n is a, c, g, or t
  misc_feature (177)..(177): n is a, c, g, or t
  misc_feature (239)..(240): n is a, c, g, or t
  misc_feature (252)..(253): n is a, c, g, or t
  misc_feature (263)..(263): n is a, c, g, or t
  misc_feature (276)..(276): n is a, c, g, or t
  misc_feature (311)..(311): n is a, c, g, or t
  misc_feature (345)..(345): n is a, c, g, or t
ttctctgggaaaactngagatgagaatctggccagngctctgctgtacagtcaccgtctnttgaattttagttttggcaccaggagtaccgttagctttcccntncttctngnccatttgactcatcagcacaatagggtcaccaccttaactnttaatttctaatctgatttactntctttagggtgtgtatgtaataaacattgacaggctttctggagccctcaaggtgcctactnngctggttccctnntccagcagcncccccacctcccntagcccccctcctctagcagcctctcctgcctctnctgagctccctccacgtgttccacccccttaccntgctg

SEQ ID NO: 655027 - DNA, 378 bp, Homo sapiens
gcttaccttggaaggatgagatgggaggatgtcttgaggcgaggtttgagaccgaccagccagggaacacagtgagaccccttctcaaaaaataaaataaaaaattagccagatgtggtggtgcacccttgtgttcccatctaatcagcacgcttaggtgggaggatggcttgacgccaggaagccaaggctgcagttgtgccactgtgctccacgcttggcaacagagcaagaccctgtctgaaaaataaaaaagacagacacagaaacacaaaaacaggcaatctctgccatcaggggagttatattccaatgagatcttgatggaaaatttggccctacctttaaggcaactttaccttcccagcttgctcagaa

SEQ ID NO: 655028 - DNA, 428 bp, Homo sapiens
attatgccagtggacagacagatgacctatttaagtagtgcgagtatatgacacactgcaggcattataatgtatcttgtttcaaatgccataaatcaataatagcagaaggccgaacacattttttgctctctgttcagcatattctctagaagatgaggtaaagcatggtcacaagtgcgaggcttatctgtgctacatgaacagaacagaagggaaagagctattataaaacgcaatatagttgggagtgcggaaagcatattataacagacattttagaaagatttacaaatgaaggttcgtgttaactaagttgcatacaatgatcataaggcatttctgcagtagctgttttcaatggacacgcctccccagtcctttagacacgtgctcaggggaatacaaaaccccaaggcataaggtgc

SEQ ID NO: 655029 - DNA, 115 bp, Homo sapiens
ctgcgcttcctgagcaggagctgagcaggaccaggccctgggtgctctcctctgccacagctctgacctgggcaggttggaaggtggcatcgtaatgtatgggggagcgatgaat

SEQ ID NO: 655030 - DNA, 126 bp, Homo sapiens
gaccgagtgggtcgctatggcgggtgaacccaccacactgcgcatgaagaagctgaactggcagaagctgccatccaacgtggcacgtgagcacaactctatgtgggcgtcctgagcagggaccca

SEQ ID NO: 655031 - DNA, 874 bp, Homo sapiens
ctcgggaggcggaggttgcagttagctgaggtcgcgccattgcactccagcatgggcagcaagagtgaaactccgtctcaaaaaaaaaaaaaattttttttttttataaaatggttactcatatcatatggtacgtatatttaactctggctggtctttaaaataagatgacacacttttatgaagttttataaaatcttacatttttaggggtcggtgtccccagggctgcctcactttttccctaaaaaactaggacccacggttaacctcccagcagatgcaaggatcatgcttctcgggagtccttagtcacttccattcttggcaagtttagtactggcccaaatttactcattctacagtgttactgcccttgtgaacgtttgtgacccatgtcacccaagagaagcaaacttttggttgccctagagacaacttcgggtgctgctctcagtaaggtctatgagtccgggggtctacgtatctgtaaattatcctctccatcaggtctcactgatcattagtgtgtctgggttttcttaccctaagatgtgttccgacaatcaaagaacgttcactattttttaattggaacatcgtttcgggaggcaaggtttttattttcttttgtggaccacgtttcccctgcctccaaggggaggccgggggggactcaagccgtgggttcacctcccggtcagtggtttctgccgcgcccgaggggggttgggggcgcgcccgcccggaattgtttaaaagagggcccacggggcggggtaaagagcatggacatactcggcccatgggtggtgccgcccttttttgttgtctgcaccctgcatgggggctactatggggcaacgcgagtgcg

SEQ ID NO: 655032 - DNA, 87 bp, Homo sapiens
cttaatagggacatggagaggagttagaacaaaactctgtctaataaataaaaataaaaaaaaaacgttagaagcttgaattcgagc

SEQ ID NO: 655033 - DNA, 560 bp, Homo sapiens
  misc_feature (2)..(2): n is a, c, g, or t
  misc_feature (313)..(313): n is a, c, g, or t
  misc_feature (315)..(315): n is a, c, g, or t
  misc_feature (321)..(321): n is a, c, g, or t
  misc_feature (336)..(337): n is a, c, g, or t
  misc_feature (352)..(352): n is a, c, g, or t
  misc_feature (354)..(354): n is a, c, g, or t
  misc_feature (364)..(365): n is a, c, g, or t
  misc_feature (368)..(368): n is a, c, g, or t
  misc_feature (372)..(372): n is a, c, g, or t
  misc_feature (379)..(379): n is a, c, g, or t
  misc_feature (385)..(385): n is a, c, g, or t
  misc_feature (387)..(387): n is a, c, g, or t
  misc_feature (390)..(390): n is a, c, g, or t
  misc_feature (392)..(392): n is a, c, g, or t
  misc_feature (395)..(395): n is a, c, g, or t
  misc_feature (399)..(399): n is a, c, g, or t
  misc_feature (402)..(403): n is a, c, g, or t
  misc_feature (405)..(405): n is a, c, g, or t
  misc_feature (408)..(410): n is a, c, g, or t
  misc_feature (413)..(413): n is a, c, g, or t
  misc_feature (415)..(415): n is a, c, g, or t
  misc_feature (417)..(417): n is a, c, g, or t
  misc_feature (420)..(420): n is a, c, g, or t
  misc_feature (426)..(426): n is a, c, g, or t
  misc_feature (429)..(429): n is a, c, g, or t
  misc_feature (435)..(436): n is a, c, g, or t
  misc_feature (439)..(440): n is a, c, g, or t
  misc_feature (442)..(444): n is a, c, g, or t
  misc_feature (449)..(449): n is a, c, g, or t
  misc_feature (451)..(452): n is a, c, g, or t
  misc_feature (460)..(462): n is a, c, g, or t
  misc_feature (553)..(553): n is a, c, g, or t
tnaaaaacatacaaagcggagcacggcaataaattaggtggtggccgcaggacggggcagggcggcggcggccagacacgggcccacatgtgatctgttttcaataatttatatcatgataaaaagcagcacaaaaaataaataatgaaatggaactgccaagtagcacagaagccagggtgaggcggtgtggcggcgtggcggcatagggggccggggtccccacgccctggaaacgcaaagaccttggatctcttttgggaagccggaggacggagacagaaaacaaacccacgtgacaaagagtccctcntntttttnttaaataaaaaaatnnatatattaaatcatnanaattaaattnnaanaatnttaaaanaaaatnanaananacntttnttnngnggnnnagntntnggnggttanatnttgctnnttnnannnttttnannatttattnnnttctccatcaaatcacttcattccaatttcatttataatcccacttcccacaatacttttacaccaataaccccaatactttacataaccntgccacc

SEQ ID NO: 655034 - DNA, 358 bp, Homo sapiens
ccccccttttttttaaatgggtttggggggaaaacccccccgccccaaccggggttcccccaggggggggtcccggcccccccccccgggggggtggggggggggtttttcctttttgggcccccgggggggggcccccccgccccccccaaagggggggggggggggggggggggggggttttttttaaaaccttgggggtttttttccccccaaggggggtttttgcccccccccaaaaatttagggggggaaaggggcttttcttgggggggggggttttttttgggaaaaaaggggtcccctttttttttttttggtggggggtttttttaaaaaaaaaaccccctttttttta

SEQ ID NO: 655035 - DNA, 283 bp, Homo sapiens
cccctggcagagcttagacaagtgttccatcacctagtgatcagtgcagggataagtcgtaaagtctcctgtaggctgagtgtagacaagagtttcctcccagggatgatcagtgcagagatatgtcacaaagcccctgaaagcagaaccttgacaagggttacatcacctgtttgatcagtagaaatgaatatcccaaagccccttgtagacaaagaacggacaaatgttacatcacctgggtgagcagtggagagatctgtcacaatgcccctgtatgcag

SEQ ID NO: 655036 - DNA, 409 bp, Homo sapiens
gacgtgaaggactttatgacttcagtgtctcgccgtttggatgcttgtattcgccggttctgttggccccgtcctgcctcagcggtttaaattattcagaaagacaacagaacgttctttttctacctttttcacaagtattgcgactgcttctatatgtaatttctcttttgtgaatatgtaaatgaaaacaggaggggaggcgttattgtacagtggtgcattttgggccttcggcggatatcaaagcttgttgtaatggatttgccatgcacagcgcattctttgaaatgtctttttttgtaaggaaacctcccaacgctctctcttgcatatacggaggggcggcgggaactctgaaaaggtactactccattaatacaatgatgccccttctcaagaatgaata

SEQ ID NO: 655037 - DNA, 266 bp, Homo sapiens
actagtataacaattgttgtactgaactcttgttcgatactgctgatcataaacatcctgtgtgtaatatttttttccaaaaaacgtagcacccttcagcaggaccctataaaactttcctccagcccttgcctctttgcaggtagccccttctctgctgagcagcccactgcaacatattttcacaatttctctaataaatctgcccttctttacctacaactatcttggtaaatggctttaccacctgcaaaactgaccctagg

SEQ ID NO: 655038 - DNA, 212 bp, Homo sapiens
caggtcaggtcctcggcacgcgtgtggtaatggggcacagttaggcctcctgccctcacctcacctgctccctgcagggctgcgacagctgtacacctgcccaattcgaccatgcaggccaggccagacgaatggggagtacggcccgtcctccatgggccagatgtcggccttccagctgagtgcagacaccagcagtggttccttgtcgc

SEQ ID NO: 655039 - DNA, 355 bp, Homo sapiens
cggtcagctagaggttgaagtcgtggcagtgtgtgacagtgtgagcatctgttacgccagatcacagtgaacacactggggagacgtgcttttttggaaaactcaaaggtgctagctccctgattcaaagaaatatttctcatgtttgtttattctacgtttactacttttcatttacaactcctttacggttacagtttaagcttttacaaagttacgtttggacgaacttgagaccacaaaactaatactgtaaggacattggtgacggcctttgaccttaaaaacctttcttggtacctgtgacattcctttgggggtgtatttgggctattgtaactttctaaaactacgg

SEQ ID NO: 655040 - DNA, 884 bp, Homo sapiens
gcgctggagttcgcaaaacgtgacccggaaatggtcacgagcaggcgccgtgggctttgtggacgcctaacttgcgcgctgagatttccgggcgtgggagcagaggtctgagtcttgcgtgggtcctctatagggtgagaagctgtggcgcgtcggttccgtgtcctcggtggaaagtcgctggcgcagatggggcccactggtggcctgggcggtggcggtctgctcttgggacccgacttgggtgcctaggctgcctggtagtcctggcggtcgcctgggcttggcgcggggcttcctcgggctggtcttgtggagcccccggccccgggctcttgttggtgtgctgctccaactctttaactgtgggcttgcggggcgcccttcggtagcggccggggcaccgggcgtgatgttacggaggctaagggcgctctggagaccctgacgattgggcgttcggggcccggggctcgccatggacccctggggccgcgtggtctcgcttgataagttgacaggctggggggacgtgacttggcgcctggcactctccagggagtttgccccacatcttgagcccatgtgaccgatgcccctgaggtcctcccgacttgggcgcgtttcagaagcggttcgggttttccatagaagagaggtggtccccggggaaggcccttcaagcgggttcagggagcttttgccctgggggtggttcgggcatggacattgcgcacgcgcaggagcggctcttgggcttgcgggggtgacacgcggttcgtgatccattttggccccaggggattcatgagcacgcgttggaggacggggcatcggggagcagcgggacaaacgtgtttgacccttgtggggcctttggggag

SEQ ID NO: 655041 - DNA, 177 bp, Homo sapiens
cgcaggacttctgtgggcagctcgtgctttcttggtgtcacggaatcgttctaggttcccttcttgagctgatttcttcaggaacagatggatagatggttgcactgaagtgccttgcgcatcccagaaccgaggccacctgcctgtcctcattgcgctataagcggtatagcctaa

SEQ ID NO: 655042 - DNA, 1212 bp, Homo sapiens
  misc_feature (845)..(845): n is a, c, g, or t
cgggggagaggatcgcttgaccccaggaggttgaggctgcgttgagctgtgatcatgccattgcactgcagccttggtggcggagcgagaccctgtctcaaaataaataaataagtttaaatgataaggtaatcctgaatgttgtttatttgtagcctaagtaaattatgtttcaaactggggcaaggtgataaagtttaacttgaagagcagagtcctgagaccctgggagattcagcttcaccgtcactctggatgtatggaacccactgttttttgtttttccaaagataatttcttggaccttttctcagaggtcttctacctaactcttcaattatttctgttgctagatcagactttcaccaaatgctcatgctgcttgagttgtctgggctatatgcctgactccatgctgagatacacagaaacctcaggccaaaagctgggtctccccgtcccccacatggttctgtgcacctgtgcattactcattccgcatgccattctctaagaacagaaatgcttgttctcttcaatgtcattgtgtccttggcatcctgcacaaggtctggcagttacgttgggttcaacaaaagtttgttgaactgaacaaagcaacaaccaagggttctaaaaactggagttgaaggttatattacaagcctgtctcctggtacctgatgtctttgacagtcttaaagcttgcatttctgtagccctgaatttaaatcaagttctttttgaaaccatgttaggtcatcatgcctgctgtgaatggattcaccaactttctgtaccattcattgctagtcactgaattttgatattcttcccccacccantctaaggataattgttattgtccagctccagagttccttgcctctaatgaaacaattgctgctgctttatgcagtagtttgtgtttatgtatgtgttataaaatcttctgtgtgactttcaattccttacatcatcttgcacaatgaatgttgattgaatttaataaaacataagctaacaaaagaatagcattatgtatttacacaataagtgtatagggttttttttttaaaccatttaagcctaaaaacaattgataaagtagctaatgtgggtagatacctcaattcaatgaaattgaggaaaatggggatttaagaagcttcttatgtgagaattaaccccggtctttctattcctgatgcc

SEQ ID NO: 655043 - DNA, 364 bp, Homo sapiens
gggggggggtttttttttaaaattttgggggggggcccccccctttccttttttcccctcccccctgggagggggggaaggaaaaaaaacccccccccaaaggggggtttaaaaattttttgggggggggggggtttccaaaaaaaaacccccccgagagggggtttttccccccccaaaattttttgggcccttttccaaaaaaggggggtcccaaaagggggggcccccccggtttttaaaaaagggggcccccccccctttttccccctggggggggcccttgttttttcccccccgggggaaaaaccccggggggggggggggggggggcccttaaaaaaattttttttgggtttcccca

SEQ ID NO: 655044 - DNA, 192 bp, Homo sapiens
attctccggaatccgtctctgtgtccgtcattgctgcatcatggggcaatgggcatgccgctctcagtcacgggcccgattccctcgtacttgagccagcacgaattcccttagcaccagcacgaattcagcaccagcacgaattcccttagcaccagcacgaattcccttagcaccagcacgaataccctt

SEQ ID NO: 655045 - DNA, 135 bp, Homo sapiens
caatggggaaggagatgcctgttacaacgacgtggattgggatggcattcccaatggattgtgacacattgtccctaaagtctcccacacccacatacagacagacagaggatgtaggcacgcggttgtgggaga

SEQ ID NO: 655046 - DNA, 272 bp, Homo sapiens
ctctgtatatccagatccttgtccagctcattgtccggttcgtgatgtctctgtctgtcattatccctatcattctctcgctcctgttcgtgttctttttcaagttctttctcacgctccggttctttatctcgctccctttccctaatatcctctggagatggttgattatgcaggacgccaagcttcacaccctattgtttcagatgctccgcacaagaagccttcctttgttgttacatttttagctcttccccttctgtcgtcttctc

SEQ ID NO: 655047 - DNA, 1266 bp, Homo sapiens
taggtgcgtttacaacgcagtctcgtgcgttgcctgcctccattctctgttgtgtgtaagaacacgcacttggtgttgggaagaacaaccacgcgagtagtttgatgaggctggtgtgaatgatgcatcccatcagcacgctgcttttgtcttgcgtgggcgggggcgggtgtatgtaatgtatttgttgtttgcactttcgtggtgtgcgttaatgaatctagtggatgtatatgatagtgatcgatatattggtggtcttgttggtggttagaggcatagatgtggaggtaagatgatgtactgtatggagttgtgtggagaaattataaagtaggtgtgttgtaacaacaacgtcgtgatccagcatcacatgtttattatgttcatccaccagctgtctgtagtgtttatagtatatcatatctcgtggtcgcctccacctccagcagatagtagtggtgcttctcctcctgctttagacgatcacccccccctctgcttcggaggagatgatcatcggctgctgttcccccctctgctgcgtaggagtagccccccagacggcgggtgcactgcgcgtagtgaaagaaaaggagatgtgtgtgctgttgtgtgtgtgtgtgtgttgtgtgtgagaaaagtataggtgtgtcacacactgctgtgtgtggtggtgccacacagcggtgtgtgtgaggtggcccacacgttggcgcacaaacactagtctgtgctctggcggtcactcgcagcaacactacctctctgtgtcactctccgcgggagtgtctacacagttgagattttgtctcctgggttgtctactaccctgctccacacaggtatggcgctgtggagacctactacacagcgcggccacatgtccacaccacacacaccgctggcgctataatgtgtgtgtggatatatgttgtataggtgtgaaaacacacacggaagtctcccacacagttgtgcacccgcatgtggtttctgaatttctcctgacacctctacaagtgagatccacacctgccgtctatacacctctaccacccggtaagtctcaccgccgtttcagaggagagctatataaagccggaagaatataccttgtagacccccgaagtttgaaaccccccctgtggccaaaattagcgagacccccgttttctccacaaaaaagggaaaataataaaccaaagacccaaaatatatataaaaatatatacgtcgagcattaatctcggtcgagaagagtat

SEQ ID NO: 655048 - DNA, 385 bp, Homo sapiens
tagcaggcgcaccgggtgaccattaatgcattccaagtggcctgagtatacccttgtgaactaactcattcgcaaatgaggcaaggacctctctttccttccgagcagtttcaccaaaccactggctcaaagagcctgactcagaggcctagcgaccggaattccactctgctaaacgtgcatttcccatctgccccaccctaaacatatcttaccaatgtcagtgtctttttttctgacctgacacaaaagcatgcatcatgacagcacacaaagggcccttgacacacttttcattgtgagctcacgccagttctccatcacaaagtgagctgaggaaccatctaccattaggagatcccataggaatgtcagcaaaaataga

SEQ ID NO: 655049 - DNA, 409 bp, Homo sapiens
  misc_feature (284)..(284): n is a, c, g, or t
  misc_feature (326)..(326): n is a, c, g, or t
  misc_feature (333)..(333): n is a, c, g, or t
  misc_feature (343)..(343): n is a, c, g, or t
  misc_feature (355)..(355): n is a, c, g, or t
  misc_feature (362)..(362): n is a, c, g, or t
  misc_feature (382)..(382): n is a, c, g, or t
aaggtgactcatgcctgtaatcccagcactttgggaggccaggagtttgagaccaacctgggcaacatgatgagactccatctctacagaaaatttaaaaattagccaggcatggtggcgcacctgtagtccccagccactcaggaggctgaggtgagaggatcgcttgagcctaggaggttgaggttgcagtgagccatgattgtgccactgctctccagcctggggcattcagagaaggcaagtaagagaagagctgaaaggggccccttgggatttcgatncatctccttgccagctcttgcttttgtgggaacttgtgggtnggaggtnggaaaacagntttacaacaggntgggggngaagccagggttagggaagncaggttttaaaaagcccagttacgggt

SEQ ID NO: 655050 - DNA, 339 bp, Homo sapiens
aagtgagaaaagagcctgtgatagagcagagcttagtcacgtgagacatgtatgcatcttcaaaggtctaattgctcaggcgtgaaacaatcctatatacttagccagctccatggcgtactgagatacatggtgccgcacaggggtaatatggtcatcttttatcagaacaacagtgccaaacggggatttaacaaatgaatattccatctgactttatttcccaatacactttcttttttaaaaaaaccatacactttctttgaggatgaccgcattaggaaatccaattatacacaaaatactacatctagtctggggtagatatatacatttttg

SEQ ID NO: 655051 - DNA, 1016 bp, Homo sapiens
gcatgattatcgtggtagaaggttagagggaaattctcaaacactgctggtagcggtataaattgctgtagacttttctagagtgacaacacgtatgtacttcaaggaacacacctttaaggatttcctactggacaggtccgttaaagataagaataagtcattacagtataatctatcgtaagtgaaaaactgactaggcaacctaaattatatgccaccatggggactgcttatggtaacattccatatacgtggaatcgctaggtaggaacgcgagatcggagaccaggacaacgtccattgttctacttggacctagataaccaggtgacgtttcaaacaaagtccaggcattaaatgctatggtcagggtatggagaaaacctttatgtcgtgcactgtggcgtggttgtcatcacaacctgtaatcccaggactttgggagggccgaggtgggcaagattgtgaggtcaggagttcaagaccagctctggcaaacatagtgaaaccccgtactctactacaagataaaacgaacaacacattcagatggggcattggtcgacagggggccgtagaccccagcaaacttgcgcaggcacaagggtcgcagatgcggccgagatcggagcccctgacatccagccgggtagacaacaggcgagaccacgtccaacagaagcacgagacaacacagacaaaaaaaagtgtggcgccgcggcccagaagccaaccaaacaacggtggggcggcgccaagagaaatcgacacggcacaagcgaccaagagaccggcgcacgcagggtgcattccacaaaaagccggggaccggtgcaagctagggtctggtctgctacagccacaacaccacccgacgcgaaagaaaagcaaagcacagagcgaagtaccatactctcacctgtcgaagaacaaacaagagagcgcacaacacaaccagagcgacgaaggaccagacaacagacagatccgaaaacacaaagctagagccaaag

SEQ ID NO: 655052 - DNA, 266 bp, Homo sapiens
gcataacagacgtggcagaaatgctgtgatctcttcatcctctggacgaactacgcctcaggcgctgtgaccctgggattgtggggctcttgtggtctcgtgtcctccatcctgtctattctcaccctaatctatccctggactacgattcaaggccctgactcttccgtgtacaggataagggacggggacctgtaattggtgacgatggaatctctagatcgtcccccatgtgccagcgctcattcgaagttctaactctttgg

SEQ ID NO: 655053 - DNA, 946 bp, Homo sapiens
cgaggacgtcacgtccgtacttgaacttgcagctcagggggctttgccatttttttcatctctctctctctctctccctctatctctcttctctctctctctctccctctttttttttattttttttttttttgtttttttgttaaaaaagcgagtggggtccccccaaattgtttccccggggccttttgtgtttttttcattttttggggttgttcaaggctgaaaatttttctgggggtccctttttttaccgggtttctccgttgataaaccggagcaccgtagctgcagaccgagcgacgccggcctgcagccgccagcacgccaggcccagtacccaaacatttgttctcggccgaaagaaagtgaataacccaatacattaaagaaaagggaaaatctcgcccgaaaccttttaaaacccatttcttacatattgatgaacaagagctacggccctgtgtgaagatcccaaaagggggattctataacctcctacacctgtgatgggacgacgacaaaataaatttcacatggggggaaaacttctatttatatcagtcaaaccccaacgcgggaaaaccacggagaggggaaccccccggctaacaaaaagggcgaggggataaaccccaccttcaccctgtagcaacaatggaaaggtaaaagaaccaactcaaccacgagtgagggagatgtggacaacccagggaccgcaccaaagagacagacaagattgtgaacacacacagtccatgcaaagagaaatgtgcgcccgaaacaggaggaccaccgattggcgaaaaacagatgagcgagggaggaggggcacaccccccaccctagtacgaacagtgaggatataacccccaccgcgaggacaataagtcacaaaatcgccccggagagacattgggaacaatgaacccaccagagcagtcca

SEQ ID NO: 655054 - DNA, 424 bp, Homo sapiens
gtcgaccaaggcgctgcgcgcgaggcaagcggctcaacgagaacaatataagcctgcggatcattggcgaccgctcgcgctttcaccccgagctgcaacggcgatgcgcgaggcggaacggcgacggcggcagcaatcgcttcattctgcagattgccgccaactacggcgggcagtgggatatcgcccaggcggctcagcgtctggctcgtgaagtccaggccgggcatctgcggccggacgatattacccccgagctgctgcagacctgtctggccaccggcgacctgccgttgccggatctgtgcatccgtaccggtggcgaacatcgcatcagcaatttcctgttgtggcagttggcctatgccgagctgtatttctccgacctgttctggccggacttcaaacacgaagccatgcgcaa

SEQ ID NO: 655055 - DNA, 512 bp, Homo sapiens
cttacgcccaaactctttctgctgcctgggacgggccgtcggtggatcagtgagtgagtctggaacacacacaatataataaccaagagaagtgggcttaagagggccataaaaacccatttaaatgagaacttcaaatgtagctttccctggtatccaggaaaataaagcacacaaggccaaataaagtaatgcgaactgatggtcagaataagctttgtagcccatgggaagtgagggtagaggtccatgtgtctcaccttgcaggtgagtgatcgcgtgcaggaccttttgctctccgggtcctggactccacagtgcttgttcgggtcaaacaccctccctgtaaacaccagacggagagaaaaaaaaaaaaccaggtcatcacggctgatatcagaattatgtctaccggagtaccacgaagacatcttttgccaatactttgtgactgacaggcgagaagttgtctacaaagtggtgtaataggcactacagtagactgttgtcgc

SEQ ID NO: 655056 - DNA, 172 bp, Homo sapiens
ccagaggtctccacaacgctgtcacagctgggcagcacagtgaagggattaagattttagcacaatacttcttactcccctccccaagtcccagtgcatggcacacaagagcagaaggaaatcctatgtaccctacaagtctcccatgcgacttgacaacacagaaagccaa

SEQ ID NO: 655057 - DNA, 866 bp, Homo sapiens
  misc_feature (99)..(99): n is a, c, g, or t
  misc_feature (101)..(101): n is a, c, g, or t
  misc_feature (107)..(107): n is a, c, g, or t
  misc_feature (109)..(109): n is a, c, g, or t
  misc_feature (111)..(112): n is a, c, g, or t
  misc_feature (115)..(115): n is a, c, g, or t
  misc_feature (119)..(120): n is a, c, g, or t
  misc_feature (131)..(131): n is a, c, g, or t
accatgcgtcgagacggtctctccgcggccaggagagagagaccagaagtgaacggctcgagagatggatcatgacccatgaagagcagcatgcacaanancttatntngnnacnattnntgtcttacctntggtggagatgcccaaggtatgaatgctgctgtcagggctgtggttcgagttggtatcttcaccggtgcccgatgtcttctttgtccatgagggttatcaaggcctggtggatggttggagatcacatcaaggaagccaccatgggagagcgtccgatgatgcttcagctgggaggcacggtgattggaagtgcccggtgcaaaggacttcgggaacgagaagtgacgactccgagctgcctacaaccttggtgaagcgtgggatcaccaactctctgttgtccatttgggggtgatggcagcctcactggtggctgatcaccttccgttactgagattggagtgacttagaagagggtgacctccatgaaagcaggtaggatcacagatgcggacggctacgaagtccagataccttgaaacattgtggggcctgcttggaatccacttgacaactgacttctgtggcccctgatagtgaccaattgtgagaaacttagcctccttgcccctgaattcaggattcaatgcaaaccttgctagattgccaataactatccacgtgccgcagaagccatcccagaggcaatatgtgtacaatctaactgggcgcgcccgtggctggataccttggccctgatacatctacatgtcctttgaggccactgcgattcagtcctgaatgtccccgatgacaatggaggaaccacatgttccgaatacacagaataggac

SEQ ID NO: 655058 - DNA, 881 bp, Homo sapiens
tgcagtggctcacgcctgtaatcccagcacttgggaggcaaaggcgggaggatcacgaggtcaggagatggagacaatcctggctaacacagtgaaaccccatctctactaaaaatacaaaaaaattagccggacatggtggcgggcacctgtagtcccagctactcaggaggttgagacaggagaatgggtgaacctgggaggtggaacttgcagtgagcagagatcgtgccactggcactccagcctgggcaaaaacagaaagactccatctcaaaaaaaaaaaaaaaaaaaaaaaaaactcaatctttaaaaaatataataagtcttagtcatatgggtagatattattgaatgtatcatttaaaaaggacatttgccaggcatggtttatgcttgtaactcacagtctttgaaaggccagaatgggaggatcacttgaggccaggagttccagacagtctagccaaatggaaaacatgtttctactaaaaatgcaaaaattaatcaggcatggggcgcaaagatacttgggtagcataaacggtgaacctgaagaagcagaggatgcactgaggcaagatcggacattgactcagctggaaagtgagactctgttcaaatcggaagtcataaataaaaattaaagccactttgtaattttgcaccattagattttataatggaagcgatataattaatggtcatggatcatatattatgtttaacaatttgggggatggtgcataccgttacacttgagacgtgggaactcaggcaggaaagaaggggacggtataaaaaaagagggagacgatcaatcgaggaaaatgatgagcggggaataattattggtttgcctcaacgtatgttctcagcgt

SEQ ID NO: 655059 - DNA, 906 bp, Homo sapiens
agcaggcgcgcgggtggcgtcacgccctggtaatcctcagttctcagtggaggtataagtagtgcgggtaggatagtcttgagtccactagagatgatttggatgagcatgccttgggcaaattatagacagaggaccgccggtgtcatccagaagacagataaatagaacaaaaatcacaagaatggaagatacttgatgggtcactcgcacgcttggagtcctattcgaaacaaggagatgtcctaagagcgagctcggatgagtgcgagagagttgacggcccacagacgcgtgaggggagacaaggtggggtccaaaagagcgcggttcccccgagagagagagaacactcgggggccacaagagaacaagaggcggcggggggacattctctccacacaaattataaaaagagcgccgcgggggggggaaacaccgcggaagagaggtcttctggaaaaaaaatccccaaagagggagagtcatgacgaggagggggcaccaatcaagggggggacctaatatataaacaggagggagaccaaaagggaggagcccgcaagtatatccaaaaattatcagcgcgcccccgagccttgggggcgcacacaaaagcacacactgacacaccacagacaccagagagggacggagagaaaccaataaacgagaaaagagtagaagagaaaaccgggaacacacagtgaaaactataccagagaggagacgccgatgccacgttaaaaaacataagagaacaaagagacaacgacagcgacgaccacgcaggccaggcaagccgcacgagcacgagaaacacaacagcacaccagaacaaaacgataagacaaaagcaagagatgacaggaaagaacacaccgcgacgacccagtaagacacctg

SEQ ID NO: 655060 - DNA, 503 bp, Homo sapiens
catatatataactgtacaataaaatatataaaatgtaccatattacatactaacaatcatcatcttcttcctcttcatcgctgatcacatacttcttatgctttaaatttgcttatatcatcatcttctgctttactcttaccggaaggttcaccttcctcatcactggaaagtaacttagcttagagtaatctttgagcttaatcttcttctgatccctcatcactgtctgatgaatagattctggctcgtacctctcgaatgcccccttaatatcggttataaatggcagccaagctagatggaactcctcgccttcctcctcctcatcgtatcgaacaggtaccaggtaactggcgctcagccccccgctgttgctgtacctctctcatacgggcgctgcagagataccctacgtatggaagccctcaaacgttcttcttctttctatatcatttctgtgcgttggcatacaggatcacgaccagccatgtgcaggattc

SEQ ID NO: 655061 - DNA, 522 bp, Homo sapiens
cgggtcgggttcaaggggtgccggaacttgtccaatttttaaccacacaaaaaaaaatgtttccgataaaataaattaaagcgtactttcccagggggaaccaaatcctaaggaaaagttgcgagagtatacatataaaagaaggttctcgcatcgttaagctctaaaatgaaatatgcacaagagtatcttaaactgcacatcagcgaggctacactgagcaagttttccgagaatatgaagatgtaggcatgcaggcctgatggtttgcacctgtttttccagcacttggggaggacaaaaccacctgcaccaccacaggcagggagtttgagaccacgcgggcccacataacccagcccaggttgctcagaaagatagaccatgtccccaggcaggttgaaaggtacttttactcccacaggcgagtaaggcccactcaaggtaatgacctcaacgtttgtttggacaaagaaacttgggccatggggcctcaattaattaggcctcggaaaaaaaaaa

SEQ ID NO: 655062 - DNA, 109 bp, Homo sapiens
  misc_feature (61)..(61): n is a, c, g, or t
gccaattatgaatactgtcctcgctgctgcaagtattgtttatcgccagttctggccgccngtttattgcctgattttgtgagggccatggcctcgcccattattggtc

SEQ ID NO: 655063 - DNA, 103 bp, Homo sapiens
ctagaggatcccgtgaagaatttcagaaactggagtaggttctttgccagtgcaggtggcatgaactgcatggaggcataacagtcagaggcaggacaagcag

SEQ ID NO: 655064 - DNA, 832 bp, Homo sapiens
agaagaatgaaactagactcctatctctcattacatacaaaaaccaaatcaaaatggattaaagacttaaatataagacctcaaactatgaaactactacaagaaaacactggggaaactcttcaggacatcagatgggcaaagatttcttgagtaataccccacaagcacagacaaccaaagcaaaaatggacaaatggaatcatatcaagttagaaagcttctgcacagcaaaggatacaagcaacaaaatgaagaaacaacccacagaatgggaaaaaatatttgcaaactacccatctgacaagggattaataaccagaatacttaaggagttcaaacaacttcataggaaaaaaaatctaataatccgataaaaaagtaggcagaatacctgaatagacatttcttaaaagaagacattcaagtggcaaacaggcatatgaaaaagtgctcaacagcactgattatcagagaaatacaaatcaaaatatgatggaatatcacctcacaccacttaaatggcttcttcctctttcttgagagggaatttccccctttggtgaccaaaggcggagggcaacagcacgcatcgtggctagcgggacaccctcacaccacgggaccagcgcacaccctgcgcctacagcgtgctacacgaagtaagcccttcaacaaaacacaaacaaaaacacgtttcgcgctccgccccaaagctgacaaccgcaggcgacgacccgacacccacagcccacgaccccaacacgacacaggcgatcacaccacccccgacgcactgcaccaacaccgaacgagcaccaccacaacgccc

SEQ ID NO: 655065 - DNA, 538 bp, Homo sapiens
aggatccactctaccaggtggtgtctcttaattatgctggacagcctcttagatcactgcctctttgagtcactgcctagagtatacttgctttgaccaaattcttcagtcacatctctcaccttggaaaccaagaaaaatgttacactgaaattcccgagagtttaaaacaaacatacgggttcctgtaattgaagcaaaaacacatggtacatttgtccaggatttattcaccattttaatcaggcactaaaagtctaagtttgagaaagtttgtctgtcttgacctggagttaaaactgggttgacctgaaaagggaactgttttgtacctttttcacagtacggtgtggagagagctatagcctggtaagaagcagctgtgagatctatggtacatggggaaggagaggtcctacggaacaagcaggaaactggtcccttatgcgttttcacgtcatttggtatgaaatagccttgaccttatatatacgtggtgagtgaatggttctgaacttgaaatatgtatacgtggagt

SEQ ID NO: 655066 - DNA, 299 bp, Homo sapiens
agcgcgagtgagggagcctgagccgcccgccgccgccgcctccgcctcccctccgcgaacaggagccctgggcctggtggccctggcactgcctgccccatgccctgtccctcgtgctgtcatgtgcctgcgatgtggtagctgctgctgcgaggctgagcggatggtggtgagtggatgatgctgatgctgatgctgcctgtgtgatgtgatgtgctgtgctctgtgatccttgatgctgtgtgctgcgcctgctgcctgttgttgtggctgttgatgtgtggaagtggcctggcttg

SEQ ID NO: 655067 - DNA, 711 bp, Homo sapiens
taggtttggagggggaatgctggaaattgtaatggggttatggaaactctttcataataagtaatgctcagggtgagtggtaggaatgtttttccataaaggaggtggttatgatgttgggtccgtagcggaatccgggggttatgctggttccgataattcataaaaacagggaggttaagaatgtaagggtcttgggtgacaaaattattgttgtgttgtaaatgttccaggggagatgtgctgtcattattgttggtctccttatggaaaaattgtggttaggtggtgtgaggggtgtgtttatattatattatatataatgtgtgtgtgttgtgttatctctcaggctatagtgaaaaaaaataggggcagaagggcgccgtgacggcgaatattctcgagtgtttagaacccgtgaaaacatagttctcggaactctccccttctcgagacaagggctcagaagggggggttccggggtgtgagtcctcgtgccataggtggtgggaagattaaatctcatatatttagtggcgcccacaggggtctcccggaaagtggggcagagaagaataaactcagaaggggtggtccgttgggtggtgggggaaataagggggtggaagaagagtttaagagggagcccattttatttagataagtggtggataaggttaaaaatgaaggggcctaaggggagaacttcaa

SEQ ID NO: 655068 - DNA, 273 bp, Homo sapiens
ggggttacatgaagggcgtcgggtttgaatcctatcgtccaaccccttaccttctcggtacccacacttccacatgctgactttccttgtatatgcccaaaagaaatgaaaactagtactcaagcaaatacacacacaaatgttcacatggcactattcacaatagccaaaaggtagaaggagcccaaaagtacatcaacagatgactagatcaacaaaaatgagccgggcacagtggctcactctggtaatcccagcacggtgctcgtgcgg

SEQ ID NO: 655069 - DNA, 432 bp, Homo sapiens
gctagctgcgaaaagtacggggaagagcacacatctattgatccgtagatagccgaatggggtacccgttagtagtgatactaacattgcgagtttgaataaaataggactgcaaagcataactgagtggagtgaaccatctaagtaactcaaggaacagaactcaattgagattctgacaagtagtggcgagcgaaattggaagagtccaaaccctataggggtgtcgtacgggctgtgcgggcgtaaagccgacaagttaggatcacactatatttatagcagaaagatctgggaaggtctgacagagagggtgaaatccccgtaagccgaaatgacatatggacttgtttgtacagtacctgagtacggcggggcacggagaaaacctgttgaaaactgggtcgaccacgatccaagactaaatattac

SEQ ID NO: 655070 - DNA, 882 bp, Homo sapiens
taacagctaaggactgtgaatctcattctgtatcaactgaacgctgatcagtcactgtaattaagctaagcctttaatagaccaatgggatttaaattccacaaaacacttagtttccagtcataggtacctctaaatcaagtggtattaaatcatacattctcccgactgtcgggaaagaatgggcgggaagatagccccgagagagtctgatagctgagttcttcgaattgcaacctgcaaatatgaagaatccacctcggagctggtaccaaaagaggtctaatcccgtgtctttagatttacgagtcccatatggctttcaacgtccatgctcaatttttatcctgacctcagcaaaaaataaaaaaacaaaattaagagaagagcgcaacatagagacactgtgtgtgagagcgggccattgaagcgcccgttgtaaaaaataccgcttgttagtaaaggaatccactcgttctgtgaggggggggggtggcggccaattaatgtcgtcaagttcgggagaaggtttgtccaaatttaaggcgtggagcccatacaaagaaagaaagtcgtgaaggtacgaacgcaccaaggcggggagggacaatctttccaaatccaaaagaaaaaaagcaggcgccgcggggggagaacaccccagacgacggcctccggggaaaaaaaacccctacagatggggaaaggccgtcggaagcgccaataagcggggaggtcctcccccataaaaagaggggagtctccccgcaaggcacatctggcatggctcacaaaatacccggagggacgggcggcgggcagagagagagtaccaaagggcattccccgcctacataagggtccaaattagcctgcataatg

SEQ ID NO: 655071 - DNA, 306 bp, Homo sapiens
tctttactgtagccctgcccatagcctttaatattcaaatgagacctagaattttagggctgtgtttctcaacctcaacgctatagacatttgggactggatgcttctttgctatggagccatcctgggcattatgggatgttagcagcctccctggcctccacctcctagatgccatagcatcctcccaccttatgacaaccacaaaatgtttccagccattgccaagtagccccagacgaacacatcagcctgccccaagtgaaggatgttattcactaggttctttttttttttttttttttt

SEQ ID NO: 655072 - DNA, 415 bp, Homo sapiens
actcatatttctcatgtaagtggaatcattcagtatttgtccttttgtgactggtttcacttagcataaagtctttaagatgcatccatgtttccagtgtttcggtttttttagaaaaactcatacgtgattgcagccgggcatggtggctcacgcctgtaatcccagcacttgggaggccaaggcaggcggatcacctgaggtcaggagttaaacaccagcctgacaaacatggagaaaccccatctctactaaaaatacaaaattagctgggcgtggtggcacatgcctgtaatcccagctactcaggaggctggggcaggagaattggttgaacccaggaggcggaggttgcagtgagccgagattgtgccactgcactccagcctgggcaacaagagtgaaactctgtctc

SEQ ID NO: 655073 - DNA, 405 bp, Homo sapiens
gggtcgaatctgtggtacctttggggaaaattggaatgtaaaggtccagaattaaaaccgttgccccattaacagatttcctctggaaggtcttccttacctaacctgatggtatccaccgaagggcatttaactaccattaatggggagtaataaaatcctccgggttaattcagacctaactgcgtaattactttgaacgcctttgtaagctgggtcttaactcgccccaaggtggttgaagggaggcctttaactctgcttcaagtcctggccttaaaggtagtcagaggcaaaggctggattaaacacacactgtttaccaagtgccactttaagaccacctgaaagacggggggccatcagtctgaaggttcctagagacgtcaagaattgaatatcttc

SEQ ID NO: 655074 - DNA, 778 bp, Homo sapiens
tcggctgcaggaattcggcacgaggagagagagtttgagagagagagatagagagagagagagagtgagacttttctctaccttctttttcccccccttttctccacctcctctcctccagttcctcctttctcttctttctctttccatctttccttcctctctcctcttcttccttcttcatcattcttctctttttcttctcccgttcatcaccttctcttcttctctcttctcttcctccttctctttcctccctctcctctttctcctctctcttttctctccttttctcttcttttttcttctcttcttttctctttcccctctttccttaatccttctcctcccctctttcttttcttccttctctactccttctctcccctcttaatcctctccttcttcttcattttccttctcttcctctcttttcccttttcctcctcctctttcttctccttttttttctcttattctctttcttccttccctcttcctttccttcttttctctccccttcttcttctctctctcccctttctttcttcactccctccctttcctcttcccctcttcccttttttttcattcctctctcttctctctcttttccttccttctctctttttcctttcacttttcttctttttttccctctttctcttccctttcttctcctccttatccctcttctcttctctcttctctcttttctcttcctttctccttccttctcttgtctccctttttcctcttttctttctcctcgctccct

SEQ ID NO: 655075 - DNA, 243 bp, Homo sapiens
  misc_feature (138)..(138): n is a, c, g, or t
cactggctcactactcatttgacgttacgggttctggtgttggtttcttcattctttactgcactcagatttacgccttacaaagggaaagcctctgcgcgtcacacgtaggacgcatgacaggtcactcgtggtgcnggctgacatgctcacacattacaacagtcgagagggcacactcctaagacagaggacactccacgacgatgcgtgtctggcgcgcttcagttccgcccgcggcct

SEQ ID NO: 655076 - DNA, 1222 bp, Homo sapiens
ggtcgccagatggttgctcggtccttccgaggaagctaaggggctgcgattggggtgaggccctcagcttcgatcctggcgattagtcacctgggttccgggagcgcccggccctacactcgacgccagcgactcatgagtcctcttgtcgtctcgagcatctgcgcgtagcatctacatcgtgtgcctcattctgctactgacgatgaggtgacagtcactggatgataagatcaattagcgccctcattaatagcatgtcgagtgtaatatgttgagcctttgtggcgctggtttgtatgcaaagtggcctgggcaacgtcaacagttgcgagcctcatctgcaagtgtagggggccggtggacctgctccagcatgctggtgctgcagccatccgaggagggtcctggcgccgcctccactgctgcgtgcttccagctgaggagacagagaaagtggaacgctagaagacaagaagaatccgaggcagtctgatgatgacactggcgcgtatggtctatgcgagctaatcgctctttgggttagcactgtccggagtccagatgctgagcttttagtactttggcttcactcaactgtccgtgagcatctgtccagaggagctggaaaagcgtggtgcaggtgggtgcaggggagcttgggactggtatgagcgggggctaagtctccttggttgccagccgtggtgttcatcgacgtgtgtgacccctgtatacgtggactgactgtttgaattgccataggacccgctgagtgtcccgggaacttcacaaccgggaaaaagtgggtctgaaccgggtcccaccaaaaccaaggttgaccccaggtagtcccgagagttaacccgcaggtgttctaaccaattgaccgggccccaatggattgaggacccgcgaactaacctctgtggaaccactttccatttggccatttcttaaacctggcttcaaaccacttgaaccgggccctcctttcacagcgggatttaactaccgggccgggagcacgaatagggattgaagcagaatcttccaagacacgtgtaggcgagcgcaccattggcggagatatcccgcgacgggactcgtgatgagacacttgcgagctgggcccacatcattagaacgggcttgggtttaagaagaacgaaagcacactcgcgggctcatatatgcgagtcgggcacacacaagtgtcaga

SEQ ID NO: 655077 - DNA, 1331 bp, Homo sapiens
tgtcccaaaaaaggtatatttttttttttcacaagaaggggcaaaagagaaaaccaaaaggaggggccccgcgggggggcacacttatctggggaccaccctctctcctacaaaaaaagaaggggggaggaggggggcgcccctacacccctcttattggtggtccacattgagggcccccgtgtgttgaccactctgctggggggaacactctcgatgatgaggggggggcccccgacttctctcgcgggggaacgggggggaaggggcgccacccacccgcggtgcagaaggcccgcaacctcctttttctccacaaacaaaaagatatttgtgggggcggggcggaatcgcggggccacaaacacgacgcgcgggcgagagctgggagcagatacaaaacactctgtggcggcgcggtgagacatcacccacgccccagcaatgaggagcgagagtgtgtatcacaaaagagagtgggcactcttcggcacacacacaaaaccacaaacacaaaagagggggctacacaagaggagtatgtcggcggggaacaaccacgagaaggaacaagtgggggcgccccacaaaacctcgggggaggggcacgcgtggagagatcacacccggaaggggggaggttctgttgaggagggggcgaccggaggagagaaccatcgagggtgagatcggggggggcgccccacaataatggagcgagagggagacacaaggggacacactaagaggggagagaacaacaccacatgggggggttacagcggaaagaaacaccaccccgaaaaccaactgcactccatgggatgggacggcaacaaccagcggctatgagaaggacccaccacccggtgggaccaagtgacgcacgggcgcttccccagaagaacacaaacaatctcgtcgcaccaaacacccgcgggaagagagacaacaggacgtgtctggctaccaaatgaaaaacgggcgacacgggagaccaccccccccaggcgcaccactagtacgccaaggggggggctgcaacacactatgaggcgacacagagacaacggcgagacagacacaacgaggcacccccggggggtgaaacacaatcggtgggaggggacctggggggcgcagccccaccacaggtgacacgtgatggtgcaggagctgtaccgaggtgctcgagcaaagggcacgcccactagggcaggaaccccacggcacagagagacagacaagagaaggaggggccccaaaagagaaggttccaagaggggatagaggggacaagtatcagcgactgtggggggaaagctcccctg

SEQ ID NO: 655078 - DNA, 188 bp, Homo sapiens
tggcccaggccgggaaaagccacctggcagggctcacactcctgggctttgaacacacacgccagctcctttttgaagcgactttcctgtttggaacggcaaaaaaaaaaatttttttttctctttttggtggtggttaaaagggaacccaaaacatttaaataaaactttccaaatatttccgagga

SEQ ID NO: 655079 - DNA, 187 bp, Homo sapiens
  misc_feature (178)..(178): n is a, c, g, or t
ggccttaccaaaggcggcgaagaggcggagccaagaagagtagtgtgctctgatccattttctagtaaagattggtatgatgtgaaagctagctgcttactcgctttcgattagtaaagaaagtgatctggagaagtactgcgtgcgatcaggcagaggagcccataggaaacccaanaaatggcat

SEQ ID NO: 655080 - DNA, 293 bp, Homo sapiens
gaatgactatgatagagctcgctctgggacagtggtctatggtcaggaagagtacatatgctgtcaggaggctctgagtgagctcaccactgcgcagaaagcacgaatcgcgagctgtcagtgatattaccagtcagctggcgatgacctatctcaggcccctgacgactccccaacaggcatacaggtgacatacctaacctacagacagacgagtcgagcctagccctagcttggatcgaatagctctgagcatatctatagcacattggagagttatgtgacctagctgt

SEQ ID NO: 655081 - DNA, 114 bp, Homo sapiens
tcgtacttaatacccacgatcactcacaaccccaccatcaccctcattaacctctacttctacctacgcctattttacaccaaccccgtgatctgtggtgtgttgtaatgtggt

SEQ ID NO: 655082 - DNA, 121 bp, Homo sapiens
tatgcactccagcttgggcacagagatctgtctcaaaacagtacaacaatcacctatgctatctgcctagggccattcacaggatggtaaatcagatgactccattctctgactgaccagc

SEQ ID NO: 655083 - DNA, 354 bp, Homo sapiens
  misc_feature (304)..(304): n is a, c, g, or t
  misc_feature (346)..(346): n is a, c, g, or t
taggatccccctcataatgtgtgcccatgagggcaccgcctagcagggcatgaaactgcccaagaccttgggaacccaccctttgcatcgaagtgccctggatgtgagacatagagtcaaaagagattattttggagctttaagatttaattacttcctgcttggtttcagatttgcttgggccctgtggcccctttcttttggttgatttctcccttttggaatgggcatatttacctaatgcctctacccccattgtatcttggaagtaactactgtgttttttttattttacagactcatnagtgaaagggactagccttgtctctgatgcaactttggattntggaactt

SEQ ID NO: 655084 - DNA, 170 bp, Homo sapiens
atcaggcgagtacttgtggcaatcatggcagatagccctgtagtaactagtcattcgtacatgcaagagcccgggaagggttcacgggcgcaggtcatactcataatcgcccacgggcttacgtcctcattactattctgcgcgtaggaaactctaaactacgaaagcat

SEQ ID NO: 655085 - DNA, 338 bp, Homo sapiens
gctttttaagattacgctctctcttaactctggggtggattttaaccatgacaactcttgtcctctcggtgatgagtatgtagctttggatttgttgtgcaactgttgctacagctgtggagcagtatgttcctctggagaagctgagtatctatgagtgacttggagtttatgaatgaacaaaagctaaacagatatccagcttctctccttgtggttgttagatctaaacctgaagatccatgaagaaccagggccctctactacaaagtgaatccttgctcattctgaatttaagcatttcctttaaagacaagtgtatagacactctcaaaatt

SEQ ID NO: 655086 - DNA, 808 bp, Homo sapiens
gggagagagaagactgtgtatcaggagtggagaccatgagcatttgggccacttcttcatgtagcttgtgccttcagggcctgctcaggccccatcacatatttaccacttccatttggtgatggagcactggtgtgcacacccaactttatggcttggtgggtcagataacacccagatcatgatgggcagctcaggtcaaatggtaacttggtggcctatggtcaagtgttgtttctactaaaacccagtagcagatcaagagctgttctcaataggagagtggttatctgcaggagatggcaagtctttgctctaaaatcctaagggcctgagctgtggttcacctatgggagcctgccaagagctccaaacaacatccctaaatgccactgtcatttcaagcaccactgtcattggatctgctggatcatatgccccaagtggcagagcagcttgcagagcagcctggagctgttgcagagcattttcttattctggaccccactcaaaactagcagcttctcaggtcgcttcataaataggccagagtaacaaagccatatgaggaatatgttggctccaaaatccaaggaggtcctatgtattagtctgtactcacactgctaatgaagatatacctgagactggggtaaatttattacggaacaggagatttaatttgactcccaagttccacatggttggcgaggcctcacaatcacagctgaacggcagaactgaggagccaagtcccatcttacattagtggcagggcaagaagagcgcttctgcgggagaactccta

SEQ ID NO: 655087 - DNA, 438 bp, Homo sapiens
cggcggtcttcaatcatgcccgttgtggtacaaaaggcatgatcgcttgttatataccgggaagaaagatcaaatttgaacattttctttgagttgtaggattgcagatcttaccaaggaactttcttttacagattctaaatttctacagtgtttcacttttatacaatgagtacctattacttctgaacgtcgaattaacaaagattattggtatcttatgaaagatattcatcataacaaagcactgttaccatactgaaaaactggaagcaacttaagtgtccactgataagtgattgtttcaagaagttatgcatggacttttttttttttttttagaaacggagctcctcaggtgtaacccccaggcgtgaagttgcaaaagcgcattctcggattactgcaccccccgctttgctcccggggttcaagcgg

SEQ ID NO: 655088 - DNA, 963 bp, Homo sapiens
  misc_feature (109)..(109): n is a, c, g, or t
  misc_feature (443)..(443): n is a, c, g, or t
  misc_feature (481)..(481): n is a, c, g, or t
  misc_feature (521)..(521): n is a, c, g, or t
  misc_feature (531)..(531): n is a, c, g, or t
gagaggtgattaatatctagagtctaacgaaagccttttaatcaacctgagaagctcttcgttcagtgctgttacccacaggaaatgagaatgattgaaattctatggnggctcctccaaaaaccttcctccatttgcacctttctccttctaccacttccctgactaatgctaggggctccaagggccaccacacccactctcctgccttctccttctgtctcctttgccactttacctgccattattaccttgcagacaattagagacttcgagctgggggaatcttcttagattctctggtttgaaatgctactttcgtagatagtgaaaccgagacccagagaagtcccccctagagcgtgcacagcatctagggttagaatcagatacgaatatctcaacttctaagcagttctcatcacagcttgtctccctcattnggttcaggttcctacaaagtcactatgggtgttcgctntcttctggcctggggtagagagggaatgcctgcgtgtccnagtctgctgnggggaaacactgtggtacagttttattagattgtgattcgtgctttgaccgacagaccggccgagacaggtgtgggagcacagagttctaggtagagtggcgtctcctaactcagtctgatactaggtttcaagacagctgattctgcacgactgagtagagcttaagcacgtgaatggtgaggacctaagcagagatgagcagggccctgacaggtgaataggttgaaaaggatatgactattacacaggtggacctgatagacagggcttctacttcttgcttctaagcctatggaaaggcagacaagataattgaggatagtcagcgctggaatatcagaatggatgtcgaggtcattaaaactttaaaggttctttctgcaaaccttttggggtacgaataggtcgctcatttgtccagaaagctact

SEQ ID NO: 655089 - DNA, 395 bp, Homo sapiens
caaagaagctctctaggtggcaaataagcactgtcctctgggaaatgcaaataaaaatcacaatgagaaactactgcacacccgtgagaatgccttaaaaaaaaaaaagacaagaccaaaaccaagtgttagtgagggtgtggaacaacagaaattctcataccttgttggtgggactacaagatagtggagccctctggaatcagtttggcagtttcttataaaataaaacaatcatttactgtatgacccagcaatcctgcccctcattctttataccagagaaatgaagacatatgtccacacaataaccaaatactgtaaccacaatgaaaaatgatgcaagtgttcacagaagctttattcatttacctaaaactgaaagcaaccacctg

SEQ ID NO: 655090 - DNA, 365 bp, Homo sapiens
tatataacattccacctccctgtgtaatttggatagtccttttccatggtttataacattttcctccctgtaaagataggcctaatttcctgaaataataattaaatttatagaaagccgagaggaaattgcctagtttatccccggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaa

SEQ ID NO: 655091 - DNA, 371 bp, Homo sapiens
caaagcatgctgcttatactacagccacttctgaccattttatacataccgcagcctgaaattgtgtgattatctccaatcaaatcactttgatggcagcataaataatccaacatgttctatagtcatagattaggtgagaacagtcatggccaaatggtgtacgaaggcattctcatattttggagctttccttccagagtcctggctgattggtgttcgctgtacatctgagcccccaaaagcattattactgatacttgcacacagtcaaaagcgcagactggatggctggtctttcataaggcatttaagggtacactactgtgtatcactgaccatacatttttcttagaccctcaagcactatc

SEQ ID NO: 655092 - DNA, 383 bp, Homo sapiens
  misc_feature (48)..(48): n is a, c, g, or t
  misc_feature (255)..(255): n is a, c, g, or t
  misc_feature (314)..(314): n is a, c, g, or t
  misc_feature (381)..(381): n is a, c, g, or t
cggggtgagcagaatgccttcttctggaatgcttcctgaaggaactgnctgaagctgttttacaggcttttataagtagaaggagtatactctaaaacaacaaaagtataagatattataaatacaggccaggcgcagtggctcacgcctgtaatcccagcattttgggaggccgaggcgggtggatcacgaggtcaggagatcgagaccatcctggctaacacggtgaaaccccgtctctactaatacaattanccaggcatggtgaatggcgcctgtagtcccagctactcaggaggctgaggcagaacggngtgaacctgggaggcggagcttgcaatgagccgagattgcgccactgcactccagcctgggccacangc

SEQ ID NO: 655093 - DNA, 373 bp, Homo sapiens
  misc_feature (40)..(40): n is a, c, g, or t
  misc_feature (82)..(82): n is a, c, g, or t
  misc_feature (94)..(97): n is a, c, g, or t
  misc_feature (134)..(134): n is a, c, g, or t
  misc_feature (138)..(138): n is a, c, g, or t
  misc_feature (141)..(141): n is a, c, g, or t
gagggaagggtatgactctgctgaagcagaatagatatgnctccattaggattttatacctgcattgagcctaaatattatngccttcgagaannnnatctttctgataactgagttagggggcaattcagctntganttntaaataaagaattttagacaatcactgcaattctttcctgctatgcaatgggttttgtggccaatggccaagtttaactctatcgttttcccttctgatttaagtatctgatgcatatgtcactttcaaaagctttccacattccgtttcagaaggacctatctaccacatgagtttgctgatataattagtgacctttggtatctacatgaaggctttaccacatttacta

SEQ ID NO: 655094 - DNA, 418 bp, Homo sapiens
  misc_feature (13)..(13): n is a, c, g, or t
  misc_feature (63)..(63): n is a, c, g, or t
  misc_feature (83)..(83): n is a, c, g, or t
  misc_feature (143)..(143): n is a, c, g, or t
  misc_feature (197)..(197): n is a, c, g, or t
  misc_feature (272)..(272): n is a, c, g, or t
  misc_feature (278)..(278): n is a, c, g, or t
  misc_feature (285)..(285): n is a, c, g, or t
  misc_feature (300)..(300): n is a, c, g, or t
  misc_feature (308)..(308): n is a, c, g, or t
  misc_feature (333)..(333): n is a, c, g, or t
  misc_feature (410)..(410): n is a, c, g, or t
ggatctgttatcncatcatggagataagttttttggttctttttaacataagttatttgtttnagagtttgctgaggagctanttggctttaagaaggatgttaattagatccaaatacatagggaccaggtgctgctttttnatgttcacaaaagctgttcttcaccatttatcttcatttttttagggggcttantgaaggctaatcaattcgatgcatgttttgtgttacagttccatgtgtctgtgtcacttgttaacagtcctaatngccaanacccatntaggtttccccaatngagaatanacccaaaacccctgtaagtaaactntctgtgtcttgtaactttactaaacatacttgtaaagtttgtctgtaaatgtgtccataaagttacctataatggtnttgtccag

SEQ ID NO: 655095 - DNA, 392 bp, Homo sapiens
cagcgcacaggcgtagcagaggcacatgtgcccacatgtgtagatgaccgtgtccaccgcgtgttcatagcaaatggtgcactcattgctccactggcccagacctggggtcactggcgactcgggcaggctcactggcgaattggggctgtcccaccagcagagctacccagagggccagagctgcacgtgctgagcaaggggtcagacaggcggctcgcagggcactgggcgaggttggcgtggaggcaggggagcaggggagtgatgggataccccgctcggccaggatagtggagccgaggatgcggatctgcgtgatggtcccgtgcaggccgaagagcatccaaagcggtctgcgagggtccaagcacagctgcatgcggcggtcc

SEQ ID NO: 655096 - DNA, 110 bp, Homo sapiens
atttcttcgctcatctctctccattcttcgctcatttcgctatttccagtcaggcagtggccaaaagcagcaggcccccataatcctgtgcatgatgcaggcactcctgg

SEQ ID NO: 655097 - DNA, 206 bp, Homo sapiens
ggtcccgttgcatgtgtgctgggcccgagggttctgcaggcggtgttgacgaacagcgcgcgcggcggtgctgcgacgcggcctgctccagcgcctcgcaatccagcccgtccagcgtgcgcgccaccggcaccacccgcagcccggccaggcgcagcatctgcagcaggttggcgtaggccggctgctcgaccagcacggtatcg

SEQ ID NO: 655098 - DNA, 546 bp, Homo sapiens
  misc_feature (520)..(520): n is a, c, g, or t
ttggggctcattcagggcaacttgatagtgagtctttaacttctctgggggacagggtgacttggatccagaaagactgggcccggggggagttggggcctttacttgggggtatggtgaaatagacccggagtgacttggtctgggcggtgtttcaggtttcacttgggtatcgggtgaggaggacccagaatgacggtatctgggcaacaatcgggattccacatgggagcagggagatacggatctgcttcgccgtggagtggttctcgacgtcaccctactaggactgggagaagaggagccagaagggcttcttggtctgggtgatattatggccttcacttggggtggtggagatgatgacctagatgggctcggtcggggaggtgtgctagatttcactctaggaggagaggcccggagcagctatgtctagaaggggtcctagatttcaactcagggtcaggtgatgattcaaaacagctcggtctctgtggcgtaacagatggctcattgncctggggacttgttatggacccttgc

SEQ ID NO: 655099 - DNA, 393 bp, Homo sapiens
tgtggaggaataagggagatagtgcagagactgaaggtgatgagcagtggctggagacagtggacatgactgcttcggcggaacgggctcgggcagctgggcttccacgtgaaagtacgactggcacggtggccgatggttgagtgactatgtggttctgcctggcagtgccggcctcctggcagtgctagcctgactagttggagatctcgcaaggtggcctgtggtcacacatgacccacgagccagagtgatcgacctgctagcgcacctcgtgtcacgtgtgaagtgtggtcatcatcccgcacttttgaggacggcactccccggaggagttggccggagacctacgacatgaatacctcggagcccaagacggagcaggaaagcatc

SEQ ID NO: 655100 - DNA, 524 bp, Homo sapiens
ggaacaagagcaatcatggaacaggtgaagtactcagagagaaccatccatcggtattgtataagtgcgcacctgggggccgagcgaatagctccacaagatgcgccagttgttcgtgcgtggagtcccactgggtggcatcattgcggacttgcgtctccctccgcccgatcgtacacagaagagctgtcacgcatgatgacaccgaagccgtgtccctctataaggccacagcgcttccagcgggaacagtcagacatggtcattctcatatcctgccttctgactctgggccggtggagtggctctcagaatatactctgtctgctggcagaataggcctgtactcttcgtatttgctttgacttgatgttgccaagggactgaggtccattgaatcaggcttagtaccacctgctcctcatcttaggagtctccttttcaaataattaggctcgtgttcccattttaaaactctgatattgccttcaccgtagaataaacaccttactagagcccttctt

SEQ ID NO: 655101 - DNA, 156 bp, Homo sapiens
tctaaggatcctgtgcagcctagtgccgaacctgatcctctccggtgcatgccgggagtggctggtgcgggccgtgcgaccatccggccctgtagcaccttcgtggaccagcagcgcttctcacggccccgcaacctgggagagctgtgccagtgc

SEQ ID NO: 655102 - DNA, 311 bp, Homo sapiens
gacctacaggatcttactggcaggctcggctcgtcaggctcgaagtccaggccaggaactgtaggcagagcttctccagcagtgtcgtccctgtggccactgcataggcctacaggtccagtggcatctggaacgaggggtcctgggggaggaggatggcaaagaggcttgcgcagtaagccctgcagcttgcctggcccctatagggcagaggccagctttgtggaagcacttgactagacgacagtggtgatgtcaagtccttcgggggttagaagtaccttgagaagggtcccttgaccatttgggca

SEQ ID NO: 655103 - DNA, 173 bp, Homo sapiens
gacatacttctcgtttaactataccacaaggtcttttgtgctaaggtggccatgtgtgtcacagtcagggaaatccctcctcctggtgagccacagaggaagtctctcaagaactagacagggaaaggtgttttctccacgatcaatccagactttgcgaggggtacctgagc

SEQ ID NO: 655104 - DNA, 323 bp, Homo sapiens
acagcttgagtatgtcaggctctggggcttatgagttgtccctgtacttatcttgctactctgatctgatgtaagcaactgtattagtccattctcgcattgctataaataaatacctgaaactgggtaatttataagaaaagaggtttaattggctcacagttccacaggctgtatgggaagcacggctgaggaagcttcaggaaactttcaatcgtggcagaaggtgaagtggaagcagacgcatcttacgtgctggagccaggaggaagaaagagaaggaggaggtgctaaaaacttttaaacattgggaggctgaggcg

SEQ ID NO: 655105 - DNA, 177 bp, Homo sapiens
cgggccctgctggtttcccgggctcaggaattgtgcagctcctcacttcaaccatatggagtctcagccagcttttatgcaaagcagttgatccctagccatctgtggtcctttctggtactgctattcacaacgtttccaactagtccaacaccaagtaacttgccacgggcacaa

SEQ ID NO: 655106 - DNA, 1080 bp, Homo sapiens
  misc_feature (558)..(558): n is a, c, g, or t
  misc_feature (652)..(652): n is a, c, g, or t
  misc_feature (783)..(783): n is a, c, g, or t
  misc_feature (831)..(831): n is a, c, g, or t
  misc_feature (860)..(860): n is a, c, g, or t
  misc_feature (888)..(888): n is a, c, g, or t
  misc_feature (926)..(926): n is a, c, g, or t
  misc_feature (947)..(947): n is a, c, g, or t
  misc_feature (950)..(950): n is a, c, g, or t
  misc_feature (959)..(959): n is a, c, g, or t
  misc_feature (994)..(994): n is a, c, g, or t
  misc_feature (997)..(997): n is a, c, g, or t
  misc_feature (1006)..(1006): n is a, c, g, or t
  misc_feature (1021)..(1021): n is a, c, g, or t
  misc_feature (1027)..(1027): n is a, c, g, or t
  misc_feature (1030)..(1030): n is a, c, g, or t
  misc_feature (1061)..(1061): n is a, c, g, or t
aaaaaaatttattttcattttggagccaaggtctcactctgtcacccaggctggagtgcagtggcaggatcatggctcactgcagcctcagacttctgggctcaagctattctcccacctcagcctcccaagtagctaggaccacaggtgcacgccaccacacctggctaatttttaaattatttatagggacgagatctccctgtgttgctcaggcgagtctcaaactcctggagctcaagcagtcctcccaccttggcctccgtaagtgagattacaggtgtgagccaccacacctggatgcacttccttttagaataacctttgcgtgtcatgttggcactcaaaacatttcagattttgaagcattttggtttcagatttttagattagggatggtcaacctgtatatgtttactcagagaaagccacaattttctggaatgatattttgagtactttaagagtaactgaaattttctattttctttttctctaccccaaagtgtttactttggaggcatgaaataatttggaaaaagaaaaacaatcaccgtnagatattgattctgtctctaagctttttgcattcattagtttccataggactttcttgcagatatacagatgcctcattggattttactgtganggaatattggtacattagcaaaaacagtggactttgtgaccttgaaaaagtcatttaacatctctgaaccctactttctaagtctctacaagtaatatatagtgggtgaggtgttctttctttgttctgtnacttggatgtgaaactctccttttgtagatgaaaccattgcataaggnatataaagaccttttccctggaagttaancctaccaggcctgggaggaggagtgccnagtggaatgcttttggccttccaaatggccccaatccnccttgggggaaataatttggnaangggtggggnggtaagccaaaacccggggggcaattaaaaaattnaanccccccttnggggaaaaaaggggnaaaagnaanttaatgggccaaaaccccctgggcccttttncccttccaaaaagggcccc

SEQ ID NO: 655107 - DNA, 205 bp, Homo sapiens
ctacatactggctagacacataaaagaacaatttcagagcccacatgatttataaagcttatgggccagccaggtcagccggctcttaaccctcgggccagaaggtccctatcactggccagcgcggtgtctttttccttctttcaacaggcaacacgcctgcaaggagggtgcagacgggtggggcccggagctcagatttcga

SEQ ID NO: 655108 - DNA, 1015 bp, Homo sapiens
tgtcggtgttgtgtgtcttgtgcgtgcttcgttggtcgcggcgttgtgtgggtagtctcccttgtttgtctgtggtggccctgccgcttgtctgtgcgttggctttgtccctgtgccgttggttacgtgtcctggtcctgtgtcgccttctagccgtttgcctgtgctagttgttgctcttcttcgcggtggctggggggctctctgtgcgtcggttcgtggtgttgggggtccctcggtatgtggtcccatcgtccggtgcgctggcttggttcgcggcgcgtttggggggccgggggtccggttgttggaatccctgaggaaaatgctgttgggcaacatgagatggaccttttcatattattgtacaatattagagtcttggaagttacagaagtcagttctcacagccacccagtagcttaatgtcagctcctgatacgctgcagtggactgcttcagccactgcacctcgagtacgcaggctggctgggctgctcctgctggctgtcctggaggatttcaacatgtcccaggatttgctgcaccctcgagggcagccagacagcgtcgaccaggcaatgacggaaagcagagacaggagaggaaggcctcactcacccactgcgtcgagggctgcagaacacagcgggatccctgtccaggcccagggacatcgagtgcaagccagacacactgtcctcttgagacctcgttctctcggagtgagccaaacacacttcccacacgtctcccagccacagctgggatgctcgatggaaaggcatctgccattaaagtaaagcaaagagatagaaagccgcaatccgatgtggggatagagagtcggaagacgcagtcaggcttgaggagctggcgcttgtaatgtttatccgtcttaaacatattgcgtccctcactggtacacgtagggaactgtcggacacaggtagcctgagcctcaggctgttgtagaagcatctgatgcctttttcttgctggagtcctccggatg

SEQ ID NO: 655109 - DNA, 126 bp, Homo sapiens
agtgtaatggctcattgtggtgacagtgtggactggagcatcaggtgtatactgttctgtctccagcccctccctcctctgtgctgtccacctcctctgtgctgtccacctcctctgtgctgtcca

SEQ ID NO: 655110 - DNA, 82 bp, Homo sapiens
aatggctagaagttcagggcgggggatgttgcggtgagatgtcttcttgtaggaaccaaaatttttttatgaaagaagggga

SEQ ID NO: 655111 - DNA, 112 bp, Homo sapiens
tatctctatgtgatgccagcagagacctttgtgaaatcgcttcttttttactgtgtttaaaagccccccagtgtccacccagtgaaatacgcaagctgcgtttcacttccga

SEQ ID NO: 655112 - DNA, 120 bp, Homo sapiens
gcccccccccccccttttgaaaaccctaataaaaatttttggggttttcgggcccgggggggtcccggggccccccccccttttttttttcccccgggggcccccctttttttttttcca

SEQ ID NO: 655113 - DNA, 323 bp, Homo sapiens
ttagagaccgtgttgtcactgtcattaacggagagaaggaagagaagtaagcctgaggggtctttgattgtgtagtaagggtggactggtgatttctatcggaatgggaggtgattcctagggggttgtttgaccccgtttcgtgcaagaataggcaggtggagtgctgctagggttgccatacatcgaagggtaagatgaagtgacagtgtacagaatctgtgtgacgggtgggactgtctactgagtagcctcctcagattcattgcaccacggtcttctcagggtacccggaggctcgaaattcggtaatcattgggtca

SEQ ID NO: 655114 - DNA, 167 bp, Homo sapiens
  misc_feature (23)..(23): n is a, c, g, or t
  misc_feature (42)..(42): n is a, c, g, or t
  misc_feature (64)..(64): n is a, c, g, or t
  misc_feature (90)..(90): n is a, c, g, or t
  misc_feature (125)..(125): n is a, c, g, or t
acttttacttaagcatttgtaanttggagtatctggtactanctaagaaataattctataattnagttctgtactcaccatatatggatnattcctcatgtataatgtgccccaaatgcagcttnattttccagataccttgacgcagaataaattttttcatcatt

SEQ ID NO: 655115 - DNA, 329 bp, Homo sapiens
agtgcagagagaaagtggtaagaaatggtcattcgagcatcgtggtaagagtagccaacattgcctgggaatctttggcacaaggtccgagatagcgaagttatcgtgaccgatttcttgtctttcgttttttttcatgacatattttattctcacactaaataacacatgaattattatggatgacattcaaacatgtatgctaaataagaaagtccactttcctgtcgcgctacccttcagtgtgttttccgaccctagaggtaataaccacttgttctgagcttttccgctctttgcctctctccgttcttcgttctctctccact

SEQ ID NO: 655116 - DNA, 657 bp, Homo sapiens
cgatggtgctctggtaggagcgtgacatttatgcctgccagttcaccaccaccgtggagtattgctgtgccgcggagctgttcaccgaagggagcatccgcaaagctgaagtgctgagcagatagcaagtcatgctggacgacaaagcgcttttccctgatggctgtggacaggctgatgaccgtggggcagaccatgacatttatgtgctgagagtgactcacccacctgaacagactggtcattttaccctaacacccctgaatcctgaaaggcacccattggtacctgctgataggcagcgtgtgactgaccacatgctccacacatagggtctgatgtaatgatcggagtgtgctgaccatctatttcagctgaaagacacatcatggtagatagggagatctcagagtgcgagtgagcttgacactcactctatgactgcagagccagcatctgacatagagcacagcgtccatgaaggtatagatcggctggctgagcatgcctagaactgacactgatgatacttatagtgagctggtaagtgacagcccatcctgatgacctgctgtgctcacttaggtgtaacatcaaggcgttgtatcaacatgcgctcttgaccctacggtgactctcctgagcatgaagacttcg

SEQ ID NO: 655117 - DNA, 760 bp, Homo sapiens
  misc_feature (219)..(219): n is a, c, g, or t
cagatgagggaagaagctgcagactaggatacgcctcctcctctgccaggtacccggaacgtgatcgaggcttgtgtgcggaccggaacacggtacctgtctctacaccaacatgatggaagttgtggggcctaataccaaatggtcagcccgttctacagggcgcaactgaagcatacctctctagtacgaacgcagatgcaacagggcgagccaccntagtcgcatctgccaggcgaacggcccctggtccgcagctggtcatagtggtcctgcgaaggccacaactggagagagtacatggtcccgtggggggctgcccctggtgactttgtgcccttcagtcccacgggcatctacggtgaaaggccaccagagtcatgtagggacttctagccgaccagggctctgcgcctgggcaggttgtgctcttccgggcctcatcccgagtctcatgatggtacgctactgggccgtgcgtctatcgtgggcacatgttgacgctggcatgctcggtgcgtggcggcccgggagctggagctgagggcaaccctgatgggcgcgcaggtatacttctggctaccggatgtgatcaccctgacaggcaggctacgaggatttcaacatggcagttcctggtgcccctgcaggactgcggtttggtgggcgcccggccattgctgtccttactggctgtctgtgtgttgcctggctgacctctgagtgccctcgctgcagtgggtgttgcggccactggtgc

SEQ ID NO: 655118 - DNA, 158 bp, Homo sapiens
gctgtattatcacgcttttgtcagataggaaactgaggctcaaagaagatatgtgcccaaggtcacctcgctagaaaagtgagctagatttaaactgtgactttaagccacggtcaacccacaagccacggtcaacccacaagccacggtcaacccac

SEQ ID NO: 655119 - DNA, 888 bp, Homo sapiens
ctaccctagacatctgcatcttgtaagttagccagacaataaagaaaagcagaatgaaaaaaaaaaaaaaaaaaaaaaaaaaaaaaaaaaaaaacaaaaaaaaaaaaaaaaaaaaaaaaaaaaaaaaaaaaaaagggaaaagaaaaaaacacccagaggcccagaccaacccacacataaattatatataaaaacaagatatcactaaccatgaactctatctcttatacatcaaacatacaactaaatctttaaataatataaatctaaatataaataaaacataccaactatatcatattataacatacaaataacataaggatatacataattgaagaaatacactttatattatacatacaattacaaagttcttacttatcttatctgtatcaatattatgtatcaaagtactcggtcagattagaattagtgggatatgactagagaatgcggacgatatgactacggtaagaatagtgttgaaagaaaggtgtatagttagtagcgcagtaagcaagggactcgaacccgaagacgaatactagattactccgactatgtttccgtattctgtagtgcgtttacgtaaggattggatatggtcggctgtggtgatattgtgactggtgcatgtgatcgtcgtgccagcgatgggcgtgtcggtgggtgtggcccgcaagagcggcatcgtggtgtggttttgtatctgggtgtggatgggcggagtgcggtgagcagaggtcacgagcgtgctcggaaggggctagggcgagtgtcaggctggagggggtatccgataggacagtggatcgtgtcagtgttgcagccgcgagcgtctctctttgacggctgagtcgggacggatactggagctgccgctgg

SEQ ID NO: 655120 - DNA, 1606 bp, Homo sapiens
  misc_feature (1589)..(1589): n is a, c, g, or t
cacacaagagaccgactcactagggctatcctgcggggggagctcgatgtaagtccctcgcaggtcgctgagaggttgacgcagggataattacaaacgaggcatgcgtaatagtcgctacctagttggagatgatgcttgcaaccatcgtcgctccgtatgccttgggaggcgagactgtaatcgaggccgatgtgttgacacgtggaggtagtcaccgcgcgtgtgcagaatcgctcgactggcgaatggtcggagacgtactcgagagtaagctattcgtgcctgggattcatcgctaggcgggtgggcctgttcccgatcacgtgtgcctggaactcgcggaacgtatctcctctgcacggatgataagcgttggaaggctggtactgtgtagagcctcctgttggactactagtatcgcgcgattccagcgtgttgtactggggtccgcggtggtacggaaggggtcgtcgcgagggtataggaatacctcccttaaaggacgtttaatggcgaaggagcccgtgtgtgcgggcgacgcaagagagcggcgatgccgaagcgagcagtaaccatgccagaaccagaggcgagccagtggaacgtggacgtggacgagtagtagggaacttcgcttcggcttgtgtgtgcacagctcctaatctggggagcgccacatactgggaaagtacccgatggccttcacactcgctcgaaatggattggtagtctagcaaagaccacccgcatggacggatggacgcctagcgttgtcattgattcaccgcgaagagggtaaatcgcacattggggcgccgctaggcgtctttcgctatgggtagctctccgccgaaacgatcacctggcggccagggccgattcaatacctacaccggtgtgtccgtggggacctcccggttggcacgatacttagagccagcgatccagaatatcctgtggcgttaggcgctcgatgtggggcggaaaagcgaatacgcgggagaaagaagtccaggcgttcccttgtgggcccattggtcggcaatcgcttaaagttatcccccgagagtgaacagaggacacgtgggggtcaccatcgggatggaaggtccctgggcacaggatacccacgggccatcgcagcaaccacaacccgtacggcctcgttgtcgtacaccaccttaaacacgcaacaatttgggacacgccgccgagtgcgggcaggcgactgatatccaccgaacattgtgggagccacactcgcctatggcggagtgacaggaggcgctatccaggacaaatacactttggatgatctagataattagaccccaacatcgtgagtaataattgatcagagcgaacaagcaacgagtgggtgttacaccaggcaacatacagcaatagtgaaacagatggttgctgttcaaaatatcatttgttgcgtactatgctatgatatccccctcaagtacagactatattgtttactcaaagttcgcacgagttcgtccagaatgtgatggcagacaaacaaagctgtgtgaagacaatagtttccatggactataatatagtggtgtgcntgagttgagaatcccca

SEQ ID NO: 655121 - DNA, 399 bp, Homo sapiens
tagggcggtgaagctgcatgcagggcggctccgggtggagcgagctcatggcacgtggtggttaccggctctgctcgatgtatgcggagatgtcgattacctctggaagtactgccacattaacttcacaacggtcctggacgtcattgaggatttaggcatcattctcgtccgacacaacagtgatggctaggcctttggtgccacaagcgaaccgcccgggacacccggtgcaggtcggtgtccgagtcctcaggcatgtcgtacttaaagacgatgttgactcgctcgatgtccatcccccggacaaacagataggtggacaccaggatccgccgctggaaatccttgaactgatgatagcgtgacaggcgctcctcctgggccatgccccggtgg

SEQ ID NO: 655122 - DNA, 260 bp, Homo sapiens
cgaatataattgtaagtcatccacgctgttggtctgcaaacttttgaggtaactacacacacacacacacacacacacacacacacacacacaaggattttagatttgaaaatgatgttttttactcatttcagaatgtactgtaacctttctttggttcttactgtttgcatttaactttctctgttttcaagaagagttgtctttattgacatttgtaaaaaagaatgtgttttgcccagttattaagtattttattg

SEQ ID NO: 655123 - DNA, 372 bp, Homo sapiens
  misc_feature (100)..(100): n is a, c, g, or t
atacctcagccctgtattacctaaataggcacctccataccggccctcacctattggccctcaccatggcccattcaccctctgtgccaagaatgccttncccttcctgcccaattttatagccaaattcccctgatgacaagataagcgccccattcaaacccaagtctcctcccacctttcagctctcccagagcctgcaatgcctcagccttcaaatgcaagcaggcaacagtacatatttaacggcaattttagcaatctgtgagtgcaactccaaaggaataacaacaaagtttctaaacattaggctatttttatggttttctaatgaagatggttgtgacagatcaatggaggtctgattgtgga

SEQ ID NO: 655124 - DNA, 140 bp, Homo sapiens
  misc_feature (18)..(19): n is a, c, g, or t
  misc_feature (50)..(50): n is a, c, g, or t
  misc_feature (53)..(53): n is a, c, g, or t
atcccagaggctgtctgnngctcggaccaccagcactgctgcccccaggntancacgtgtgtagctgaggggcagtgtcagcgaggaagcgagatcgtggctggactggagaagatgcctgcccgccgggtttccttatc

SEQ ID NO: 655125 - DNA, 430 bp, Homo sapiens
gggcgttgtgacgcgcactgattttcatgacaatgaacagacacttgcggagacttatatgaacatgccagaagacatccttacttttatgccccggaactcccttgctttggtacaaggcatatagctgcttttacagaatgacggcacgctgctgttcaagctggctgcctggtgcccaagctcgttcaacttccggatgaagggaaggattcgcctgcctaacatagactcaagtgtgccagtgttcaccaatttggagaaagagccttctaagcatgtgctatagctggcctgaggcaaagatttcccgctgagtttgcggaagcttgcaagatagtgacagatcttaccagagctcacacggaacgctgacacggagatacgcctgaatgttgtggagacagggcgtgggcatgcgtgttctgtg

SEQ ID NO: 655126 - DNA, 212 bp, Homo sapiens
ttgggactcaagcctgtattacacagctgaactccacttgtgctcccagatgctcggaaggctgaggtgcgagaatcgcatgaactcgggaggcacaggctgaggttagcagacgatcgcgctgttgcactccagcctgtgcaacaagagcgaaattccgtctgtaatcccagcttactcgggaggtgaggcagaagaatcgcttgaatccg

SEQ ID NO: 655127 - DNA, 949 bp, Homo sapiens
ataataggtgtcaaatgctaaaccttttatcttcgatgtggcactgtagccatccccgacctctcccgacatccaccgcctgacagcatccctggccttgcaccagcatgtctatgtatggcactcttgccatccccgccctttcccagcagagtctcactgtgtcaccccggctggagtgcagtggcgagatcttggctcactgcagactcactgcaaacatccacctcccgggttccagtgattctcctgacttcagaactacctggagtagccttggagattacaaggacaacgactgccacacacacactggcataatccaaccgtattctttctacgtagatacacagggtattacaccatgtaggaccaggcatggtacttaacacataccaagcactatcagggatgatacccagaccatacctgcgcagccatcaccacaacaagatggactgagacgcaataaccagggcaggatgaagaacccacacacgaggcatcaagcaccataagcctgctaggatactaggtacaccacacacaaccgccaagaacacggaaccccacgagaacacaccagggcgcacacaaaccaccacgaggcccacaaacaagaagcgacggagaaccaaaaaaccagcaaacacagacacacacacgcgcacacgtcaaagccgcacaacagcacccccaccaaggcatcaccaagccaacacacgacccccagcaactacaacccctaccgagcaaacacaccctgggacaagccacccgagcacctacacacccacaatcccccgggcacaaccacaaaggaacactcacccagccacacaaaccgagggcaccacaacagaaccacagccacacacccacgaacaccctcaccctctcaccccaccccgccacccagcacgcacacagcacccacacacacccccag

SEQ ID NO: 655128 - DNA, 708 bp, Homo sapiens
  misc_feature (76)..(76): n is a, c, g, or t
agggttaaagtgttttttttcaacataaacgggtgttttccccccctcaaagaggtgggggccccccttcccccanaaccccaaggtgagcaaaggtggagatttctccgcaagtcattggtttcaccaaggggccttcaatgtgagctgtactcggaattccaaattggggcccccgggggccgaggggttccggttcggggtccgctcagccccctcacggcgaaattacggccctttcggcccaggcggcctgggtttcttcggacgattgcattttgtgttgttttagggcctccccccagggccggggggcccccacccttccgggggccaaaggaattttgtgctttgtgggtttccccccacgcgccccgccgggttttaaggaaaacaaaacccatcggggggccctgggccctttaatgcctcccacctgggggttagggttaggccccgggcaggaaagggggctcccctttgccccccctcttgtcccccaaaacttttggggggggggttccccccggggggtttttttttttttaaaacccccccttttaaaaaagggcccggttgggggctttccaattttttagggaaatgccttggtttggatttttccaaggtcccccccttagaaaattttttttccaaaattttggggggcgggttttttgttttttaaccaaaaattttaatggggga

SEQ ID NO: 655129 - DNA, 337 bp, Homo sapiens
cacccagtagacattttgcaacatctggagtcgttttggattgttttaactggggggacgtgctactggcctctggtgggtagaggctagagatgttgctaaacatcccacaacacgcaggaaagtccccacagcaaagaattatcccgtccaaaatgtcagtgtttaccaggaaagggagataggagaaaaaaaaaaggaaaggaggaaaaggatgagggggggggaggagaagaagaagaagaagaagaagaggaggaggaggaagatgaaggaaggaaaggaaggaaccaaattgtcggagcatggttgagaaaccctgttgttttgtcccttg

SEQ ID NO: 655130 - DNA, 739 bp, Homo sapiens
catatgcagactttgcttcccgcgggttcataccttgcgcctcccggctggaagaggccactttcagactgactatgccctcttcggtcctgaacacgggccccctgcagctgtggacacgcctggcaccgatctggctgccggctgtctgactgttcatggagccgccgcccctcacagggacccggtttttgcatcccggaggcgccgggcctccttcccccactgtctcacatccagtactctatatgcggggcccggctggctgaggctgaacgggccaacctggaggaggcccacccagctgtaccaggaggccgctcaacggtgaaccccagatggcggtgcgccatcatgcatagcctgggtctgaagctgaggtcggctgggccacccacgacgcttggccccgaaggtgcttcgctgatctccgtggagagcgcacgatgtatcgtgccccgacggcgtggcacagggcctggcgcgagtgtgctgcaaggcccacgggccacgtacgaaggcttcccttgagctgcttcctcaaccgcccttgaggctggaggcccagcaagccctgtgctgcccttctccatcatccccacgagaactctgacgacctcaccgccacgggagggaggggctggcccgagggacgaggcaccagggaactgggtcagggtggggccaccatggcatcaggttcggggcctcagggaaaaacatctttagtgaacgccca

SEQ ID NO: 655131 - DNA, 215 bp, Homo sapiens
gtgactggagcagctggtcaattgacttttcactgctgtacagtataggaaatggatctgtctttggtaaagatcagcctataatccacgtgctgttggatttcacccccttgattggtgtcctggacggtttataattggactgcaaggctgtgcccttcccctcctgaaggttgtttcgcaacggtaaggagacgttgcttcaaggcctggtt

SEQ ID NO: 655132 - DNA, 207 bp, Homo sapiens
gggggggaccaagtacgtctgactcccgagtaccagagctgggtgagcccgcccacaaccaccacgcacacaactactacaattcatcagtcagccctgcaatgtgagacttccgtagctgtgagagtcactgcaggtgttctttcatcccgtctgattttaacccatgggttgagacgttccaagttagatctgctgctcgttagg

SEQ ID NO: 655133 - DNA, 914 bp, Homo sapiens
ggtgccccaatacttcagctgcatgggctgttgcttctctagagcatatcccactccactaaggtccgcagaagacgatgttggtccaatggagaacgtcacctacaggagatccaatatggcatgatgtagtctagaactcaatttttaatcaaggggtcacagtcaatgtgcgggaggtaatcaaatgttgaggagaaaccatacggtcgtgccattgcagaacccgttcatctcctcacacaatcttacaagtgtgtttactcatatgtggctggatactggacttgatcttgtctgatgtatctcactgggaatcggacgacatctaaagtatgattatagtgttgatcgcgcctttgtagttgaggataataatatatactactcttttctcactttgaaccgataagctcaacatattggacatctgcttccatatgtgtagtatacttggctacgactttttgaccttgctcatatccttcgctttagtcgctatcaggttactaggcagacagtactaggtctctatacatttgaggaatgaatacaggaatctagctttgcatccacggaaattaacagccttttacgagtcatcaaagaaaaacacatgaaaaaagagaagtaaccccggggattgtacttgttcaagcaaaaatctaatactacctattgcgaagtgggaattgctgattgaacattcgaaacattatcttagcttcatttagagccagaaggctaattttttactgcaatttcttgttccctattgagcagggaatgcttaaagtgtagccataaacgttagagttgtaaatagccaaaagtgggaacagaacttgaaatacgcgatcatctacacgcagggaagccgacacgcataaacaggtaggcatcccgaaatcaga

SEQ ID NO: 655134 - DNA, 180 bp, Homo sapiens
ggatttgctggtgcagtacaactaggcttaatagggacatggtggggggtgcctgtaatcccagctactcaggaggctgaggcagtagagtagcttgaacccaggaggcagaggttgcagggagccaagattgtgccactgcactccagcctgagcgacaagagcaaggctccacctaaa

SEQ ID NO: 655135 - DNA, 544 bp, Homo sapiens
  misc_feature (417)..(417): n is a, c, g, or t
tatctacggtgcttattgcattgtcttccctggacggaaaagtaacatcaaacacggcgaccgacatagtgagacctgtctctactagaagaactataaaaatcacctaggtgtgggccgggcacggtggctaacgcctgtgatcccagcactttgagatgctgaggcaggtggatcacgaggtcaggagatcgagaccatcctggataacacggagaaaccccgtctctactaaaaatacaaaaaaattagccgggcgtgggggcgggcatctgtagtcccaattactcgggaggctgcagcaggagaatggcatgaacccgggaggcggatcttgcattgagccaagatcacgccactgcactccagcctgggcgacagaatgagactccatctcaaaaaaaaaaaggaacccanggatatagaataaaccaggagtgtagattggggcatggaggccttcaaatgggatggttctcagtgtccagaagaaaaaacaattttagaagagacccaattcagaaaacaaaggtggggctgaata

SEQ ID NO: 655136 - DNA, 607 bp, Homo sapiens
  misc_feature (523)..(523): n is a, c, g, or t
  misc_feature (544)..(544): n is a, c, g, or t
tatagacatttgtagctataaatttttatctcagcactgatttacttcatcccttaagttctgctatattgtgttttcccttttttaaatctaaaagtatattctgatttttctggtgatttctcttttatctcttggttatttaagagtttgttgtttaatttccacatatatgtgaatttcccaggtttccttctgttattgacttcttttcttatttttgagagacaagatctcactttatctcccaggctggagtgcagtgcagtgatcgcagctcactgcagccttgacctcccacctcagcctcctgagtagctgagactacaggcatgagccaccaagcctggctaaatttttaaaaattttgttgtagagacagggtccgactatgttgccaggctgtgtggaactctgggctcaagtgacctgcacttttccttccgtgctgggattacgcatgagctaccatacctggcctgtactgattcttattcactccattatggctaacatagaatgnatgattctcgcttttatatgnattgaaggtattttaattggcataccgaatttctgtccagagtgtgaagtatttctgctcttg

SEQ ID NO: 655137 - DNA, 109 bp, Homo sapiens
tcggacctctcctcttcctctttcttgtatgtctggaaaagcacattgccagatccatggctgcagagcacgtgcttgaagctattttaatctgctcctgaaattgata

SEQ ID NO: 655138 - DNA, 99 bp, Homo sapiens
cctcattatcatcactattattgctcccccctgtatcccctttactgggcaagtgcttgtcaagttttagttgttcaataaatttgttaataatgctga

SEQ ID NO: 655139 - DNA, 423 bp, Homo sapiens
  misc_feature (10)..(10): n is a, c, g, or t
  misc_feature (36)..(36): n is a, c, g, or t
  misc_feature (379)..(379): n is a, c, g, or t
  misc_feature (382)..(382): n is a, c, g, or t
gatttaatantaaattgccatgtgttaatttcaaancccgtccttacccagcaatccctatgaggtagcctaatgatattattcctctccctaatagttggagaggttgaagcattaagaaattaaaaaggccccggtgtggtggccttacaccctgtaatccccagcactttgggaggcccaaggtgggaggattacttgcccagaagtttgagacccagcccgggaaaacaggcaagacaccgtctctacaaaaatttttttaaaaaattagctgggcatggtgacacaccagtagtcccagctactcaggaggctgagacaggagaattgcttgagcccaggagtttgaagctgcagtgagctatgttcacaccanctnctccggcctgggcaacagagcaagaccttgaaaacaagaac

SEQ ID NO: 655140 - DNA, 367 bp, Homo sapiens
aagacagagtgttgctcttgtcccccaggctggagtgcaatggtgcaatctcagctcactgcaacctctgtctcccaggttccagtgattctcttgcctcagcctaccaagtagctgggattacaatagcctgccaccacacccagctaatttttgtacttttagtagagacggggtttcaccatgttggccaggctggtctcaaactcctgacctcaggtgatctgcccacgttggccccaaaagttctgggattacaggcatgagccactgcacccagccaagagtcagtctttctaactgatgaggccgcacattagttagcaacttctattacaatatgtgttattattcgatttccagatgc

SEQ ID NO: 655141 - DNA, 93 bp, Homo sapiens
tctgaagacacggccgtgtattattgtgcgattagaggtcgccagcaactcggcgggaactactactacgccatggacgtctggggccaaggg

SEQ ID NO: 655142 - DNA, 378 bp, Homo sapiens
actcacccagcttcctttcaccagccaacacaaatcacatggcaacgcaacttccaggactgcactgtcatctactgtgtgcctggaagaacaagagatggactgttagagaggggcccttatgagttccataagtatattctattctgccatgacctctaatttcctaaaccattttcctaccaatggatatctgggccacgagcaatgactttactactttatgtatgacttacaaaccatgtgctaaaaattacttcaactgactacttacctacaacgcccagtcaggaagactttattcagacaccataaccggtagctactacagacccaccacaactacgggtctggcacgccacggaacaaacgactcga

SEQ ID NO: 655143 - DNA, 264 bp, Homo sapiens
agccattggatctgtcaacgggccgccctgcctggggttgttaccgccgagattaacggatgctcgtccataaagaaacttaacgttgtgcctgcctcggtgtctatggtgtatacataggacttaggactgaatctcccgccctggtctgtttccgctctggtgtcctgtcctggggtgcatctcaagaaaccaggttcttggccgggcaaggtggctcgcgcctatggcccccgccctctgaacgccgaatggggaggatcg

SEQ ID NO: 655144 - DNA, 175 bp, Homo sapiens
tagaggatccctctcgcttagtgtcccgatgggctgtgggtctatgtggactgctgcccggcttgccgcgctcctgctggtgagtgcccagacatcctgccaaagtgtctgagcgagcacgagtgttggggacgacgtgaccactctggccacacggtgaccgatggacagatgg

SEQ ID NO: 655145 - DNA, 825 bp, Homo sapiens
  misc_feature (55)..(55): n is a, c, g, or t
  misc_feature (173)..(173): n is a, c, g, or t
  misc_feature (450)..(450): n is a, c, g, or t
  misc_feature (463)..(463): n is a, c, g, or t
  misc_feature (752)..(752): n is a, c, g, or t
agtgaatatcatacaagatgtagatctgatgagaggcaggacgacagtgaggggntccgtgttcctgcgagctcatgaatgtccagtcatatagagtggctcgcgttgatcctcgaagagtgtgtactagtatctaatggacggatctaactaggagtgaacgcgagacgacngtgatcactgtcttcaagtacactgcgattaccacatggtctgcgtagtcttgtgaagtaggctcagtaatttagcatgatgtgcaagcaaggtaggagtatatgcaagcaagctaacagtatggttctaacaatatacagtcatgtatgatgcgacagagctacgcatcatacgcgtctgggttgtgggctgagagctagttatgggttcgtagatgtgatacgagtttggagagtttattctgtagactagtcatttaggtattccacatcgttntccgatatgtcantagggtatattcaatgcataagtgtattgacaagggtttcgtggatataatcatgcttctactaaaaattaacgatgacataggagtcaagacacatgtagtgatgatggttaatgcacttctaagagtaggactatcgttcgtgtggtgtggtccgcattacttagtagacagatagtgaagtcgccgaaagttaatttggcatatattgagcctattattcgattggatagtacttagtagcgtctagttcgtatgagacgctaggatatgtactaagatagggcgntggggaaattatacttcggatcctcaagtttgcacgaatgagctggggtcgcggacatagtattgtttattca

SEQ ID NO: 655146 - DNA, 116 bp, Homo sapiens
ggacaggggccttcgagattgagatcaatggacagcatggtgttctccaagctggagaatggagggtttccttatgagaaagacctcatggaagccatccgaagagccagcaatgg

SEQ ID NO: 655147 - DNA, 914 bp, Homo sapiens
  misc_feature (3)..(3): n is a, c, g, or t
  misc_feature (100)..(100): n is a, c, g, or t
  misc_feature (102)..(102): n is a, c, g, or t
  misc_feature (125)..(125): n is a, c, g, or t
  misc_feature (140)..(140): n is a, c, g, or t
  misc_feature (151)..(151): n is a, c, g, or t
  misc_feature (167)..(167): n is a, c, g, or t
  misc_feature (177)..(177): n is a, c, g, or t
  misc_feature (184)..(184): n is a, c, g, or t
  misc_feature (191)..(191): n is a, c, g, or t
  misc_feature (193)..(193): n is a, c, g, or t
  misc_feature (208)..(208): n is a, c, g, or t
  misc_feature (210)..(210): n is a, c, g, or t
  misc_feature (220)..(220): n is a, c, g, or t
  misc_feature (223)..(223): n is a, c, g, or t
  misc_feature (227)..(227): n is a, c, g, or t
  misc_feature (235)..(235): n is a, c, g, or t
  misc_feature (238)..(238): n is a, c, g, or t
  misc_feature (258)..(258): n is a, c, g, or t
  misc_feature (260)..(260): n is a, c, g, or t
  misc_feature (273)..(273): n is a, c, g, or t
  misc_feature (282)..(282): n is a, c, g, or t
  misc_feature (304)..(304): n is a, c, g, or t
  misc_feature (316)..(316): n is a, c, g, or t
  misc_feature (320)..(320): n is a, c, g, or t
  misc_feature (324)..(324): n is a, c, g, or t
  misc_feature (326)..(327): n is a, c, g, or t
  misc_feature (339)..(339): n is a, c, g, or t
  misc_feature (341)..(341): n is a, c, g, or t
  misc_feature (352)..(352): n is a, c, g, or t
  misc_feature (366)..(366): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (386)..(386): n is a, c, g, or t
  misc_feature (407)..(407): n is a, c, g, or t
  misc_feature (412)..(412): n is a, c, g, or t
  misc_feature (419)..(419): n is a, c, g, or t
  misc_feature (423)..(423): n is a, c, g, or t
  misc_feature (428)..(428): n is a, c, g, or t
  misc_feature (445)..(446): n is a, c, g, or t
  misc_feature (541)..(541): n is a, c, g, or t
  misc_feature (550)..(550): n is a, c, g, or t
  misc_feature (611)..(611): n is a, c, g, or t
  misc_feature (811)..(811): n is a, c, g, or t
  misc_feature (825)..(825): n is a, c, g, or t
  misc_feature (909)..(909): n is a, c, g, or t
ggngttgggatcttaatataatatttggggggtactaactattctttattgctgtaactgttaaaagtttaattcctgagatttttggagtcggtaaaantncttaaagtgagcagaggaaaganatgtctttcccaganaggaggctganctgtgaatcaacagtntcaatcagtnactttcngtcattntnccatacagcagtctncntctggcatangtntacnctgtagtntantccttgactgcccccaaaananactactctaagangctcttggnagttctgaaatgttcagttganagatggtatatnagtnaaantnnttattgtgaaananttgtgattgtnaagtggctttggtntntngnagtatgagcttgtntgtgagtgtgttagatctggnttggnttagatnacanttcangtgtctgctttaaaatnntgaactgaagaacattaatatttatgaagcacagatataaatacactttctgaaagggagaatattgaatattccttgaaaatgatttgtgttgntcatttttnagactatcaagattacaacctagcctttggtccacatcacatttttaatagttcataactntttatccatatacttaactaaaaatttagaaaacgtttatcaccaagtgcatgaaggaaaacttcaaactgtaacatttcatttaaaagctatattcaaatgaagataggatctgaatataagctatttgtgcttattttcagctatggctaacacataagctgttcattgggtttttgcttgaaatggagttgtatcanagtcttggaaatgnaattccctttagaagttgtgatcttcataatagcaccatttaaagcatcatcttcaatgagtgttattaaatccattggcaatnaatgg

SEQ ID NO: 655148 - DNA, 920 bp, Homo sapiens
tgctgttactggtccggaattttaggcatgttgtggtcctctctcggctcctcgcggatcgcggtggacgacgtgttcctgggacaccgtgcttgcttgagccgttctggggctcagtgcgttctctgctgcgctcccgtgttcgctggacgggaagaagggctgggccgtcccgtccctgtccccatcgtgaaccccaatgtctgctgccgcttgatcctgtccgcattggctgatgagtgatgctgctgtgactgcatgctggcctggtggcgcccctgccctggatctgctgcctggagaagggtccgaacggctacgggcttccacctgcactggggagaagggcaagttgggccagtacatccggctggtgtgagcccggctcgccggccgagaagggcggggcatgctggcggggtgaccggctggtggaggtgaacgggtgaaaacgtggagaaggagacccacgcagacagggtggtgagccgcatccgcgccgagactcaacgccgtgcgacctgctggtggtcgagccctgagaccggacgagcagctgacagaagctcggcgtccaggtccgaagaggagctgctgcgcgccccaggaaagcgccggggcagagccgaggcagaccgtgccggccgccgaggttgcacgaggggcttggccaccggaacaattgagcctcggcgaaggccgacgaggaggccacctcggcagcagagcgaggcttcgggagtcgggatctggaccaatggacagaatgggaccgcaagatggcatatgggcctacgaccctgcacaagagaacaagacccaagccccgggccagtacgatcggggcagagagaccacaaaaaccacgggaagagggcttccgggctccagggccgaggagcagcattgaggacggagaa

SEQ ID NO: 655149 - DNA, 905 bp, Homo sapiens
gctcaggtccgcgtgctctccggaccaccccacttccatttgggccaaaccaaccgcacccctgaaatttctccgcaaatgtcctggcgggaaggatcccaggcattgagagggtgatgatggattctgtgtgtttgagagcaacgcctattgcctactatgtgagcaatgaggagctgctggggaagtactaccacgaggcagcagaccctaaggtggtgcagtgtgaggtttgagcttcgctgattccgatatagtgcccccagacccagtacctgggtgttccctctaccttgtggctatcatgcaccacaagaaataggccacgtgaggtaatgcaataggaggacgtgaggcgaattctggggctgctggatgcgttacttgaagacgaggacttttctggtgggcagaacgagtgacatcgggtgacatcacagtgtgtcgtagcaccctgtcgtggctctataagcaggttctagagccttctttccgccaggccttcgccaataccaaccgtctggttacctcacctgcataaagccagccccagttccgggctgtctatgggggaagtgagactgtgtgagaagatggcccagtttgatgctaaccaagtttgagaaacccaacctaaaaaggacacaccaccggcaccagagaagggtgcacgggaagagagcagaagcccaggctgagcggaggaggagaaaaggcgggtgccctggtctgcaggaggagatggtgatgtgaccagggctggtgtgagcccagggcatgaccctcggtcactggcagatactttgtgtggcgaaatagcgcactgtccagggaaccgtggggggcgatcggggacggaaagcggggccccggcccgaaagctaaaaaccccacgaggacgagcg

SEQ ID NO: 655150 - DNA, 1095 bp, Homo sapiens
  misc_feature (351)..(351): n is a, c, g, or t
atgagccacctgtttcacatggcctatcatatagttaaaatccaggcccatgacccgctaatagggggccctctcagccctcctaatgacctccggcctagccatgtgatttgcacttccactccataacgctctctcatagtagagccatagataagacagatagcagctgaagccatatagccaatgagtggcgcgatgtaccacggaagattagctcaatactcataggggtcatcctatgacacccatccatgttcctatacacaaggtcctttcgactaacgagaggagtagaatcctcaattttgattttagccgtctatggaacgttgtgtttgtctcttacgnctgagtatgtattatcctgaggactctgtattaatcagatcactacctcattagtcctgctaaacccgcacacaaagtgtattaggagtgggcaccgataggggctcaccatagtatagtgtacctacaactcccagcctatataggtcacacccgtaatatcctgttgcgcatcctccctatatactaccacttcctggtactccacccacttctgcagtaaccagagactgtacatcattcatcaaaccttgcacgtttgatcacattaattcttcttgtaccttcaaggacacccaaacgaaatccccggagccctcaccagcaactttaattgaacttttccacgagcgttgaccatttattttgagcttgacctttgtttatcacctggaggctacatgcatactctggaaaactctctatcacattattatacgcctccttacagaaagaggtaccatctacgcgtttttaactaccctttcccacactagtgagcgcgcaatggggcgaatcattgagacgtgagactcgaaggcgaaatagtcttttgaggttaatcacaaccaatgccactctcaccaattgggtgatcttccaccaccggttgcgatgggattcggcggttttcaaattgtgtttaggcttgttccaccataattcctggactatatcattctcgcgccaaaaattaagagtaattctaccactgtttgtagcaatacaccaaattgcattcca

SEQ ID NO: 655151 - DNA, 123 bp, Homo sapiens
gggggggggcccccccttttttttttgggccttcccccctttggggggggggttttaaggggggggggggggggggccgttttttttatttttcccccccaaaattgggccccctttttggga

SEQ ID NO: 655152 - DNA, 470 bp, Homo sapiens
agcggagcgtcctcctgtgcaaggcggtaggggcccgtggagtgggcaagtctgccttcctgcaggcctttttcggccgcggcctggggcaccaggacactagggagcagcctcccgggtacgccatcgacacggtgcaggtcaatggacaggagaagcccttgatcctctgtgaggtgggcacaaatggtctgctggccacatagatggacgccacctgtgacgctactctgcttgatgtttgatggcaaggacccaaagtcctttgcacattgtgccagcgtctacaagcaccattacatggacgggcaaaccccctgcctctatgtctgctccaaagccgacctgcccaaaagtgtcgcggtgtttggaccatcaccggacgaatttttccgcaagcaccggcttacccgttccgggccgattccctgtgctgggccatccgggcccagcaccaaccattttttaac

SEQ ID NO: 655153 - DNA, 652 bp, Homo sapiens
cttgatccaggaatgctatccttacccctatcccataccctgtacttactggacaaagccaatttactgagcacaaccgccttcaaccagatcagctgcacggccaagatgatcctgtctgctttctggcaatgcccttggctcaggaccggctcctttatgatgaatagatgccaaggatcttggagcgagacagtggtggtgcagacgcgtggcgcacggatggagcgtgtcttccatttgccttagatgtttcgaacgggaataccacagacctggactctaacgatggatgtcaaagaatttgagcgctggcgtggacatcacgagccagactcctcgtatcgagcattatggatagtctcccagtgatcaaaaagagactggttgtggaatcctgttggccctagttggtttcaagcctagagtacattcagagaagtttcttaagtcgtctatactttggcattggtagcttggtgtgagccggatgacccctctgaatcctagaaacccctcttgcctctcttaccacgtgaaggagggccttgggccctcgtggagcctctgtgtccgttttggcctgctgctctcgctagactaataaacgagccccttggcggtcgcaagcttaatcacgcctataaagggg

SEQ ID NO: 655154 - DNA, 426 bp, Homo sapiens
cgagaaacgggacttgtaaaacacttcctgcactatctaccaagagactctgtcagatcacacagggtgagggctcagtccccatgagtgccccttctaacccccattagttgcaactatggccctccaaaagttctaactgaccaccttcaatttggggttcccatggctccctttttaggtccaattaatttgctgaggtggtttacctaagggagatgcttctgttaactggtttattataacacattttgcaaaggatccagttaaaggaaatcttggggccaaggaatggggaaaggtccccatttgtttgaaagctttctggccccatttttctggggtttttatggagggtttctgaccccaactttctgcccctaagagtattaaagctgccctctttttggggagggttcaccatcc

SEQ ID NO: 655155 - DNA, 403 bp, Homo sapiens
cgttatagcaccgtggtatgatccttctatgactaattgttgaaagtttttgatcatgaagggatgtagaattttatcaataatttttctgcatctattgaggtgatcatatggtgtcttagtccattttgtgttcttaaaaaggaatacccgaggctgggtaatttattttttaagaaaaggtttccctggctcctgattctgatgcctcaaaaagttcaagactgggcatcttcatctggtgagggcattaggctgcttccactcacggtggaaagcaaagggaagccaacttgtgcagagatcacatagagagagaggaagcaacagagaggtggggaggtgccaggctctttttaacaagcagcactcacaggcactaatagagtgagaactcactgat

SEQ ID NO: 655156 - DNA, 1026 bp, Homo sapiens
atgacggatgtgtgtgcaagcagagctatatggaggccttgcaggagttcggacccatcagctatgtggtggtaatgcctaaaaagagacaagcactggtggagttagaatgatgtgttgggggcttgcaacagcagtgaactacgcagccgacaaccgaaatatacattgctggtcacccaggctatatgtacaatctcactcgtaaccagttatcagaagatcatcccgaccctggggactcggatgactcccggagcgtgaacagtgtgcttcactttaccatcctgaaccccatttatatcaatacaccacggatagtactatataacactactctgtaatccttagtggaccctgtccagagaattgtcatttcccaggcaagaatggacgttcaggcgcatcggtggccatcttgacctcagtttccaaagatgccgcagcgaggacccaagggcctcatcttcaaataggggactagatcatctaattctaggcctgtatgcacatactgcacagatcgacatacgccaacagcctaccaccgcttgaactgtgtacaacgacatgactcacggcatactttaggcaactaacaccaaaaccccgacattctccagatggaacaagtgtagacccctttggcagacaacacccccagacaacaccgccagcaggcagcaccaccttctcgcttcggcaagaatcaagacccggcacgacctcattggaacggccccacactgcaggcgtacccatcaagaccactcaaccataggaatcaacgggcactacagggagcgacaaacacgaacagctataacaagtacgacgaaggtaaagccaaaggacacagagaccaagacgcagacagcgcgagagcaacacgaccagggcccaccgcacgcaaccactgaggtacgagaacgcacaaggcacagaaccgcccagcaccgtcgacacgcacacagcacgtcagcaagccacggaccaacaccagcaacccacagcgcagcgaagccc

SEQ ID NO: 655157 - DNA, 310 bp, Homo sapiens
caaagacatggggctacatagcgtgaccaaggacatggtagtcaccatagtgctagcacatcaaggcagctaggaccataggtgaccataggtaccagattcctacgttacccaagcagggacctgagtggacataaagatgggcggctgatgtctcaagggcaaactatatctgtaaatgtctaaggacaccagaaacctcatataactccgaggagggatagctcaagaataacaaattaagttttccacccgtccagtggcatgcgaacacacagtaagaaatccggttgagagacctgctaccgta

SEQ ID NO: 655158 - DNA, 703 bp, Homo sapiens
cgaaaaatactcccgaagctgccaacctctcccaaggaagaaaacttccaaggcgggttcagccttggtagaaataaggctgtccgtacctggcaacacctttggacagacacagttttttttcaaggaaaaacaagcatctcagtgcccgaccgtcatggaacctagaagctaaaagcccgcctccagaacccttataaaacaaaccgtgatctgggcgtagattaacacacggctccaaactgcgccagtgtaatcacagttccaagttcaccaaggtgaaggaagaacccaaatcagtacaagctaattcgttcccttagcagtgctatccacatacaccccacaggtggcatatggatagttgatcatcaggtgtctgttataataaaataagcataatatgagtcttgtaaggatctagataaagacaatcgttgaatataggctaagctcttacagtttgagtatgaaagaaattctggtccaagggcagaatgttaggtattcagggttcagaacacagagagatcccctttatcagaaagcgtttatcatcaggctcaactagaacctagggtagatgcactacaagaaaatggtggccgtctgtatacaccctaatccacggaagtaagttgtacaaatctcttgagacttttgcaattgtctatttaaactagagtaaaagcaagatcctgca

SEQ ID NO: 655159 - DNA, 295 bp, Homo sapiens
ccccccccccttttttttcccccctttttaaacccgggggcggttcccccccccgggttttttcctggggccgggggggggttctctttttcccccgggacccccttttcccctttggccctttttgggggcccctttaaccctttttttctcaaaaaacgggggggggcccggcccggtttttcccgggtttttttcccccccggccccgttttcccttgggggggggggggggcccccggggtttcctttcccctttttttggccccctttttttaaggggccccccctttta

SEQ ID NO: 655160 - DNA, 207 bp, Homo sapiens
ggcctcctcggcttctttttttccctccccccccttaccccaagctgctccattccttaaggaagggctctctctccctccccaagtagggcggacggcggggcgcgttcagaaaacgtacaccgaagatgtccagggataggcaaaggtccgatgatgagagccaccagacaccagcaagggggagtacagatgaggaccagcgag

SEQ ID NO: 655161 - DNA, 462 bp, Homo sapiens
  misc_feature (455)..(455): n is a, c, g, or t
tgttcctccaaaggccctcaaggaccccccccaagagcagaaaagaccagaaaaaccatttaacccagtggaatatctcttttgatgagattgtcaacattggctcgacagatgcgggccccggtccttagccagagaactcttctggaaccattaaagagatcctgggggctgcccagtcagtgggctgtaatgttgatggccgccatcctcatgacatcatcgatgacatcaacagtggtgctgtggaatgcccaaccgtaagtgacattttcattgttacagtaggggtgaaaggggggccgcccagtgtattcacaaagataagctgggaagttttggaaatggttactggtggggtgggataatccctttaaaccttttactgattttttttttctttcccccagagttaagcccaaaggaaaacctttccataaagggtcctttggccnctggtga

SEQ ID NO: 655162 - DNA, 808 bp, Homo sapiens
ggctagcttgtctcttctgtcaaacccacatcgcctttggcacgagtgaagtgggtaacctttatttgcccttctttttctctttagcctcgaggttataccaggggtgtgtctcgtcgagatgcacacaagagtgaggttgctcattcggtctcaaagatctgggagagagaaacatcgtcaaagccttggtgtcgattgcctttgctcagtatcttcagcagtgtccatttgacagatcatgtcaagattagtgaatgaacgtaactgaatttgcaacaaaccatgtgttgctgactgagtcagctgaacacattgtgacgaattcacttcataccctttttggagaccaattatgcacagttgcaactcttcgtgaagactatggtgacaatggctgactgctgtgacacaaacatgaacctgagagagtatgaatgcttcttgcaacgacaaagatgagcaacccaaatctcccccgatgggtgagaccagaggtcgatgtcatgtgcactggattctcatgaccacatgaagagacattgcgcaaagatacttatatgaacttgccagaacacatccttacgttttatgccgcggaaactcctttactattgcctcacaaggcataaacgcttgcgtttagagcagcactgtttgcaacgcattgttgatcacaggctggccttacctgttggcccaaaagctcgacatgaaacttcacggactgcacggggaagggctacggacgtgggcaaaacaggacaactcaagtggtgcccccctccacaacattggaccaagaact

SEQ ID NO: 655163 - DNA, 630 bp, Homo sapiens
cagcttacactgaggcgcttggaaaccaccgtcaatatggaccgcactgggaaacacagatgaacaaagtcaacaccgctttgtccttcaacaaaaacaaaaaaaaaaaaaaaaaaaaaaaaaaaaaaaaaaaaaaccacaaaaaacaaaaaaaaaacagagaaaacaacaacacaacactcacaccaaaccacacagcgcgcgcgcacaaccccccactttatactacactcagacgcaaccgcgccaccctcaccaacaaacaacaacaacatcaccaccctccacactcccccctcacaccacactcatacaactaatcacctcctccacccactcccctctctcactcctcacaccacaacatcactctcccaactcatcaaaaacaccaaccgccaaccacatcaccacccaccctcaataaccacatccctacctaaaaccaatccactacatctccccccaccatctcaacccacaccccgcaaccaacacaacataacacccttcactccaacgcaccacctataccaataatcatactcaaaactactaacctctctatctactccctgccacaaacccaccacaatcacacaaacacaacaatacccactatctcaccta

SEQ ID NO: 655164 - DNA, 883 bp, Homo sapiens
  misc_feature (7)..(7): n is a, c, g, or t
  misc_feature (65)..(65): n is a, c, g, or t
  misc_feature (78)..(78): n is a, c, g, or t
  misc_feature (92)..(92): n is a, c, g, or t
  misc_feature (133)..(133): n is a, c, g, or t
  misc_feature (141)..(141): n is a, c, g, or t
  misc_feature (154)..(154): n is a, c, g, or t
  misc_feature (163)..(163): n is a, c, g, or t
  misc_feature (188)..(188): n is a, c, g, or t
  misc_feature (192)..(192): n is a, c, g, or t
  misc_feature (202)..(203): n is a, c, g, or t
  misc_feature (222)..(222): n is a, c, g, or t
  misc_feature (226)..(228): n is a, c, g, or t
  misc_feature (258)..(258): n is a, c, g, or t
  misc_feature (272)..(272): n is a, c, g, or t
  misc_feature (305)..(305): n is a, c, g, or t
  misc_feature (353)..(353): n is a, c, g, or t
  misc_feature (357)..(357): n is a, c, g, or t
  misc_feature (504)..(504): n is a, c, g, or t
  misc_feature (548)..(548): n is a, c, g, or t
  misc_feature (558)..(558): n is a, c, g, or t
  misc_feature (664)..(664): n is a, c, g, or t
aaaattnaaaaacaattgtttcattaaaaaatattgattttaaaaactaattaatttattaattnctacacgcaaaanataataattaaatnttgtccacaaaacattctcctttccttctgaaggttttttnttgctttntttttattaaccngttttttantactaaacttaaatggccaattganacanacagttctgnnaccgttcttccaccactgntttnnngtggggtggcaggtattagggataatattnatttagccttctgngctttctgggcagacttggtgaccttgccagcnccagcagccttcttgtccactgctttgatgacacccaccgcaactgtntgtntcatatcacgaacagcaaagcgacccaaaggtggatagtctgagaagctctcaacacacatgggcttgccaggaaccatatcaacaatggcagcatcaccagacttcaagaatttagggccatcttccagctttttaccagaacggngatcaatcttttccttcagctcagcaaacttgcatgcaatgtgngcggtgtggnaatccaatacaggggcatagccggcgcttatttggcctggatggttcaggataatcacctgagcggtgaagccagcggcttccattggtgggtcatttttgctgtnaccagcaacgttgccacgacgaacatccttgacagacacattcttgacattgaagcccacattgtccccaggaagagcttcactcaaagcttcatggtgcatttcgacagattttacttccgttgtaacgttgactggagcaaaggtgaccaccataccgggtttgagaacaccagtttccactcggccaacaggaacagtaccaataccaccaatttt

SEQ ID NO: 655165 - DNA, 577 bp, Homo sapiens
  misc_feature (83)..(83): n is a, c, g, or t
  misc_feature (119)..(119): n is a, c, g, or t
  misc_feature (162)..(162): n is a, c, g, or t
  misc_feature (179)..(179): n is a, c, g, or t
  misc_feature (283)..(283): n is a, c, g, or t
ctgccccttaagttgttgacggaaaactgttttgacacgccaaaactggatgggtggggattggggtgtgttgttctacaaanaatgttggtggcgaagtccccattttcccagggatnataggagagggttttggacagcatgtcaacggagaaggtttgntacccccgcttcctgtnggcggaagccatcggcatcatgagaaggctgcttcggaggaacccagaacggaggctgggatctaagcgagagagatgcagaagatgtgaagaaacagcccttnttcaggactttgggctgggaagccctgttggcccggggcctgccaccgccctttgtgcccacgctgtccggccgcaccgacgtcagcaacttcgacgaggagttcaccggggaggcccccacactgagcccgccccgcgacgggcggccccttacagccgcggagcaggcagcctttttggactttgactttgtggccgggggctgctagccccctcccctgcccctgcccctgcccctgcccgagagcttttagtttttaaaaaggcctttgggatttgccggaaaaaaaaaa

SEQ ID NO: 655166 - DNA, 212 bp, Homo sapiens
  misc_feature (27)..(27): n is a, c, g, or t
  misc_feature (34)..(34): n is a, c, g, or t
  misc_feature (59)..(59): n is a, c, g, or t
  misc_feature (129)..(129): n is a, c, g, or t
aagactctgtctctacaaaaagttttnaaaaatnagcctagcatggtggtgtgcacctntggtctcagtctcctgagtagctgggattagaggtgcacgccaccatgcccggctaatttttgtattttnagtagagacggggtttcaccatgttggtcaggctggtctgaaactcctgacctcgtgatccaccggcctcggcctcccaaagt

SEQ ID NO: 655167 - DNA, 154 bp, Homo sapiens
agactcctgaagctggacgggacgcaacacttaaatctgcggacagggcgcgcgagccgctcgtgttcttgtcgtagttgttgagccagccatcttcaaagtccatgttgtaggcgttgttggcggagcgctgcgacctgtcgagctatctaca

SEQ ID NO: 655168 - DNA, 179 bp, Homo sapiens
agaggatcccccgtccgtcgaccgcttgctggacagtgtttgtgccacagtgtccagtaccaacctgaagatgcttcttgagcatctcgtcacttatccctaggtgcctctggcaggccccagtgttacagaagcagccggttcgcacatggatgttgtgaagaagcggtcgacggacg

SEQ ID NO: 655169 - DNA, 579 bp, Homo sapiens
  misc_feature (245)..(245): n is a, c, g, or t
  misc_feature (250)..(250): n is a, c, g, or t
  misc_feature (252)..(252): n is a, c, g, or t
  misc_feature (254)..(254): n is a, c, g, or t
  misc_feature (256)..(257): n is a, c, g, or t
  misc_feature (262)..(262): n is a, c, g, or t
  misc_feature (297)..(297): n is a, c, g, or t
  misc_feature (310)..(311): n is a, c, g, or t
  misc_feature (313)..(314): n is a, c, g, or t
  misc_feature (319)..(319): n is a, c, g, or t
  misc_feature (328)..(328): n is a, c, g, or t
  misc_feature (339)..(340): n is a, c, g, or t
  misc_feature (345)..(345): n is a, c, g, or t
  misc_feature (365)..(366): n is a, c, g, or t
  misc_feature (369)..(369): n is a, c, g, or t
  misc_feature (371)..(371): n is a, c, g, or t
  misc_feature (374)..(377): n is a, c, g, or t
  misc_feature (379)..(380): n is a, c, g, or t
  misc_feature (387)..(388): n is a, c, g, or t
  misc_feature (400)..(400): n is a, c, g, or t
  misc_feature (406)..(406): n is a, c, g, or t
  misc_feature (417)..(417): n is a, c, g, or t
  misc_feature (441)..(441): n is a, c, g, or t
  misc_feature (445)..(445): n is a, c, g, or t
  misc_feature (447)..(448): n is a, c, g, or t
  misc_feature (456)..(456): n is a, c, g, or t
  misc_feature (462)..(462): n is a, c, g, or t
ggggtggcaacccccacctgtggccttatatccctccctctccactcccctggccctagagcctgtgcccctctggccccatctcacatgactgtgaagggggtgtggcatggcacgggggctcatgaaggcacccccattcccaccctgtgccttccttgcgggcagagagggagagaagggctccccagatctacacccctccctcctgcatctcccctggagtgttcacttgcaagctgccnaagcngncnanncctgnacacccacctccccagacacaactcccttccccangcacacatctgcnngnngctgncccctcagncccttcctacnncccancacgcgcctactatccccannggnanctnnnncnnacccacnncgcaccccctgnactgcnttacagcatantctcatctctggccccgaggctgnctgngnngcgagtgnagcctnccatcactgagacagagcacagaccacgagtgcctttaccggacctggacgttgcctccagagcacgcaccagctctgtccctctctagacagagatatatttgtggttctgcggcg

SEQ ID NO: 655170 - DNA, 214 bp, Homo sapiens
  misc_feature (24)..(24): n is a, c, g, or t
ctaggtcccatttccaacatgggngattacaatttgacatgagatttagagaggacacctatccaaattatatcacattgaaaatatatacatcatgtactatgccgagttaaacattacacgcacacacacacacacacacatccttgttcatgaagatagtatttgatgctgtgacaaagagaaagagaaagagagaaagcaggcacaggtg

SEQ ID NO: 655171 - DNA, 575 bp, Homo sapiens
  misc_feature (413)..(413): n is a, c, g, or t
  misc_feature (437)..(437): n is a, c, g, or t
  misc_feature (441)..(441): n is a, c, g, or t
  misc_feature (443)..(444): n is a, c, g, or t
  misc_feature (452)..(452): n is a, c, g, or t
  misc_feature (458)..(458): n is a, c, g, or t
ggggtggcaacccccacctgtggccttatatccctccctctccactcccctggccctagagcctgtgcccctctggccccatctcacatgactgtgaagggggtgtggcatggcacgggggctcatgaaggcacccccattcccaccctgtgccttccttgcgggcagagagggagagaagggctccccagatctacacccctccctcctgcatctcccctggagtgttcacttgcaagctggccatgatggcctctggatggtccgtggaactccttgaacgtttagaccctgcacacatctggaaggagctggcccctcagtgccttcctacttcgcaacaaggggctcactatcctcgaaggagctgttgaggacccacgacgcaggccctgtactggattaccgcatantctcatctctggccccgaggctgnctgngnngcgagtgnagcctnccatcactgagacagagcacagaccacgagtgcctttaccggacctggacgttgcctccagagcacgcaccagctctgtccctctctagacagagatatatttgtggttctgcggcg

SEQ ID NO: 655172 - DNA, 1214 bp, Homo sapiens
  misc_feature (528)..(528): n is a, c, g, or t
gccagcactgagttctgcccgggagaagccgacccctcccgcaatgcccgccccgaccgtgcgcctcctgccatgctgcacgcggccgccctcccgccctgtccgctctctgggccaagctgctgtgcggtgcctgtcttcttgcgcctggccattcgatggcctgacgtgtgcattgctacactgtgatgctctgcctgtgcctgctcatgcattgtcctgccctgtgcagccgggttgtgtggcctgtggggcggcctccggtgcaggcgaatggagctccgacggtgcttggtcgctacgttgctgcgccgctgctgagccgctcgttgccatggagcatcgtcacctgtcacgctctgttggcctgtcggatgatgggcgatcgcgtggctacctgggagcgcgtgctgtttggcggtcctgtgcgtgcgcctagggcgagtgcggtctgggaagctgctcggctcgaccgggtctgtggcactactgtaacgaccttcttttgggcgcgcgctttggactganttgcgactcgcctgtggccccgcaaggcagctaggccagcgctctcggagcctgctagtccggctccttgcttgcaccattctcgtgcgagttgcgttgctgtgctgcccgagcgccgccttggatgctgaaagggtgcgccgcggcccggcaggttgtgcgaattgcccattgccaaccatcctggtggacccatgcgttcgaccaaagctgcctgcaacttaaccaattgggccgggacagatgcgctagtcttccattgaacacctctcacttaacgaggtggcttgaccaggcggtgcgcccgtggcctttgtggccccgtgtgtgcctcgtgcgtgttggccctttgggggccgtccttcccgctggtgcttgaacgtgtgcgaggggactggcactccttgcttcgggccgtcagtttgccccgtggccccggccttgcccaaggttttccgggcgcttcggggccacggaccagggggaagtcgctcgggtttgcgttcgttagcccgcctggccagacattttcccccgcgctgggccgttcctgtgaggttaatcttctccggtcacgcgaacgggggaggtttgccacggttcttaacttgctccccccctggtggtgtcctttcctctggcgcgtcgcaccggcccccttgggagacaccctttcgcttcacgcg

SEQ ID NO: 655173 - DNA, 128 bp, Homo sapiens
  misc_feature (110)..(110): n is a, c, g, or t
tgcctagaggatctccggtgcatgatgtaacacagtgcatataactattggtggctgatattttcagagcattctttattccaaacattatgttagcaaagtcctggtgngatctacaaagttcttat

SEQ ID NO: 655174 - DNA, 160 bp, Homo sapiens
atgctggctagtcatgtaaagaacaggaggatgtcagagtgggtccttgggcaacctctgtgactcagaagtcaaagagggctactcctagttttattgctatagccattatgattattaatgatgagtattgattggtagtattggttatggttcatat

SEQ ID NO: 655175 - DNA, 1763 bp, Homo sapiens
  misc_feature (619)..(619): n is a, c, g, or t
  misc_feature (845)..(845): n is a, c, g, or t
  misc_feature (1525)..(1525): n is a, c, g, or t
  misc_feature (1620)..(1620): n is a, c, g, or t
cttacagctgcgtgattgctgtcctcttttccatcgtctatggatatgtctctcttgtctctcctgctctgtggtcttctttttttctgactcctggtctctgtctgtgcgcttcgttgttgattcatcctactctggtaggtgatctgcgctggtgtgtcgctgctctcttcctctcgcggtcgcttttttatacacagcggtgttgattattcatcatctatctggttttctctgtgttcatctattccctcctctcttgtattgatgtggtttttcctctatccgtgcatatgtgaacaaccggggcccttctctttgggttatacacaattcgccgggggttgtccactggtgtgagttgaataatgggcgctgtggcccacacgtctccccttgattgtgtggggcctccgatgtatcctcctggcagcggtccctccttgtagattgtgtcctacgtgatgttctggtgaatcccctcttctagtgtttttattcccacgggggcccccctttctgttgaattggaaggtttgctacctcccactactgctttctattgttgtgtcctagcccacaccgccgcacaatgctgtgccaataggtgttaacatangctggtatctctcacagtgggcgattatccccacttcgcgctaagtaattgctctgatatgattggataatggccgcggtgcacacctccgggggggattgatgttctccccttcctctgagtcccttttctcatccacgggcccccgggaattctctccctgtgaacatgccccttgttgatatgtaaccttgtgtggttcccaaaccctaggggtacctcccangttttgtagcatatcctctcgcgccctacatcaccacattggggggccaccagacccagttttggaaccccctctctcccctcttcttggtggccacaccccctgtgaggcgtttccgctcatttggggggcttgtccctctattatgagggtaccaccccctcctctcggggccgctttgtgttttgtggccgctcttgtgcgccccccacacaatagggcgcagtctcccacagacagttgctgcttgtgtgtgtaaaggtgaatttctgttgctcgccccactgccgcgccaccaattggtctccccactgggtctcccccacaaggagcactcgtggccccaccccccttgttgggcccacacacacacacgcgcacccaaacaggacgcccacgatgtcttcctcctggtgcgccaaaaacacagggctataagcccctcgagaggccggagattatagtgggagccccaccgccccaagtggagccccaagtgtgtgaagcccccgcgtgagaggaggcttcttccaaacggcactctggccgccatggggcacagagagggcccccggaaaactccctctggaaccccagagagtgttgttgtgaaggagaggcacatctttgttgttgtgtgtgcccctgtgcacactgtcacaaagaacttgggtctccgnggctgtctcacaggagaggcgcggaagggggccacagcgcctgggacctccgctgtcggcttgtcgctcgtgccgctcctcgtgggcgcttctgnccctcgtggtcctctcgcgttcctccgttaaagcacagacaagaaagtccacgtaagtgtaatttctcccactgaaacgtttttgtctgtgtaccagtttttagaaccattaccaaggatctgtttgcttagctgtcccacca

SEQ ID NO: 655176 - DNA, 437 bp, Homo sapiens
tggacccccgccttcatcatacctaccatgaccttatttttctccctctgtttcttccaattgtagcacactttttaattaaatcagtaatatttacatgattatgactatgcaaattctattcactgctaagtcatatggtgttttcgctgtgcctctgcattatatgtccttcattccttctctgaaacagttctgaaatctgagcatttctgcactttttctgggtcatctctttttccctagcctatgttgctttacccagacaaatgcaataagtagccactggctggtctgtttgctttcacatccattattttttagcatgaagctaattttctgactatatttgtttgcctgttttctaacagctgttttcccttcaagtgttgtagcatttatcacatgcctttcaaagatactttccatctgctaaa

SEQ ID NO: 655177 - DNA, 312 bp, Homo sapiens
tggggcgttcatgcacaaaaaaaaaaaaaaaggggcctccctgtttaacaaccccgggggggggaattttttaaaaaaaaacattggcttctcccaaaattgggccgggaaataaaatcgttttttggaaacccctcccaggtttggcccttgggtttaaaaaggcggccgtttccaaagggcttcctttaaaagggggggccctttaaattggcggaaaagggaaatttttttttttttcaaagtttgggggtctttccttttggcgggctaaaatttggcaaagcccctggttttttttaaaaggttttt

SEQ ID NO: 655178 - DNA, 202 bp, Homo sapiens
  misc_feature (28)..(28): n is a, c, g, or t
  misc_feature (35)..(35): n is a, c, g, or t
  misc_feature (91)..(91): n is a, c, g, or t
  misc_feature (106)..(106): n is a, c, g, or t
  misc_feature (139)..(139): n is a, c, g, or t
  misc_feature (148)..(149): n is a, c, g, or t
  misc_feature (167)..(167): n is a, c, g, or t
  misc_feature (171)..(171): n is a, c, g, or t
  misc_feature (201)..(201): n is a, c, g, or t
ccccaacaggcatcaccccgactaaatnccctagnaagtccccactcctaaacacatccgtattactcgcatcaggagtatcaatcacctngagctcaccatagtnctaataggaaaacaacccgaaacccaataattnaaggacctnnttattacaattttacctngggnctctattttacccctcctacaaggcctcang

SEQ ID NO: 655179 - DNA, 681 bp, Homo sapiens
  misc_feature (271)..(271): n is a, c, g, or t
  misc_feature (318)..(318): n is a, c, g, or t
  misc_feature (321)..(321): n is a, c, g, or t
  misc_feature (336)..(336): n is a, c, g, or t
  misc_feature (346)..(346): n is a, c, g, or t
  misc_feature (348)..(349): n is a, c, g, or t
  misc_feature (363)..(363): n is a, c, g, or t
  misc_feature (366)..(366): n is a, c, g, or t
  misc_feature (368)..(369): n is a, c, g, or t
  misc_feature (374)..(374): n is a, c, g, or t
  misc_feature (378)..(379): n is a, c, g, or t
  misc_feature (401)..(402): n is a, c, g, or t
  misc_feature (413)..(413): n is a, c, g, or t
tctttggctttgagcactgatctccggactcacagccaggacaagctcttttctctgtctgtcttccaccactggcagatggtgcctggtgatcccctggactagatgcatgtcatccggccctaggagcgcttacagctcgagactcctcatctggctccgggaattcactgatcataaacccgtcgtaggaagggcgctcagttgaagatgtgagcatcagcaaattcttcgatgatcctatgttgctggaacttgcaaacaggatgtngtgctcaattaccccatgtgagtgcgtggactcctgggagctcctgntcnctacagtgggctgcnactcctgtantnnaagctgagacctcntantnncgtgncctnncgtgttgtcagagagtgtctgnnaagctgctgtngcagtctcgaacaatctaccatactccaacccagagccaccagtgagagaggagcagttgggccctccgtgtcttccttctgtggcctctgccgggctccacttcccacaggaaatagagaggagcttgggctcacagaaagagacggggatgaaaccccaaggggtccctactctttgggatttacatggaattctattttctacaagttgaccttagccactggttgtagagtgagcaagaacgttctgaataaatgaaagaaatg

SEQ ID NO: 655180 - DNA, 107 bp, Homo sapiens
gaaagaaggccaagggaaagaaggtggctccggcccagctgtcgtgaagagcaggagctaagacagttgtgaatccctctctgagacaaggcctaagaatttcgcat

SEQ ID NO: 655181 - DNA, 405 bp, Homo sapiens
  misc_feature (89)..(89): n is a, c, g, or t
caatcctttcacagaaagaatagtcctaacctggtcaaacccagaaccagagcaggtttcagtcaactcgctcacccaggtgatcaccnactacttcgtgatagcttcacttccaggtaatttctaaaatacacccatgtcttaaactagaaggcaaacattattgttgagaattttccgaactgaccagtgtatgtaaaaggcttaaaaggcaacgtcaacttcagcctcctatggcatgaagtggtgagttgtacattaatacttcctccagttcccgaaaccttttggtgaggttagcaatatggcctttaaaacctcctgatgaaaactgtacttaaatatatatatatgtatatatatttacttatttgttcccacatatacagatcttggacgtaaggt

SEQ ID NO: 655182 - DNA, 106 bp, Homo sapiens
aaggtcggacagggctataagaggaggctgtcggagcaggacttctggtaagctcaccactggggcatcctgggataactggcttgtggcggccaagcgttcatag

SEQ ID NO: 655183 - DNA, 264 bp, Homo sapiens
  misc_feature (54)..(54): n is a, c, g, or t
  misc_feature (216)..(216): n is a, c, g, or t
  misc_feature (245)..(245): n is a, c, g, or t
  misc_feature (247)..(247): n is a, c, g, or t
  misc_feature (251)..(251): n is a, c, g, or t
acagaagccagaaacaagagccctgttatgattgtgcctttgtgaacaagctgntctaatacgttaagtaaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgntcctctggcatatgctttaataaatggantnaaanatgagcaaaaaaa

SEQ ID NO: 655184 - DNA, 129 bp, Homo sapiens
gccggcacgtttcccgccggcccgtgtcaactgcgcggccgtgtccccgtgcgggcccgtgtcccccgccggcccgtgtcccctgcgcggcccgtgtacaccgcgggcacgtgtacaccgcgcggcccg

SEQ ID NO: 655185 - DNA, 210 bp, Homo sapiens
gtgccgtgcactccagaggctgtggcccatgctactcaggaggctgactgagtgtgggaggatctgtttgagcccaggctgacagaggttgcagtgaaccaatgatctgcaccactgcactccagccattagtgacaaatgtgagaccttgtctctgaaaaaacaaaaatacatttcataaactctacagcttccacagacagtgattcc

SEQ ID NO: 655186 - DNA, 948 bp, Homo sapiens
gattgatgtatttcacaggcttgttgcagaatctgaaggcgaggccttcatcgagctggtccagattggagtgtggggatcatggttacatgggatcaacgctgcggaaaagcagaatagagtgagtgttccgatgcctgccaggcgagtattgtggttgcgagccgtgtaacgtatgtcaagtccgatgagcaggctcccctcaccaggacagtcacgccccatatcgtgacccccagacatttcaatggcacagaacgggtactggaaagcttatgttcaaaggctgaagctatttgtaatacatgagtattgactactaagtggggacagaaagatccagtcctgagcttgtggatacattggtccatgccgtgagccagtctgcctgtggacacgatgagcttcccgggctcagctgggcttatatcacacatcccgtgaacactcagtgaagtcagcctcgtttgcgccatgtgggcatcagccactgctgtctaagggaggacactgtatcctgttctggtctatttcccacttcatccgtagtgtctcttaacgttagaacgtgctcagatgatttggaaactatctgtcctctttggatgagatcagtgtgccacaagtgggccgacatggaacatgctgagcagcggctcctctgaatgttcactttattagtcatgtatattgttaaatgctaacatctggatgaatgtaagtttccacattgtggctgtttctgcatttgaacataaattgggagacaactgacattctctagtcgactgccagggccttagactccacatgtccatttcttgttcaggtatcgctatttatagacaagggctgcatctagcttcttttattagaagtgtgtgtgctaaattccttattaatgtgtaatccagtttacattataactcgtctgaggaaggtgatgtt

SEQ ID NO: 655187 - DNA, 385 bp, Homo sapiens
aggaaagatgcgcagactgtacgtggcctcagcctaacacagttaccttcttagtagtatttgcatgagaggcttcggaaggaactgtacgtaggtctatgcaggggttaagggtcctaccaggcccccagagaccagcacctgtggaaagcccctactgacctcagggtgcagggggcaagacagcagctgtcaccataagcagtgaaagtttggagccacggaagaggcctgcccggcaggagctgatgtacagatggggacaaggggctaaggcaggtaggacgaaagtactcagaattctccatcttgttcctcagtctccatgccagtggccttaacccacattaagccctagtgcaagagagccaagtaacagcccaca

SEQ ID NO: 655188 - DNA, 1118 bp, Homo sapiens
  misc_feature (1118)..(1118): n is a, c, g, or t
agcgtgctctgccactctcgcttcctgatggtcccctgctgccatgatgactgcagcctgctgctcccgaccactccacacccacctgctgccctctgttctgccgtcttctcctgtggatgccatgtcctgctgcctacctgccttgcctgctccatgcctgatctgccactcctcctgcagccaatgtccaaccaaggtcctgtgatcctcatttccttccttacctgcatgggactgttctggctgtgcccgagtgcacctgcaggatgcctggccatgaagcatcacaagaccttggaagcttactgttgacttatcgttccacacacagtcgatccattatcaggtgcagcttgttggggcaattgcctggcctggctttgggtggccccccacatggctcaaaccgcatgttgctctatatgtatgtacctcttcttaacgtgacccatacagatacaccctctgtgggccaggagccagcttggtaatttgccccaactagcagggccttcagcattacatagacccgtgggttggacctcgcccccttggccttgtaggatagccatgatacggtgatttggcgcacccctggtggggtgcttgggcagtgtgggcattaccaccattttggccaatcctgctgtaaaatctttcctgcgcatatggggatcctattcaacatccatcgactctttggggacccaggaatcagtggccacaaaatttcgtatgtacgcagaaccgccctggacatcgagctttaccaacagtagaaacaagcgtaaaccaccccttggtacataatccgcaaaaagcttgtaactgcagcacgcggcggtagggcgaacgcgccataggacacatcgcgaaaggtcactttgcgacgcacttcggtaaccccaacggtactttattccgtggatcgcacaataagcccgttacacccaatttcccagtgagcgcacagactgtggtatcggcacgagcgccattcacaccactattatgcgtgcaactgccccatatggcagcatgtgcgaaacacttttatgcgtgccgaaatttcactccatttggacgctttaggcggcaccgcagtgacatgcgcn

SEQ ID NO: 655189 - DNA, 1198 bp, Homo sapiens
  misc_feature (283)..(283): n is a, c, g, or t
  misc_feature (293)..(293): n is a, c, g, or t
ggagggagtgactcgatgcatgaagatgatgatgaggaaagaagaagaagaagggggctcatggtggccgtggagaacccaagggttccagtagtccttcaggcactcccccatgatggaaatttggcgttctggcgttcagcgttcagcgcgcatggaggatgggactacggtatccaatcgataatcgttcgcgcgtttgagtcgatcgctatgtacgatgatttcaataggcactcgttcagcgatataggagggcctggacctatgcctcttccacatnctctcctganacttaccaggttcctagacgttcatggagacaactctgcgtgaggatgactagcggagaggggacatgacgacttcggtgactcaattgcttcaagtatccaggatagtcaggcaggcgcaggatctttgagagggggtcttggagaagtcgagtagcaatgaagtgaatcccacccaaccagcagcagactggaggctcccagaggccattgtcataggtttgatcgatagtatggcctatggagcacccattctagaagccagagaggagcaagtgatcttgattacacaggttatcccaggacgcggtcttgagccgcgggttctacagcccccagaccaaattcctatttcaaagagcattctcgtgtgaccaaggatcacgaaagccagatgggatagtggaccgtagacccggactgtggtggtacagctgagggccggatagagacttaagtaacccgataccgaagcagatagcagccgtaagggtgatcaagattcacatagcccttccagccctgggtgcatgccgttgcaatccgtgattattcctgggcacgctggattcggtaccggagaaggcttgagtaagacccctcaggaagggcccacaaaggaccaataccaccgcaacacccaattggccacgagattaataaggtaagacatacacggaacacacctcgaggggttggccctacaggcgaaccactcgcgacagggggcccagcaccgcggagaactacccccccaaggcggccaaaaagcgtagactgactgcccgaaaacagaaacggcgcggcacaacaaaaccaagagcggcgccacagcgacccccacaccgagaggacctcgagaaggagaaccagagaaagccaaacgccggagagacgcgaaaccg

SEQ ID NO: 655190 - DNA, 118 bp, Homo sapiens
aaacagagagggcaaagacaaggaaattggctccgtatccagcagtgagacaccaccaccaccaccaccaccaaatgaaattaatcgtcctcgacatacatggaagaggaggaggatg

SEQ ID NO: 655191 - DNA, 197 bp, Homo sapiens
ctacttactgttgtgtgctccaggacttcaccccggtaccggactcttacgacgtgatctggatcctgtgggtgatagtgccacctacaccgatcagcaccttgccgagtacctgcggcgctgcaggggcggcctccgccccggtggcttcatcgtcatctaagacaccttggcccatgagggcgtgacttcttgac

SEQ ID NO: 655192 - DNA, 554 bp, Homo sapiens
taccccggatccacctctcgcggtcttttacagcgctgttcgcccccatatggccgttgcttttccccgccgtttcgtctctgttggttactctggatttgcgcgggttccaccgtctgtgaaaaccccaaaggggtgcggctcacgagtcaatacgcacgttggtgcccccttcttccccccagtgatctctgccacacccgtattgccccgtgccaccgcctcttcgcccatatttgttcggtctttacggctgcgcccacggagatagggaatagatccccccacattgttgggtcgaggcgaaataattgtggggagggcaaaaaatggggtggtgggccgcccctcgctgtaacttttagagcagagaccccccccactgcgcgcccctatatttcttcttcacgccactttacatccgcctgtctataccaagggtccaccttattttttatttttctcgcaaaagagagcttttaattatctgttgcagaagccccaatttttctttaatatatgccaaatacaaaagttttcaaaccacaatacca

SEQ ID NO: 655193 - DNA, 663 bp, Homo sapiens
  misc_feature (422)..(422): n is a, c, g, or t
  misc_feature (449)..(449): n is a, c, g, or t
  misc_feature (494)..(494): n is a, c, g, or t
  misc_feature (497)..(497): n is a, c, g, or t
  misc_feature (500)..(500): n is a, c, g, or t
  misc_feature (503)..(503): n is a, c, g, or t
  misc_feature (508)..(509): n is a, c, g, or t
  misc_feature (514)..(515): n is a, c, g, or t
  misc_feature (521)..(521): n is a, c, g, or t
  misc_feature (523)..(524): n is a, c, g, or t
  misc_feature (528)..(528): n is a, c, g, or t
  misc_feature (530)..(530): n is a, c, g, or t
  misc_feature (541)..(541): n is a, c, g, or t
  misc_feature (546)..(546): n is a, c, g, or t
cttagtagtaatttacaatggtccagcttccaagattgctactggcatttccttcttactatttgaacaattacagatttattgatgacttttaaattcttactaaatgaattaaactccaggacacaattttaaggtgtctcttataaaagatacataacagcattttggaattaagaataaatcagctaaaattcaattcaacaaatagttattgagcagctattctgctgggtactttctgaggtgttgggagtaaataggaaaacaattttgagaaaatctcttcttttatagagcttaactataaaggatgtttccaaaatttcagtttggcttttctaaagaaatattgatttagatattttattaacgcatttttggttcttaaattccttaggcgtcctttcttttgaagttanccgcaccttaaaaacctggctttatgntttgtgctcaatatcccttggccttatatatcaaatattatggcntgnaanacntatgnnttcannaaactntnncttnantttcattattntggantgttctaggctggttcattttggaatcatgtacattgacaatttctgaacaagcaaaaaaaaatgctctcaaagaatagcaaggcacaagtgcattcccctattgaagcttttaccg

SEQ ID NO: 655194 - DNA, 280 bp, Homo sapiens
atggcggacattcagaactgaagcgttgccttaaccaaaaagcaagccgaaccaatcttttcaaaaacaaggaaggaggggttcctgcttgggagaaaacttgacaagggaggaagtcttcccgcgggttacttacaaggaaacaatcgggtcttgggctttcaagcacacccaagggagggctatttgaggggcacctacaattcacaaggaaatgccccttcactgggtaatgtgttccattcgagggcggatcctctcttggcggtggtgaccaaga

SEQ ID NO: 655195 - DNA, 150 bp, Homo sapiens
gtagcggcgctaccagagcaagactcccccttccttagcaaaacaacattgaaattagaccaactaataacccagcaatgacctccatgtgtacaagtgaaaggcacagtcacacatctctcactttaaataaaaagctagaaatgatta

SEQ ID NO: 655196 - DNA, 95 bp, Homo sapiens
ggggtttttttggggggcttttttttgggtttccaagcccgggggttggggcccccccctgggttttccaaaaagggtttttctttttttcccca

SEQ ID NO: 655197 - DNA, 115 bp, Homo sapiens
ggctcggtacccacggtcccgcgtgtcacttgagcttctgcgcaagcgtctggaccagctcggccccgggggcagccgccagcagttggagtaactggccaaggatggggattcg

SEQ ID NO: 655198 - DNA, 141 bp, Homo sapiens
tacttggagtcaaaggtggtagtaccgagctatcagctggtgtagccagtagcaagaagactggagaactgcaagggagaagacgaaatacagacttaccggtccgaagagaaaagaaaacacttaactgttccacagaga

SEQ ID NO: 655199 - DNA, 393 bp, Homo sapiens
  misc_feature (29)..(29): n is a, c, g, or t
  misc_feature (372)..(372): n is a, c, g, or t
aattcggaacgaggagaaataattttggnggctttatctaaataatatgaggttaattaagacaaattcttaatctgttcttaattatttaaacaattcagatggaagtcatgttctcacgtaattataatgtgaactacaggataaacacatctatttgtgtgtcccagccagattttatgactgataaatgttgccctagccatattgattgtgcagtgatccacatcagtcaataaagctacagctttaagctacatgcgtagaacaaagctccaatgaaacactcaataaatagtgattgatttatttctggatttcctggtttgcttttatttgtgggctatataaatgcagataggtaattggccnagagctattttgacaattgtg

SEQ ID NO: 655200 - DNA, 423 bp, Homo sapiens
  misc_feature (63)..(63): n is a, c, g, or t
  misc_feature (224)..(224): n is a, c, g, or t
  misc_feature (337)..(337): n is a, c, g, or t
  misc_feature (355)..(355): n is a, c, g, or t
  misc_feature (368)..(368): n is a, c, g, or t
  misc_feature (400)..(400): n is a, c, g, or t
  misc_feature (407)..(407): n is a, c, g, or t
ggaaagtgtttaattgactgaagagttcagcatggccagggaggcctcaagaaacttacaatnatgggggaacgcaaaggggaagcaaagcaccttcttcacaaggcttcaggagaaagagtgaggagttaaaggggcagagccctttataaaaccatcagatcttgtgagaactcacccactatcaggagaacatcgtaggggaaaccacccccatgatccantcacctcccaccaggtctctccctagacacatggggattatggggattacaattcgagatgaaatttgggtgaggacacagacaaaccgtaccagccatttatgttatttctnattaacccattgcccccntttttttttaaantttttttcaattttctaaaacttgttagtctnggttttngacccccgtaatttaa

SEQ ID NO: 655201 - DNA, 423 bp, Homo sapiens
cgtagagtcctagtaagggcggagccccctttgggccgaggggagaagaaaccagttgtgcctcgtaaaaaaaatttgagatcatctattcacatatgagtgacccacgacacagaaatttacatactttaaaacgcacaaggccgggcagggatgtctacctggaataaaggacttgagccaaaggcaggaatacggtcagaagccaatatcttaagaccttttatgggaggggaatttttccccgcaatcttttacactggtccaggactgaatgtttggtgacaagcggggaccttgaacaaagatcctcgtagctagtttatccctgaggaatgattgacctctattttttcgtccaaatcccaaaggaagaataagattggcctggaaaacttaaaaaattaactgcaactttagatt

SEQ ID NO: 655202 - DNA, 256 bp, Homo sapiens
gggtccccccaggggtccgggggggggggggggaaaccccaaagggggggggggaaccccccaaggggtttccccccccgtttaaagggggggggttggggggtaaatttgggggcccgggttccggttttccccccgggtttttttgattttttattccgggggggggaattggtttgggaaggggggaaaagggtccctttttaagggggggccttttttttaaccgggaaggggggtttttttttttccccca

SEQ ID NO: 655203 - DNA, 253 bp, Homo sapiens
atattcttggctgattagcttggtatcttgccaggatgttgtattaagagagaaaagggtgagggtatgaagatatttgcaaaatggtgatgagtactgattctctggcctttttatgttggcttcctagggtttagggtttgatgaggtcatcaaaccctgggccaggtgtatgccatgaagatcatgaacaagtgggacatgctgaagaggggcgaggtgtcgtgcttccgtgaggagagggtttcgatga

SEQ ID NO: 655204 - DNA, 1015 bp, Homo sapiens
  misc_feature (35)..(35): n is a, c, g, or t
  misc_feature (153)..(153): n is a, c, g, or t
  misc_feature (195)..(195): n is a, c, g, or t
  misc_feature (246)..(247): n is a, c, g, or t
  misc_feature (257)..(258): n is a, c, g, or t
  misc_feature (287)..(287): n is a, c, g, or t
  misc_feature (312)..(313): n is a, c, g, or t
  misc_feature (318)..(319): n is a, c, g, or t
  misc_feature (328)..(328): n is a, c, g, or t
  misc_feature (338)..(338): n is a, c, g, or t
  misc_feature (358)..(358): n is a, c, g, or t
  misc_feature (361)..(361): n is a, c, g, or t
  misc_feature (376)..(376): n is a, c, g, or t
  misc_feature (378)..(378): n is a, c, g, or t
  misc_feature (384)..(384): n is a, c, g, or t
  misc_feature (386)..(386): n is a, c, g, or t
  misc_feature (389)..(389): n is a, c, g, or t
  misc_feature (391)..(392): n is a, c, g, or t
  misc_feature (396)..(396): n is a, c, g, or t
  misc_feature (414)..(415): n is a, c, g, or t
  misc_feature (436)..(436): n is a, c, g, or t
  misc_feature (438)..(438): n is a, c, g, or t
  misc_feature (458)..(458): n is a, c, g, or t
  misc_feature (483)..(483): n is a, c, g, or t
  misc_feature (488)..(488): n is a, c, g, or t
  misc_feature (516)..(517): n is a, c, g, or t
  misc_feature (521)..(521): n is a, c, g, or t
  misc_feature (532)..(533): n is a, c, g, or t
  misc_feature (549)..(549): n is a, c, g, or t
  misc_feature (551)..(551): n is a, c, g, or t
  misc_feature (570)..(571): n is a, c, g, or t
atcagctgacggcctctgtgggaacaaagacaggnaaaggggaaatgagttcaccagaaaccaacaggcagcacaggaggtggtaaacccgaaaaagaaaatgaagaaaaagaaatacgtgaatctggcacagacccagatcaacttcactgnggccattgatttcactgcctccaatgggaacccctcacagtncacatccctgcactacatgagcccctaccagctgaacgcctacgcgctggnngctgactgcnngtcggagagatcatccagcactacgacangtgacaatgatgttccctgccctgnngcttnnggggccaangctgcccccnggatggcagatggtcccacngangttcccactgaatgngnaaccangngangnncccntcatgctgtggcatcgannggcatcctggaggcctaccancngcagcctgcgcactgtgcangctgtacggccccaccaacatttgnccccngtggtcacccactgtggccaggaatgcnngcgngccgtgcatgnntggctcccagtactcngntgctgctcatcattacttnntggggtcatctcggacatggcgcagaccaaggaggccattgtcaacgtcgtgccgaagctccccatgtccatcattatcgtcggcgtgggccaggccagagttcgacgccattggtggagctggatggcgacgacgtgcggatctcctcccgggggaagctggctgaacgcgacatcgtccagttggtacccttccgggactacgtgggaccgcgcagggcacacgtgcttgagcattgggcccgggcctgggcccccgaaagaacggttggttgggcagaaagatccctgtaccaacttggtggtgccttcacttgaggggccggcgatatcacacacggtatacccaacacgacaagttaaaccattgcacacctcaggtatacgaaaagagtccacgcacacaacccaagcaaaagaaaatggcaaaaaaaaatgatgctt

SEQ ID NO: 655205 - DNA, 139 bp, Homo sapiens
ttatcagtgtgtcccccctcgactccttctacaaatccgccacaccacggaggattcggggatactccccagagggtccatccggccacgctccctccccccattacacctgatccccgtaaccaacccactgtctacc

SEQ ID NO: 655206 - DNA, 157 bp, Homo sapiens
attaaacccacacaatacaagcctgttcccccacgagaaccaaattcaacagacgtagaggaaacgcttggaacggataaagaacaacgaccccaaactttaagaagttaacctcaatatatccggaatatcccatccccacctcagggcatatcag

SEQ ID NO: 655207 - DNA, 197 bp, Homo sapiens
gcggaaattcatcgtgtaccttacatggtgacacatttgcttgcttgttcatgtatcatttgtcccagcatagaggtctgcgcatctggtgaagtagtggcgtctacccattcttctacagttcacttgcatagcaggctatcaccatgcacttgtgtccttaatgtgctatttgacaagggtgtagtaaacatctg

SEQ ID NO: 655208 - DNA, 612 bp, Homo sapiens
tgccgtaggccccaattctgcatctttgacacccagatttgaagtgtgcctcctcacagattggaaggtgccaacacgctcctgtgagtctcctccttcaactccgtgccacgtccactgggccttttctacaatggggtaccataggaatttttaaagaaatactcgacagtcgcaacgacgcacttacccataacccatagtattgatgcagattccccacaaccggggtttcctatgcgccggtatcttttaaacggcgactggtgttcctaaaatctttggaactctaaaggctcctgatatccgccaaagacatctttggacgcaaccaagacaagggcgtatcgctacgagcttcgcttgtccgcacggccagcccctggggcacccctgtgtgtctgccgtgggcacgcctctgccacgcaccacccctttgtgggcgaagagagcgctccgtggccgtctcgttccctctcgaggctgtgtcgtttccgccgtgtgtcgacactctcccgcgtgctcctcccagcgtgggtgttccccttcaagagtgctcgtggctttttccacgggaacagcttcgtgcgtgggtggaccttttgtgtcgcc

SEQ ID NO: 655209 - DNA, 378 bp, Homo sapiens
catacctggaccttctcatgtccttgtgttgaggacttacactttttgaacctcaattttcttacatgtcaagtgaggttttgtggatgatatctttataagctttcaggcaatgtcaaggaataccggttagtgggtagtgtatgtgaaagtgttttaagaactgtaatgcatcatacaggttatctagtcttccttcccagatggatggagtttacagacatgggacttctttcccagcattggtggacagagaagatttggatcaacatcctgaggtcagagtgaaggcaaacagcttgacatggagctagatgagaccagcgagacagtacacaaagccaagtacttcggggccagcagagctaatgcatgagg

SEQ ID NO: 655210 - DNA, 1412 bp, Homo sapiens
gtgctgccattgctgtcatgctgggtgagtggcggcccaggcccaggaccagagctgcgagtacagcctcatggctatggctaccagtgtggacaggtcattccgaggcatgctgtgtcaagagccagagagaccggagatttggatgtcgagcgggcctccaagaaacggataagatcattgaggttgacggaggaacaagaggacccatatcatgaaatgaccgctgccgaggaggcgggccctgacaagcagcagagccgagacacggagtgacgaggtggtctgctcctgcttacgagggactaccagcatgctgtctgatggtgtctccatgtgaagatgtcaatgacatgcatcacgaggcaagccacagactgaccggacttgcgagaatcctagcatcaacacagtgggcatcttaaccgactgccagacggcgacagcaagactgcgaggacatggctatgacgctcacacgagcgacaaataagctgcaagagcatatcacgacgacgtgatgagcagtggtactccactaaactgcgctaccccggattctcatctagtcaggcaatactcctgcggaatccatacacgcaaagccaggaaccacaacgcctaaacacgaggcagcggaacatggcacataaatacacaacgcatggctcatagggccaaactgatactagcaatatccactgaacaagcgccacgagaaatacaaagacccgcgaggacacataatacgagcgcacaataaattgccattcgaacacacacacagacgagcgctccgatacgacagatgaccaacgaccgaaacaggagcgccagaacgagatcgcaacggagcgcaccacgaaattagaacgcaaggaaaggacacgcagacacgggatagacagagtgacgagcaaaggacacagggcccacacagagcacaagactccctgcggagagacaacaggaagaacaagcagaggatgaacagaaacaggagaaaaggaatccgaagaacgccaagctgacggcaggaggaaagaaacgtagagtacggggccaaggaagcaaagtaccagcagacaacgtacacgacacgagacacgcaaggcgatccagcagggcgaccgctgggggagcagacaaagtgaggagacagtaggaagcaaagacagaagagacaacgaggggagcgagagaagaggagaaggatagagaaacacaaggagagaacgacggacagaggcggaggacagcaagcaggcgagagcggaggagagaggagacaagcgaggagagtcagagaaggagagcaccacgcggagtagtacgaactaacaaacagacgacagcagacgagacggccggagatggcggtcctagtaagcgcacgcgatagcgacagcagt

SEQ ID NO: 655211 - DNA, 199 bp, Homo sapiens
gctcgacgtctgcacagaccagtgctggccctcctgttccagtcgggtgaccggggaatggtcaaacaactgcccgcccagcccgactgcggcattggccaagcctgctggtgtaggccatcgggttcaaggtaccggcacgtcggtcgagcaaggcggcacgaatctttttggtaccgatggcttgctcgcaggccgc

SEQ ID NO: 655212 - DNA, 764 bp, Homo sapiens
  misc_feature (133)..(133): n is a, c, g, or t
  misc_feature (194)..(194): n is a, c, g, or t
gacactatattacattactattcatgttatgattaacaagttatcatatattatcacctatttgtggttatagttttggccataaatatatttttaatgtatagatatagctattttgactctattttagttnccatttgcatggcatatctttttccatcattctattgtcggactatatgtgtctttgttgnagaagtgtatttcttgtaggcagggatcattggatcttgtttttttaatccactctgccactctattatctttcaattggtgagtttactccattgccattcaatgttattattgataagtaagaatttaccactgccatttttttttttctgattgttttgtggtattcactttcttctttgcttcctttctgtcttccttttagtgaagataattttctctggtggtatgttttaatttcttgctttttattttttgtgtatctgttgtatccctttgatttcaggttatcatgaagcttgaaaataatataacccattattttaaactgatgtcaacactaattgtataaacaaacaaacaaacaaacagaaaactaataaaaactccacattttaactttatgcctccactttttaagattatttttttggcttccacttacatcttcctctactgtctatgtcttgagaagttgttgtagttattattttttttcagctcatcatttagtctttctacttaaggtatgaatagtttatacaccacacttacagtgttataatact

SEQ ID NO: 655213 - DNA, 445 bp, Homo sapiens
  misc_feature (13)..(13): n is a, c, g, or t
  misc_feature (28)..(28): n is a, c, g, or t
  misc_feature (162)..(162): n is a, c, g, or t
  misc_feature (195)..(195): n is a, c, g, or t
atctagataatcntgttaaatatgatgntattacctattaatcactgtactggcatacataatgtacactagcttgccgagctctatattatgatgccggtaacccacgtgtggactccctgtatatatgaacatcactgcctaaatgttagcacagtagcncatatggaaaatttgaatgagctaggttaaganatgctaagtgcaggtaccagaatctcagaagcggactgaagtgttaaataagatgtttggcttgggaagcaatctgggcttaaattgaatgcaatttagtgactggaaatttttgaagttcaaaaattttttaaaaacagttatgttagaatagactctgtatctgaattcttgatactaatgaccttataacaagttgggtttgatcccattcacttgagccagttggttttttgtaagtgaatttccc

SEQ ID NO: 655214 - DNA, 862 bp, Homo sapiens
  misc_feature (103)..(103): n is a, c, g, or t
ctggcgttttcaccccccgtcccccctgtcatttgccccaaaccctttttccccgatctccccacaccacacatctcttcccgtttcttcgccccaaagttgnccccctgagatgcgccgccaagcgcctctttatctctctctctacttacctctcgcgttttctcccccacccctctcccttattggcccccccacgagatatccaaataccacatgccgcacacacagtggcacccgcgtttagacacatggtttttaagaagcccactcccgtgtgggtttccacagaatatgagcccccttcgggcttttgaggcggcaagactcgcactatgggtaacactctatagacttctggaacttggcacatgccaccacatgtgtacacatgtgcacagccctttggccaatagataccaccaccacatgcacataccactgagggcctccaccacccagcaccttgcgacaccacatgtggaactcctataccacttcgctaaccctgcacactggctggggaaagggtgcgggaaccccacatcgggccacaaccccttgcacaggagcgcccctttgccaaggcattatgcggtgtggccacgccctgagaaagctaaccttggaacaccacaggtttcacagctggccccacgcccccgaagtgaccccccgaaagggagggccccccctttgtccccctgcttttacccttccttctgggtgctctacacctccggttacccggcctgaggcatttcatcccagcttgtttcccgctctgaggcttgtggggtgggaacccgaatggaggtcggtgaaataaagtgatgccaattagtaaaaaaaataaaaataa

SEQ ID NO: 655215 - DNA, 184 bp, Homo sapiens
  misc_feature (54)..(54): n is a, c, g, or t
  misc_feature (72)..(72): n is a, c, g, or t
agtctagatataaatatgtctataataaatatttaatataattatatttattanttattattatattattantatatattaatatattttatataatatataatataaaatatataataaataagtagtctagtaataaaagaataccagcctgggtagtcacagaccatatgggtagtcacag

SEQ ID NO: 655216 - DNA, 368 bp, Homo sapiens
atcatcagagtcagttccagttacatttccattagtatggatagatctgccgccgctgcctctgggcaccgctcaccggcgccgcactcgtccgcgaccgtggcggcggcgccgccccggcctccgccgctcctcgggcccggcgcccggccccctgggcccaggcgcctgccgccgccgccgccgcggctctccggccccctcctccggagcaggggtccccccgcagggggatgcagagggaacctgacgcaggctccgctcgagggagcagcagcgaacaggcggcggaggccctcaaggccgcgaggcagccgtcggaggacagagctcagcaaatcgcgtcagactcccgctcgcccggcctg

SEQ ID NO: 655217 - DNA, 1599 bp, Homo sapiens
ggctggactgactgtagacccagcaacaaactaccaaccactgtagcaggagcccctggcatcttcatcagtgctcagcctcagcatgcagcgaatttatcgtagaaacatgcagcaacatgcaccgcagcagcttcgcaggcagcattcaccatgcattcatgcatcaaaccatttcaaatcatgcatcatttgaggcagcatgatggaaagcaaagctgtgcactcactcatcagcacaattgcatgcaagcaaaaccatatgcacagccagatcattatcacaatccacacgcacacacggcacattatttcccagatgcatcgtttagtcctgagggcagcatgagcggatatgtccataggtatggccccatcacacatgcagcagattggcatgcaaacaacaaaagcaatttggtccattgtcattggaacaacctgtggagcacttttgtaccatggtgggccttcttcttcaacaaggtaccaagcagcaatatcattaatggatgaacacacctgcattaccagtatattatgataatttacggacaccgtacaatctccggagggaaattcatatcacagctcaccttgcaaacattgacacgttcagacatattcgcccaggacttaaacacatccaaccaaagcttttcatatcaacgagcatcaccaattggcatacttcttctcccactatcacacttccacagacataccttcccacaacttcaaactttatttgaaaccacacccaatagacatccccccaacagtaaacaccaagaaaccaaacaacaacacacacccacacgagtcgccacagatacagacggtagataacagccgcgcagctcaacgaggagaacaacgagaaaaaaagagagagcgaagataaacaacgcaccacgacatcacgatttggggcgcaccgaacgcagaggacacccaacaatatgagagaaacactcaaacacacagctgaggacactacctagacgaccactgagagaatccacgacagaacggagcaaccacgtgacgcccaacaacaagagaagatgtgagtgcgacacttataccacaacacatgaaaaaagagaccgcgacagcagaagggacaaaagcaagatgatgcgtaagtaggaaggaaacacacacaaaagagaggaacacgaaaagaggccacgcacagggcgcccaacaccaagaggacgacaacggcacagtaccaagacacaagatccaggaagcgcagcacgagagagagggaagacgacgaggagaacggacgacgcagacgagggacgcacggaagcaagagaagcacgaagcgaagagagcagagagagagagaagagcagagacgaataactgaagagacacacggagagtcagaagacggcagacaagcaggacgacggagagacagagcacacgagagcgagcaagcagcacaagccgaccacgccgaaccagagacacaggcggagccacgggagggagacggacagagacgaacagaagggacaggacgaacgacgaagaatgcatatcggatgaggcagagcagacgagaagcgaagacgagcc

SEQ ID NO: 655218 - DNA, 462 bp, Homo sapiens
tagctcggtaccccgcttctttccgttcgggctgagcttgtcgaagccccgctcgcgccacgcgcgtcctgcgctttgagaggtgcccttcgacaagctcagggcgaacggggattcgcggcaatactcccgcgctagcgcgtcaccagcaccaccttgtcgcgcgcggtcgcgccgcgcaccagcgttagcgccgatcgcggtcgacccagcgccttggcgagcaaggcgaggatcgcgtcattggccttgccatcctcgggcgtcacggtggtccgcacgttgagcacagcgggcgctccatcggcgggcaggcggatgtcgttcgcgcccgcattgggggttgcgcggatcgtcaaatgcccgtgcgcatcgatcaatcgttcgagttcctcgcgcggggggaagctgttcttgatgcggctcatgcccgccttcttaaaagaataccgacgcgttgag

SEQ ID NO: 655219 - DNA, 566 bp, Homo sapiens
  misc_feature (551)..(551): n is a, c, g, or t
cactagggagttcctagaagagaagctggggcataggcatgggatagatatcacctgtccccaagagcccctttccttcccagtggggcttgggaaagctcagcacaacccagaagtgcatgtcagagcagagcctgtccagggctgtccctgcaactacagggctccctcctgcaaagtgacacgtaccaaatcttgcagccaacaagctatctttgttggccagaattatcctacaaggattagacagatcatagacaaggacagacagccccagaaagttgaggcatttaaggggaagatactgtgtcaaagccatccccaatccatgccccacaggaagcctgtgccacatccaaaccccacttgccggcgtcaggtcagcctggtgtgtccagccgtcccaaccagtgctaaaagccctgtgtttagtgatgtgcctttcctaactggacagaaaatgcttccaaagcatttacagggaggaaaatttccccccacaaaataattcactccttgttgagaatcttgattctccccaataaatgttncaataagaaggaaaa

SEQ ID NO: 655220 - DNA, 224 bp, Homo sapiens
tacgctaggtctagtgcatacccttagctatctcgggtgttgcgcgcgctgctgccctggatgtctcagggtgtactgacctattctggctcgatctcgggtggctttaagccacttttgtctctgagatcttggagtgacgcctatctgctcgtgggtcgcgtaattcgtttgcatgccgagtccgctgcattgggtatcgagctcgatttagtagtcgtcgt

SEQ ID NO: 655221 - DNA, 251 bp, Homo sapiens
tcggtcctgtctttaacattttcaggaggctaatgttacgacagtctcaacagtgcgctcctgatcataccaaatggttatcccagggcagtcctccataacccaattggaaaagccttaatctggggagaaaggccagcactcttcataagcaagattttaaccaagaggtgataaaagacattctgttaacggttgcctaagtggtcaccccgtcttccccatcccagtccctcttccccagtcccatg

SEQ ID NO: 655222 - DNA, 210 bp, Homo sapiens
cctggagatgacagcgtggcagaagctcacaagtgcatagagtcgtaagagctctctcctcacagagctcagcaacagcctcaccaaggactccatgtaatatcaaagccccatatccacagtgttgctagacggggcttagatgaactacaagtgcctgcagaaatatcccagtcgcaagtgtacggcgggatcctcctagacgtcgac

SEQ ID NO: 655223 - DNA, 105 bp, Homo sapiens
acggccatatattactgtgcgtcacctctgtaccccccaaaaggacccatagtggctacgacaactgactactggggccagggaaccctgctcaccgtctcctca

SEQ ID NO: 655224 - DNA, 247 bp, Homo sapiens
gcttttacccttgggcctgggcctttgcccctcccaacccagccgttgtttcccttgacagggcccctgctgtttttccccccccagtccccccccccccaaatgccccgtggtccctgtgccctgccctgttcatgtgcctttgcggggcagggcctttctggttttgttccctgctgtaccccaatgcccccccccctccctgccccatacaggggctccattaacccttgtagagccgatggga

SEQ ID NO: 655225 - DNA, 459 bp, Homo sapiens
  misc_feature (7)..(7): n is a, c, g, or t
ccgagcntaagggctacccccccaggacgagggcctcaagtccaaggattttcttccgcaacagcctgccgaagaaaagagggcgttcttgcgcgtccaacgcttccggcccgtggtcgagagccaggccttcaagaacatcctggtagacgagatggacatgatgcacgcccgtgcagccacgctcatccaagccaactggagggtctattggctccggcagaagctgatttcccagatgatggcggccaaggccatccaggaggcctggcggcgcttcaacaagagacacattcttcactccagcaagtcgttgataaagaaaacgagggcggaggagggggacataccttatcacgccccacagcaggtgcgcttccagcatccggaagagaaccgccttctgtccccgcccatcatggagaacaaggagacccagttcccttcccgtgacaatct

SEQ ID NO: 655226 - DNA, 863 bp, Homo sapiens
ggaccggagcggacggttttgtgcagactggacccgcgtgtgcgcgagccccggggcggggtcggggcgtcgagatcccggaggagtctcagcctgaatcgcctcctcctagtgccctgtccgcccctgcggcgcgtcgccgtgtggccggtgttgcgagagcgggcaggcgcgccggtgcccggaatacagcctgcggtgctggaggtggcacagggagctgctgatgaaaccgacgatctccctcgggccaccgtggtggtctgctccgccaggcgctccctggcctgtgtggctgccttgcacatcgtcggcgggacgcccagtccctgattccctgctgggcttggtcaccccttcgtacccgcggtcagccttgcgccggggaggcctcctgtcggaagcccagccgcatgccctggagtgtgcccctgggaggtcttccgcgagtgctggccgactcgctggcgggagctccttccgactcccgctctgctacccgggcgcgctgaccggcggctgggcttacgctggtgcctcgcggtggtgctcctggcggggcccccggagtgggcaagaccccagtggttgcggggccgtgggcgctgcgaggcgggcgcggacgcttgcctgcaagtcaggccccgggctgcaggttcccggcctgggagaccgaggtcaacgtgcgggggtctccagggcgcccggaagtgccagccggggacagcctctcttctgtacgagatgacgcttgttcccaggggtagtgacaccgaagcggtaatgccatggtgcccttgaggcgcaggggccccgcggtggggcctacggcggctcgacccgtgtggcggtgcccaggctgg

SEQ ID NO: 655227 - DNA, 319 bp, Homo sapiens
  misc_feature (1)..(1): n is a, c, g, or t
ncaggaacaagatacgaaatccatacacatatgaaatggtcactttcccatgaatatgtgtcagatcagttcgggaaaagaaagatacctttctatggtcggagccatacacttcataccatgtaatgtaatcctagtatttatctatacagtatagagtagtccaaagctaatttatattcaagatgtggggaatgccagcttatattattattgagattctcaagtgggaatgaggcatgtcctctagtccggctagtgcgcttgggagtcatgccagaagttgggatgtgattgttctgtcctcatgacatgccat

SEQ ID NO: 655228 - DNA, 257 bp, Homo sapiens
  misc_feature (58)..(58): n is a, c, g, or t
cgggtgacctaagatccgcaggtggtgtggtaggaataatatatgtagctctacctgngctcatcacccaaatgtagtactggcatgtctgcaggactggtctgtgaggttgcatgtgctcttctctactggaatgccttctcttgctttcctggggagccctcagctttagcgttgtctcttccgggactcctcctcccgctttccactccatcctcagctgcaggcttctccctcgtcataccacaaccacctgc

SEQ ID NO: 655229 - DNA, 145 bp, Homo sapiens
gacccaccaccccatgtctgaccatgagggccacctgaggggctggacctgggctttttaaccttacgagatacacaatgaacctgcagcggatggggagagaacagagcccagagacacgcgagactcggtgtagtaccagatc

SEQ ID NO: 655230 - DNA, 270 bp, Homo sapiens
  misc_feature (146)..(146): n is a, c, g, or t
  misc_feature (261)..(261): n is a, c, g, or t
gagctcggccccctgcctgtgtctctgcctctctctctctgtctctctttttctgtctctttgtctctcatgaataaataaaatcttaaaaaaaattaaagaatgaaagaaagaaagaaagaaagaaagaaaaagaaatgaatgtntgtgggcacagagaaaagtttacatgcacagtcctcaaattattaaaaggctgggggcaaggggatactgaaaaaatattaaatttattttttaggggatcccttggtggctcantagtttagt

SEQ ID NO: 655231 - DNA, 135 bp, Homo sapiens
  misc_feature (65)..(65): n is a, c, g, or t
ctcaagaggctgaactagagagagagacagagatgaggcgagactaggggagcaggatagcgacntggtcggggcagagactccaggacggatagagacttgggagggactcacgaagcatagcgactgtggggc

SEQ ID NO: 655232 - DNA, 928 bp, Homo sapiens
tgtggtggctcacacctataatcccagcacttgggaggccaaggtaggtggatcacctgaggtcaggagttgagaccagcctggccaacatgatgaaactccatctctacttaaagaaaaaaaaaaaaaaaaggaaaagaaattagctggggtaggggtgggtggcacggccggtcatctcagctactgggagaggtggaggcaggacgacatcaggtggaacccggggaggcggaggttggccggggggccaagacttggcaccatggcacctccagccggggcaaaaaaggcaaaattccattctcaaaaaaacaaccaaacaaaacaaaaaaaccattttataactaggtgggtgtttccaatgggagcacaaaggattctaatcatttaactctatggattaacgccctttcctagtccagaagatcgggcacacacgtattggcgaggcggttatcaataaactcatttaaattcaggaacgctttaagcggattagaaagttcctctcctggtgaagtaggtccaccaaggtcaatggcgggagtgggtcactttctacttcacggaggaggatacttagtggtgcttggattaacatccccaccagtgtcattatcttcactgctgggaagtcacaaagtctggtaaaggattttagatccaggaaaaggccggggcgggaaatccacactggtatccagtaatggggggccgaaggggggactcttgaggcaggagtgaaaacaggctggcaacaagggaacccggtcgtacaaaaaacaacatcaggggggggggggcgctggaaccagtaaacacgggcgaggacacatgtgaacgggggaatgggaggagaacctgcccacgggagagagacttaaaaaaaacacacggggggaacccatgtgcactaccgaaggca

SEQ ID NO: 655233 - DNA, 345 bp, Homo sapiens
cccccccggggattttttttttttccccccccggggggtaaaagatttttttttaaaaaggggggggcggccccctttagccccccccggggttttggggccaaaaaatatggtttttggggggccccccagtttagggggggggcgggataaatacccaaagggggccttttcccccgtgggggaaaaaagggggttcccccaaatatcaaaaccttccccccccccccttttccctttttttttttttttttgtttttttttgggggccggggccccaccccctggtcccttgggtttcccggggggggaaaaaaaaatttttttttaaaatttttttcccca

SEQ ID NO: 655234 - DNA, 162 bp, Homo sapiens
cgctcgttctagaggatcccgaaggagacacaggtgacggtgtcacacgcatagcgacggaggcagcgtgccgggacagagggagggaggagaccaggagatgaagttagagacgagattggtggccctgaacgtgccataacatgcttttcactttgcttg

SEQ ID NO: 655235 - DNA, 664 bp, Homo sapiens
agcggtttcaccatgttggccgggctggtctcggagtcctgacctcaagtgatctgcctgcctgggcctcccaaagtgctgggattgcaggcgtgagccactgcacctggcctgcttttttatttttaaaaagcttatattattctttcataaggtttgaatttcaaatgttagctgtgacttggaaaataagaatttagttggttcgcctcgtcctcttgctgtgttcacttcctctttccccatcgtacacttcttgtttcccatcctcccagtggtgattatggataaatacgtattcactgtttacattaccaggactatgcagacgtggcgcctggtagcatgcaatcattacttccccgttctccccagtatttcgttttctctggatttaagaccttgtttttttgcaattagttttctttgtatttagcactaattcaattctaagctcttctcccagttgggctcatctcctttcagtagaaccagatacctgaggtattctatccattacatcttgaggaaatctcttctggacatttctggcctgtgctaatctcgactatataatccttatgttggcagcacagctggcatcttgggatctcgagtcaggatcatcctggaggtccctctggtccctctgtctctctcatat

SEQ ID NO: 655236 - DNA, 1011 bp, Homo sapiens
gactctggagcctcagcgaccggccggatcgaggcgcaggggacgtaagccacgattactgcggggagagccaagcgtgccaggccgagctctaaaagccgctgcacgtactagagtaaccgggcgaaggcgctggtgcactttgtagggccctgtgttgctggcatgagcagtctgccgtctaatccgtgcgggagagcacaacgtgctttgcaatgcgaagtacgcactaactggtacgaaaactacgggtgatcacccacaacgaaaggctgtcgcgacagcaaagtaggcaactcgggaacctactgtgcctatgcgtttgacagaacatcgtgagaccaggcagctccacaggtatcactacagtctcgtcttggacgaacaacgggcgtttacactggcaaggtcgctgtcggcacataaaatagccactgagagatgattgcccaaggacagttgcgccaattgttcccacgtatgacctcatcgtccattggcctgaagagattgttcacaatgggaggagaaatcgccatcagctttgattgagattggccacaaggtggtataacgaacattggcgttcgcaccaagatatcaccacagacatattaccacaacctatacgtggtgtccaccctgggcgaaagtattactgtggtcgggcaacacgtcagcacaccggctactctgcccatggcttcgcgaccatgcgaggttaccatgggttcgtgtgggtccgacagcatcaataaaaggtgataaccgcttcaacaaaggtgatactggccaagactacagccagattcctatacgtcatgaaaacaacgtatcatatgaacgatgcacagagatcgatgatattcactagcgacaatgatcccgacgtcggtgtaccccccacgtgactcatacaagtggtttaccacaaccactgtagttggggtccaagctgtgccgacgtgtgctagcgggaacaccttttctcaaccaacaggcttcttcgtg

SEQ ID NO: 655237 - DNA, 639 bp, Homo sapiens
cactgcagcctcaacctcccaaggctggtcttgagctcctgggctcatgtgatcctcctgccttggcctcccaaattgctgggattacaggtgtgaaccactgtgcctggccagcatattctttttaatggcattatggtattccatgtaaatgagtattatttaacaaatcttttattaatagatatttaggttgttttcagtcttctgcttttatgaatattactacagtgaaatgccttatatatagatctctgtaccttgtacaagtatatttttaggataagttactggaaatagaattgctgggtcaaagaatatacatttaaaattttgtgtattgcaaagttgtcttaaaagaagttgtgtaccattttaaatgtcctccaacaatgtacagagtataaatacatcagattgatttctaaaagttccccacaggggaggttagatattctcatctgcagggagagtacagagaaataacaatccttttttgtggttagcaattacaagggcctttgcctccctcattgtgaatttgccctttctgtttacccgtattagtttcaaaactttctgtctctatcccagtgggaggatggaagatggacagtctctctgggtttcttcttgatt

SEQ ID NO: 655238 - DNA, 220 bp, Homo sapiens
ggggggccccccccccccccccttttttggtttttttttcttttaaaaaacccctttcccggggtggggttttatccctttttgggtttttttaacccccccttttttttggggtttttttcccaggggaaattttggcccctttacccgggccccttctgtttgggtggggggcctttttttccccctttgggggaaaaaaaaggtttgggccccccca

SEQ ID NO: 655239 - DNA, 354 bp, Homo sapiens
gaaaaagctcggagatggtgttaattcttcacttgagccaatgttagccccaccccactctggtgggtgtttttccacggttttggtgtttaattttgttatacatggagtaaatgcagagtgcttagacaacactttctcgtgtaataaagagccttaaactccacacacggagcggagcactctttaagaggtgttgaaaattatattaaggctatcattcttttagtaaagtcatatttgccaacttttttagttttggcctttaaattttaaaagcctaattttaaagtgctgcctgtgagtaacttttggattaaaaccaaatattaataattggaaaaagaaaaaaaa

SEQ ID NO: 655240 - DNA, 104 bp, Homo sapiens
gaggacgaagcgcgaagagccgcttagttcatgtccggtgttggtggcggcggcggagacttgcgggcccgtaggctgggctctgcgacggttgcaagaaaggc

SEQ ID NO: 655241 - DNA, 403 bp, Homo sapiens
ccagttacaacagctcccaggtatatctctttccttggcaagttgcagatttaggtagcaatctgaatatgccacctcttagagatggagcaagaatacttatgaaactcatgccaataggtaagaaaaatacttccccactcccttcgccaccctgtccctaataccgacaatgcatggtatatagtattgtagtatagcatacaatatcaattgtgtatgtcatccatactatctttgctgatgagaaattttccatggatgattaaagaatgtttaggagcatgtaatgtaagaaatatttttaattaactaatgcacacaatttagaaattaagaattcttcaaggctataatgaaaaacagtgttattttacccatcctcaccagctgttgtaactgg

SEQ ID NO: 655242 - DNA, 889 bp, Homo sapiens
ggggtgcttgtcacacctcgaaatgtgctttgggaagaacgttttctcccccgtaagacgcgctgtgttcacgcccgtgtgaaattgcgccagaaaattggtttctgccttcagggtgttctccccccgggcctgctgtcttgtcgtgttgggaaaaccacttggcctcttcatcagtggtctgtggtgatttacagggtgcttccaaaatagggggcagcgaattgtccaaaagagcacactagcccgggcctgtctgtctctcacatgatctctctcggcgtctgacccaccgcgccctcgcccccccggcgaagtatatctccccggcctagtgcgatggttttctttccgcgcacagatgatgggacagggccttttagcacggtccgccatcaccaaatgtatatctctccgaggcataaccccactcatgctgttaacggctatcgaccacgccaatattcacacttcgtgtgacatccagctgtcgccgcgcgacattacttccaactgtgcacgagcaacacttctggtgaataaaagattgttcttccccgcgttctttctctcttggggggttgatgcccccccgcccgattgcaaggtgcgcgagataattatgcacgctacttttctttaacccctttcttgtttgcctcacagttcgctgtggaccactcctcgaaacggactcttgtaaaaagattctgctgggataacgataacctctggtatctacctacggtcggcgctgtcgttctacaaacttcatcggacatcaaatgcttctctgaagtagggcacacaccagtggcctgccctgcccgagacgtctcccctttccaccttcacctggtcattctttccccccaccaaacaacaaaac

SEQ ID NO: 655243 - DNA, 223 bp, Homo sapiens
ggttgagcggctaaagcacagtacgacaaggatgtccattcacaccacttttattcaatatatctttggaattcctagccatggcagtcagacaagaaaaagaaataaaaggaatccaaattggaaatcagacttcattttttcagttttgctctaaagtagtaactttgcaatcaaaaacttttttaagaaatgcaaataaacatgaaaacacagttgacac

SEQ ID NO: 655244 - DNA, 259 bp, Homo sapiens
tgatagcttcgactggttagcgtcaagcatgacgcgtagtcggtacatgccataactgactgagtcgacttatggccttgtttaatacacctgctaaagaaataacaatagcttcagcaatgtgcagaaggtggtagtttgtgcgatatccctccatctttttgatgcggcacactcggagcgccgcgtcccacagcttcacggttctgcgttgacgaaagacctgtcagtgcacctacagcgatccttcgttcatcgc

SEQ ID NO: 655245 - DNA, 1231 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 655246 - DNA, 1063 bp, Homo sapiens
ttaaattatggcaattttatattacaaaatgataaatgacacggatggagtgttactcagtgatttgtaatttgggactaggatataatctagagatgtagtatatgtgtcagtaactaatactgcgctgccatcatggtgactgtcatggttctacagaaatgccctccatgtgtccctctaatgtgcatgtctcagtgggttggaagtttgtatatcatagtattaacacacgagtgtcataacaactaaaatgctgatagactggaaacaaaaacaaaacacaaacacaaagaacaacacacaaacacagcggcgcggccccacaaaacagcatcaccaccaaaggggccccaccaccgacacgaacgcacacaccagagcacagccgacaagagcggagcgcaccaacaacaagacgcaccgccaacacacgacacgaacgaagccaccacgagcgacacacacacaaccagcgacgaccgagagcaaaacacacgagaccgagcccaacacagctaatacgacaccactcacatcggcgcgccacactaagggccaaaccgcacacaaaccaaaccagctaacagcaaggcaacacgaacaacacacacacaacaaaaagcgacaacacaccaccgtccatattacgcacgacccgaagacaactggcccacgcgcaaagcaccaacaacaccacactacaaaccgctgacgccgcaaccaccgaccgcgtcaaggcaacaccaagcagcgcgaaggcgcacgtagcggaatgcgcgccgaccaaagcaacgcaggccagccgcagcagccgccgaccgacgagacgagaggcgacagcacgacagacggacgagagagccagacgcagcgacgacgaggcgcgagcgcacggcgaccacgggaagagcccgaccgagcgcgaggcaagcctcgcggagaacaaggagacgcaaggaggccgaagatgcgcagagggcagagaggcaaagcggcgagcgaagaggaaccggcgcagcaaagatagaaaggcgaaagcccgagagagaagacatgcagg

SEQ ID NO: 655247 - DNA, 287 bp, Homo sapiens
agttgactcggagtattcacattttttttttcttctgctaatttaacttctgcgacatcattgacattaatgtacatgcgggatgaacttgaagggaaatgctaccctaaaagaattgtctttttatttgaataacgcatattcgtctccctaatgcgattcttgattatttatctttaaaaaaaataccactaattcataattattggctcgaaactcacagcctttatttttttgatcacggatttcgagttgagccgcgcgtgtttccatttttggagtgaaaa

SEQ ID NO: 655248 - DNA, 117 bp, Homo sapiens
cgtctctacagatcccttatccactttatactgctatgtcggctggatatccactttaatactccaaggtatgcaaccagatatgtgcaggcaacctcttccagaccagacgagcag

SEQ ID NO: 655249 - DNA, 478 bp, Homo sapiens
actcatgcggataagtcgtgtggatatgtggttccgatgcattcgactcgtctataacatgcttatctttttctttaccgatatatttcaataaaactaatgggaccacccgtatatcagtaggaccgggtagggatcggaagtacttggcagggcagcagcaatcttgctgtgtttgatataacatgcatccttgggcaggttgcccttaaatcttacactgtggtgaagggatgttttttttggtaatgctgcagtagagtgggagtacttagttctctggtagtccagtatatctaataagtgtttttcatattatttccacgtaagggaaataaggtagtacttttcttttaatatttctatgcttaaaattctctttcctagtcaaaaatggcccaaatctgtgttggctttctgcttgctacattggtctcccttacttttcttgagctaaagacaggctttttccaccggc

SEQ ID NO: 655250 - DNA, 468 bp, Homo sapiens
  misc_feature (336)..(336): n is a, c, g, or t
  misc_feature (373)..(374): n is a, c, g, or t
  misc_feature (423)..(424): n is a, c, g, or t
gctccccagccatggcgttcacgttcgcggccttctgctacatgctgtgcgctgctgctcactgccgcgctcatcttcttcgccatttggcacattaatagcattggatgagctgaagactggattacaaagaattcctatagaccagtgtaataccctgaatccccttgtactcccagagtacctcatccacgctttcttcgtgtgtcattgttctccttgtgttgcaagccacgaagttggacttataacaacatggggggatcctccaaagttatgtgccccactttcttgtgggccatttattcattaatctgcgcgacggctatcatcgangctacgaccccatgtagctgcacgctgggccccaagnngacgtcataagtgaagcccttaacgaagcccattccactgacattgcanngattatttcctaggcactactcggtccatgacagggacagggcg

SEQ ID NO: 655251 - DNA, 964 bp, Homo sapiens
ggcggcacaagtggtcaggtcctgaagagtcgctttatggtgtagaccaggtgcaccagtcagagccatcatcataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtaaaaaaaaagaaaaaaaaaaaaaaccaaaatatttcccccgaaaaaggggggaaattcaagatgggagctgtgcctacaccacaaaaggtagccggccctattctttccacaccaaaaagagagggtgcctggtcgtcgggagaaaattgggtagggaaaacgtcccccgggggtaccacgaaaaaactatcggccctggggcgtcaagaagcgcccacaaggaggtctatgggaggtgcccctaactttgcggacgaagaggccccctcgcatggggtattcgtgtccatcgagggggaggatcccccctctgcggggttggtgacccttgtgttaaacgactgccgagagggaaccattgggtcactccgcgggagataagatgtggatgaacattcgcggaatgatcaaaccgccggttcgaaaaagcggccacagagacctgttttgtttcccctggtcccccaggtcttgagagaacgtccagactcgggggactcggtcacccagtgggggaagatggcgggcctttgtagaaagaaggtgggcgttcacagggtgccaccagggtccccacaggggtgcgggcaccacaaagtaggtccagaagattgagagtggaatgggcccgccccaaga

SEQ ID NO: 655252 - DNA, 258 bp, Homo sapiens
  misc_feature (98)..(98): n is a, c, g, or t
  misc_feature (100)..(100): n is a, c, g, or t
  misc_feature (132)..(132): n is a, c, g, or t
acaggaaggaaaaaaaaaaaaacaccccacaacacaaaacccacccgcaaacgacaacacaacaaaaaaaagaaaaagggaggggcggggggcggggncnccccccgccccccctctttggggggttttttnccagggcctccacgctaagcccttcttctttcatctggaagaagaggcaagggggcaggagaccaggctctagctctgggccctccttcagcccccatcatgggaataaattaattttctcaatgt

SEQ ID NO: 655253 - DNA, 871 bp, Homo sapiens
  misc_feature (257)..(257): n is a, c, g, or t
  misc_feature (289)..(289): n is a, c, g, or t
  misc_feature (301)..(301): n is a, c, g, or t
  misc_feature (303)..(303): n is a, c, g, or t
  misc_feature (380)..(380): n is a, c, g, or t
  misc_feature (401)..(401): n is a, c, g, or t
  misc_feature (421)..(421): n is a, c, g, or t
  misc_feature (423)..(423): n is a, c, g, or t
  misc_feature (436)..(436): n is a, c, g, or t
  misc_feature (441)..(441): n is a, c, g, or t
  misc_feature (443)..(443): n is a, c, g, or t
  misc_feature (453)..(453): n is a, c, g, or t
  misc_feature (456)..(456): n is a, c, g, or t
  misc_feature (469)..(470): n is a, c, g, or t
  misc_feature (484)..(485): n is a, c, g, or t
  misc_feature (497)..(497): n is a, c, g, or t
  misc_feature (499)..(499): n is a, c, g, or t
  misc_feature (522)..(522): n is a, c, g, or t
  misc_feature (536)..(536): n is a, c, g, or t
  misc_feature (539)..(539): n is a, c, g, or t
  misc_feature (543)..(543): n is a, c, g, or t
  misc_feature (548)..(548): n is a, c, g, or t
  misc_feature (569)..(569): n is a, c, g, or t
  misc_feature (609)..(609): n is a, c, g, or t
  misc_feature (613)..(613): n is a, c, g, or t
  misc_feature (621)..(621): n is a, c, g, or t
  misc_feature (633)..(633): n is a, c, g, or t
  misc_feature (635)..(636): n is a, c, g, or t
  misc_feature (642)..(642): n is a, c, g, or t
  misc_feature (644)..(644): n is a, c, g, or t
  misc_feature (648)..(648): n is a, c, g, or t
  misc_feature (652)..(652): n is a, c, g, or t
ggagacctacctatggcagctctcgccggtcgggattactatgacagaggatatgatcggggctatgatgatcgggactactatagcagatcatacagaggaggaggtggaggaggaggaggatggagagctgcccaagacagggatcagatttatagaaggcggtcaccttctccttactatagtcgtggaggatacagatcacgttccagatctcgatcatactcacctcgtcgctattaaagcatgaagacttnctgaaacctgccctagagctgggatattgttngtgggcaatatntntattgtctcttgtttaaaaagtgaacagtgcctagtgaagttaggtgacttttacaccttttacgatgactactttnggtggagttgaaatgctgttntcattctgcatttgtgtagntntcggtgcttcgtnccaangnttaacgtgtnccncgaaaagtatgtnntgcatgtatttttnntacagtctaaantnttgactgctgagaagtctctatngtacaaaacttcanttnaaanggttnttctactgaatccagggtatnctgaagatcgaagcctgtgtaaaatgctaccaaatggcanacgncgcaacanctaaacagttgnannttttantncttntttnctaacatatcaatgcttagcagaactattcagatgtcatgtagtaaattctacaagacaaatggccgttttcctccagtccatgaaaacataccatacttatataacctgcaaactaagtgtttaaaattatgctctgtaactctgtacttgctagtattagaccttaaaatcttaaatacaggcagcgcttaatgcttaacaacaaaacaacaacaaa

SEQ ID NO: 655254 - DNA, 135 bp, Homo sapiens
ctctctctgtggggatggggacccacagagatgggatcaagataggagcagagagaggccagggagacggggagggaaagagcggcaggaagaaggagagagacggaagcgtcaggggtacctgacgctcgaatt

SEQ ID NO: 655255 - DNA, 1302 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtcaacacacacacacccccagtcaaaacacaaaaacagacaaaaaaaaacaaaggggggggttcacgggggc

SEQ ID NO: 655256 - DNA, 1190 bp, Homo sapiens
gggcggcgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 655257 - DNA, 539 bp, Homo sapiens
  misc_feature (324)..(324): n is a, c, g, or t
cggatccccgattgtgaaataggtaggtacagaggacagttaagaccagttaggaggctgctgctgtagcccagctgggatagcagtgccctaggcaaagataacgacagtgaagttaaagagagtggacaagttgggtaaagtttagaatcacaggacttgctgactggagaagagggcaaaagcagagttagcacaacacatgagttatgaccaccttgagcagctcagcagggggtggtgccatttacagaacagagatggcatggacagagcccatggagaaggaggaggaaaaagagagtttggttttgggtttttttnttaagacagggtctctggctctgtcacccaggctggagtgcattggtgcgatcatagctctttacagcctcaaactcctgggctcaagtgatcctcctgcctcagcctcccaagtagcaggattacagatcctacagatgcacttcaccatgcctagctaattttttttttttttttttttttggggctccactctcctgttcccagcaatctcc

SEQ ID NO: 655258 - DNA, 1080 bp, Homo sapiens
gcaagtacaggaacccgagatctgcgcagggagttcccgttgtgccgatttctcatcaccatcacctttcaaaccataaacatcgcagccgtgcgtgttcaccggccatagcatgtgctcatcgccagtggctctcagcgatgctgacgtgcacaaagccagatcacagcaatatgcatggctttccatggcaaccaagaagccaaattgagaaaagcaagaagcaaatgagatgcacaaggcagaagcaagcagttcaaacatagcagcaacagggtcgcgctagttggcacacaccccccaaaggcatcaacagcattcagtggggccaatcatccatggcaagcaacagccacccagcagcagccaccgcagcatttggcaggccagccagacaaggcacaactcccaagtatgctcccaagttgggcactgcacgtccaagcggagcaatccacacagacagctccctctcagcaggccacacgacatactggacatctgtcacttcacacgcacggacccccttacgtcccaacttggcagagtgccaaaaacacccacggacgaccttcccaggccacacggcggcatcgggcgtgacacagcggattcaccacacacagggatcacacaaggtggcctgggattgggggaatggggaacttggggtttatctaacaaggagggattatagggatcaaccaagaatatgggcatgtggacggacactggaaagtggaatatgggatcaggattggacgggaaacaaccaatgaattatccccctccatggagatataaaagagattgggccagtggacagaaagggggaaaattgaccaatatatgttagactacagacattaggacgcaccccaacaccacgggcactggtcaggatgagtaccccacaaattgggaacccagaggcagccccatacaccagtggacttggaaggaacctatcgcctggatcagcaagtcaggagaccctactaaaggggcagccacggcaacaactcacagggtttagccagagacgcccgcggaaagggagggcggggaattatgccagag

SEQ ID NO: 655259 - DNA, 1355 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtaaaaaaaaagggggggtaaattcccagggccagtcgtccgtttgcaaggccaaggggtaaaaaggccgcaggggggaggggattggagacttgggagggcccaagcggaattgtgacgggtgtt

SEQ ID NO: 655260 - DNA, 1227 bp, Homo sapiens
taaaatacggagtttaatttcacatgtatattttggtctccccaccatttccatgtctgaccaccgggtactactagtgtcctatcataacattccatacatacttaaaaccaagcaagaggggtggagttccatctttaaaaactaaacaggcatttgggacaacacattctgggcaatagaaccgggacaactattttatcaaacacgggtaagggaaagttctccagtcggctattctaaaacagggcacagccagattatcacactggtgtcaccgaatatggacaataagacggaaaatttttacacacaaattggtgtataaactaatattcctataaagagaagaatatcctaccactggcgcaagaagatacttggaatagcgcctctaggggtacaagtcataccgggaacagcaattccttacaccataatgggagtgcgaatatcgggcttaccatattgggcgaagaggaaccaacctattgtcgctaataacatagggcttgggcatattagaggctcttacaatgagtgcttctaacaggaactgagggtacctattaggggggtatcaaagagagttaaataacccatgggaaccctggaaaaaggagcaaaaacatggggaccctatcgggaacacctggggagggctcgaaggaaaagggaacggacagatactgaagacccaaaaccgggaatagagaacaacacagaacgcaccaacttaggggacaagaaagaaatccgcgagcaagtaacatacactcacacacaggggcgggccgatatatacatcaaagactaacccggacagtcgaactaaagaagacaagcgagaacaaacaataaaatgaagaagacaagtaaaaccccctgataaaaaaaagcacaacgggcaccaaactggactaacacaagagaccaagggttatgcatgcactccggcgcggcacccgggaaaccacacaccaggggaggacaaacggtttcaacaagaatgtgatcagaaaggtaacaagatcgacggacaccatgaaagagcgagacaacggcatttacttacaagaagacaaaagcggcgccgcaaaataaaccgggcccaagaacaagagaacgacaacaaaccggggcagttaatacaagcccccgaggaaacaggtgcacagcatcaaagaggagacaatagggggggagaaaagagcagcaaagagcacg

SEQ ID NO: 655261 - DNA, 1606 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgtaaacaaaaaaacaaaaatccaacgaaataacacgccaacacgaacacaaacacgcacaagaacgaccagtacaacacacctccacaagaaccaccgcgcgcgccgcccatcaaacacccagcccacgaggaagccagcacaaccgaacgacgacacccacccacagtagagacaggcacgccccggacgggagggcagaacgcaaaagaaggaggtaggcaacgactcaaacgaccgggccggtggcgacatgcgcacccgtgaggaggatcacgcaggcacgcagccccccagaggggaggaaaaccagagacgcgaacaccgacaatgcagacccaggcagcaacaaccacgagaccggggatgcacagcaaa

SEQ ID NO: 655262 - DNA, 1751 bp, Homo sapiens
  misc_feature (477)..(477): n is a, c, g, or t
  misc_feature (728)..(728): n is a, c, g, or t
aattgttactatctctatcctctctcactgtcgtgtagcttgtttgtatctctccctctgctctggagttgtaaataaccatgtcgctgtgccacttttgtatacagctatgctcgtgtgggtggagacaaccccttctgtatgttgccgaggcgctcctctactaaccgactaaatgctcgatcgtcctgtgtcccgcccgcttgtatattaagcgcccacagttgggggggttgcgcggcccgcgcctcctcatttgggctgtcgccccctcggtacgaaagttttttgaatgtgggttggcctcccctcctgaacaatgtgtggtgtggacccccggtgacgccaaggagaatgtttgtgtctcctgaaggaagccacgaagacccgcgtgggggtgggcccccccctgtataacgccggcccgcggggccaatagcacgaaagaagctgaccaccccttatatggggggccgnccaacacaaaattaaagtggccccccccctgctcggccccaaatagcggtgccccccccccttgggggggaaccaccccccgttgccccccatttggacacccagccgtgtgtcctctcctacagcccccatgtaagagattctcccccccccgtaaatagccgttgttgggcccttttgtgggagcccccaccccccccccccccccacggagatttggggtggtataatattaggtcgtaaccaccccntctccgctcacaatttggggtacaaaagtacccaacattgggccgtatagacggtcgccccccctgaggtgggtgacccacacgatggcgtgggacccaacgttggggttttccccccccccaaacagagaggggtctcaaagatatgctctcgccaccccacgtcgccccccaccccagatctgcagagagccccaccacagcgcgctaccagcaactatccacacacgggtgcttcctgcgaaatttgggttgtccccccacctcctggcgcttttcacacaggtcttttggcaccttctcacacgctgtctcacggcgctcttctccgcacccgctgtgttggggtgtctcttctgtgtgtgtgagagagactctcttgtgctcacacagagatacacacagacagacagctctggtgtatgctcacatgtctttgacggcctcacacactctcaccacagccgccctctcgccctcgagagtgcccccctgcgcgcatctctcccgtggagacacacacacacagagtgtgtgacgacacctgtacatgtgacactctccacagagcgggtcccctctctgtgtatcacctcggtgaacactgaggttgaagcgcgcgagtggtaaggatatagccccgacgctctctctccacagaggtgcacaccttcgataagaataataggcctgtcccccctcgaagaatggtaattcactcgacgcgcaacgcgttatggttcgttggagtcttctggtatgagaaggaagaagggctgagaggagaagacacagcgacagagaggagaatatctagagtataatccacattcctctttggcccctgcacagcacacgctcacatgctctccacgaatttcacgcgtgtcacgcttaacctgacacgagcgttaaagctttctgggtagatatgttttcccctggtgcatcaagtcttttcccaagtgtaccctgtcaaaaatttgtcccatcataatctccaagtataagtccattaaccat

SEQ ID NO: 655263 - DNA, 1210 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaagatgttgatgatgatggctctgctggtgcccctggtctacaccataaagcggcacaagtggtcagtcctgaagagtcggaagctggcatatccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 655264 - DNA, 298 bp, Homo sapiens
  misc_feature (36)..(36): n is a, c, g, or t
  misc_feature (53)..(53): n is a, c, g, or t
  misc_feature (120)..(120): n is a, c, g, or t
  misc_feature (123)..(123): n is a, c, g, or t
  misc_feature (168)..(171): n is a, c, g, or t
  misc_feature (235)..(235): n is a, c, g, or t
  misc_feature (290)..(290): n is a, c, g, or t
acacacagcaaatgctgacatcctattggcaaagtnaactgacattggctgcnatatttcacatgatcatttctgccaatcccattttttgaatactaatatttcacatggttaattctnatnaatttgttggcattgtttattgttaatgatgcaaatagataattnnnnattatacacaagtcacatttcactgttaatggtttgacataggtgataagcaaaccaatttganataaaatataaacatgtgccattgtattataacactatacactttcttgacagtnaaatttca

SEQ ID NO: 655265 - DNA, 184 bp, Homo sapiens
tcatcggctcggcccggctttttgggtggctcttggtgggtggtgagatcatgtggagatggacgctgccccaggcgtggacctgagccgcattgatctcaccacccacctggcctcgcagggcggttcatctcctccacgcgcccccacggaagaagccactccaagcgccgccacaaagggc

SEQ ID NO: 655266 - DNA, 125 bp, Homo sapiens
  misc_feature (93)..(93): n is a, c, g, or t
gccccgccagtttgatggcatatctgccagcacattcggcttcattgccacgcttcggttcatgtggtcagccatcagtgttcagcatcgtcngttccagcacatcgcatggcagtcccacccat

SEQ ID NO: 655267 - DNA, 1328 bp, Homo sapiens
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggcatctgagccagagcacgaccatcgaaaacgcatggggctcaaggtaaaagggttgggaggccatggtgggtatcagagaagggctgggagctgggcagggctcctccccactcccttctctgagccttccttgtctgcagatgttgatgatgatggctctgctggtgcccctggtctacaccataaagcggcacaagtggtcagtcctgaagagtcggaagctggcatatcggccgcccaagtgaccctgtccagtgtctgcttgccatcctgccagaacaggccctcaagcccaagagccatcccaggcctgttcaggcctcagctaagcctctcttcatctggaagaagaggcaagggggcaggagaccaggctctagctctgggccctccttcagcccccatcatgggaataaattaattttctcaatgt

SEQ ID NO: 655268 - DNA, 975 bp, Homo sapiens
  misc_feature (901)..(901): n is a, c, g, or t
  misc_feature (934)..(934): n is a, c, g, or t
  misc_feature (939)..(939): n is a, c, g, or t
ggaggttttgactctcgtggcgccccagggccgacgggagtggcggccgcgcggaggaggccaagatggcggcagctgcggcttcgcttcgcggggtagtgttgggcccgcggggcgcggggctcccgggcgcgcgtgcccggggtctgctgtgcagcgcgcggcccgggcagctcccgctacggacacctcaggcagtggccttgtcgtcgaagtctggcctttcccgaggccggaaagtgatgctgtcagcgctgggcatgctggcggcagggggtgcggggctggccgtggctctgcattcggctgtgagtgccagtgacctggagctgcacccccccagctatccgtggtctcaccgtggcctcctctcttccttggaccacaccagcatccggaggggtttccaggtatataagcaggtgtgcgcctcctgccacagcatggacttcgtggcctaccgccacctggtgggcgtgtgctacacggaggatgaagctaaggagctggctgcggaggtggaggttcaagacggccccaatgaagatggggagatgttcatgcggccagggaagctgttcgactatttcccaaaaccataccccaacagtgaggctgctcgagctgccaacaacggagcattgccccctgacctcagctacatcgtgcgagctaggcatggtggtgaggactacgtcttctccctgctcacgggctactgcgagccacccaccggggtgtcactgcgggaaggtctctacttcaacccctactttcctggccaggccattgccatggcccctcccatctacacagatgtcttagagtttgacgatggcaccccagctaccatgtcccagatagccaaggatgtgtgcaccttcctgcgctgggattgagncaaaaagaacatcgaaaagcaggggccaagaangtganaaaaatagtctggtgtgcccgggttaaacccataaa

SEQ ID NO: 655269 - DNA, 327 bp, Homo sapiens
  misc_feature (27)..(27): n is a, c, g, or t
ctggggggaaaaaaaaatccaattttnctgttaatagtaatgctcccaatgaattaatggcccctctgttccataaataaaaagcttaattatccccaccctatagaatctggggcgccacaacctggggttcttttcttttgaaaagctcccccaaaaaaggttttaaaggtaaaagttttgagtaatgtcctccccataagctcttgtttaaaattctttttttttatggataattagggttatgtttcctgtcttttttaacccctataaaaaattttattttcccctctttttttccatgtggaaaaatttaatattgttggt

SEQ ID NO: 655270 - DNA, 734 bp, Homo sapiens
aaatgtaaaagaacagaaattataacaaactatctctctgaccacagtacaatcaaactagaactcaggattaagaatctcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacattcaaagcagtgtgtagagggaaatttatagcactacatgcccacaagagaaagcagcaaagatccaaaattgacaccctaacatcacaattaaaagaactagaaaagcaagagcaaacacattcaaaagctaacagaaggcaagaaataactaaaatcagagcagaactgaaggaaatagagacacaaaaaatccttcaaaaaaattaatgaatccaggagctggttttttggaaaggatcaacaaaaatgatagaccgctagcaagactaataaagaaaaaaagagagaagaatcaaatagacgcaataaaaaatgataaaggggatatcaccaccaatcccgacagaagatacaaactacatcagagaatactacaaaaccgtctacacaaataaatagaaaatctagaagaaatggataaattcctcgagaaaatacacgtttactaagactaaaaccaggaaaagaagttgaatctctgaattagaccaaataaagaatctgga

SEQ ID NO: 655271 - DNA, 1718 bp, Homo sapiens
  misc_feature (286)..(286): n is a, c, g, or t
  misc_feature (426)..(426): n is a, c, g, or t
  misc_feature (537)..(537): n is a, c, g, or t
gcggagtgagatccgcggactatgcatgacattcgtctatactaccgtgatgaccgttacataggtctcacagaagccttctctcatccgggtgcacagatcggtcacagcctctttacacgcgaaagaagaacttcagtgtgaccactcagtttaggacggaaaagtacaggaaggagccacatctaggtgtgcacagacaagtacacgatcgactgctacgttgggagtggtgaggcacgaacgttgtaggctcagtggtgacggtgttggctcactcccatgnccattgttcttgggagaaggacgattctacttgcgtctagcctagtgacacatctgcctactatgttcgctgatagattgtgtggccacaagatgagagtcgtgttagagtggagaagagatcgttagagttctacctgnaacgccaacattagggttgagtgcattgaagaatgctcttgtcaaggaaagcacactcgtcacaaacaatttgtgtggcgcacagcgaatcacatccgatctgaatgactntgggtttgaccccgggcggtctatcgatcacatcactcctccgatcaagtaagcgttcacaccatagttagagagaaggttcccggactaggggtagatgcacacgtgtgcatgtacgttcagggcctccctacatactcgggtgggcgacgaaaggaaaaagtggctataaaagtttgttccctttctcgacaatttagcattgtcactctaacccttggatgaaactacgtaaccacgtagtaaccagggtaaccatagagttggccggttgactattccatttggttgagcttctcttcacatctcccgagcctgtgggcacatatctgcgctctcacagtcttaaaggttttaacccctgtggacaatacatcttaatacgttgggtagtttgaccgcgaaacatgacccggatccgtgaaaataggggtacccgcatgggccattgatccagtgccaagcggcgaatttgcattggggtacggaattcccacgggtcgcaacccgttttaggtaggagactttgggcaagatacctttgagaggtagggttccgaaatgaaccccacgtcggagttggtgggtgcatctcggagaatgagggagcctccctccaagaggggcggtaaacagaccacttgtgtcccgaccggaagcattaagcgttggggtggggccatagtcccgtttttaaacccttggtataggtggagggcagagacttttcgcgaaagggggctggtgcaaaacacctctccgtaggttaatccagcgatggttacacttgggggaagttgtgccgaaaggaaggcggcgtggacacggaaatggctgtgcaagaccccttttcaggatattgcggggacaactaagcgcccgcagcggaggggggaactccggctctttccaacaggggcgcaccgtgagatgaaaccccacaattgaggaacggagtgaacagggggggtgttatcccccaggggggggcggcggagtcgtcgggtgttccaaccctgtcgacgctgtagagattaacccccggggtaccccgctcgtgtacacaacgcgaatgctccggcacacaagcgtcctacgccgggcaatacagccacggtggaagaaagcggctcttactgcgccccgagcaaaacgaggacactctcccgaggagcaccagt

SEQ ID NO: 655272 - DNA, 467 bp, Homo sapiens
gaaacacactgatcctacatttggaatatggagacacagaaaggttttggtttcaaaggtagccaaggcagaattaccaggaccctacttaaaggtttcactgtgaggaaaccaaccttaaagaaaaaactctcccttaaactgatatcaagccattgtcaagtgcattgttttatctctttaatgtctcacgaaaccatcaacttctctccaaattcaagaaaaccatcacctgtctggaatacttaaatgaccttttaataatccaaatgtgtttttctaacatgtcctcctgctaatctctacatttgagccaatgtcatcttggcaaaatgccagattgctgatgtcactactgctcagacccatcacagcatctccacttaaactctcaaacagcttcgaatgactcttataaggaaaatcaaaagccttaggccctcatattcaataatattctacacaaa

SEQ ID NO: 655273 - DNA, 582 bp, Homo sapiens
tattttggtattggaaatatccccagtttgatgggcaactttgaaaatgctgtggactacttccacacagcccttggttttaggcgaaaagaaacattttttgttacaaaggttggtcattgcatcgaaaaggacattggtgattttgaagcttaaattggagcagacattaaaggccaattaaaatgttatgactttgatgggcaaacaaagaagacactaaaaaacattatttcacctccgtgggatttcagggaatttgaagtaaaaaaacagactgcagaaaaaacggggcttacgccattggaaacctcaaggaaaactccagattccagaccttccttggaagaaacctttgaaattgaaatgaatgaaagtgacatgatgttaaagacatttaagtcagaccccaggacgtgactccagtcagtggttctggtccccctgtcccagggtaggaacaaaaacccgccttaaaagaatggattgcacacctttgcaacaaatgtgttttgattttttgaacctacaaaaaagttaaacaaagtggaataaagaaggttaaccctccaaaaaaaaaaa

SEQ ID NO: 655274 - DNA, 113 bp, Homo sapiens
cagtaaatccaaaacaataaaaattttaaactacaaaagatagagtatagtattacagcaaatataaagaggtaatttatagactgtgtgaacgtaatatcaggactatttac

SEQ ID NO: 655275 - DNA, 763 bp, Homo sapiens
cttttttaaagaaaacccctgggtctgggaaggaatatttttgacctaaatagagcccggggacccctggaactgataatttcaaccgaacccagaagggttattaagcctttttaccccttcagagcaacatggcttatcggccaaaaccctccaagtttttagacaaccagacgcttgctcctcccacaacacctggttagcaatccatggtaagaaggatacatgtcttttagtcagccttatagtttcacatagtgtgcctcttatagagagctcatccccaagtggtgtggcaagaggagcacaatttcctttcatactcctgttaagcagtcacttacggtgctggtctcatgaagaaaagtccttctggcccaatctctgccatatcagtgaacatgtacagcgtataacactgagaaattttcttcagtagttaggattatatcgttacgctgttgtctacatgcaatcttcaaacagagaaagtttcgttatattaaaacacttaggccaccattgggtctttcccatttctacctaagtcagcattcatctttgtgtatggtgtctccccgagtaaataaggaaataacaaagcccgtgttctcagttttttgggaccacactcttactatgagttccagttcgtctttggtgaacaactgtgtaggtaatccagtcgcctctgtcttaagcatcgtcataagtggtcaataaaacacagtggtggtcgcgtaacattaaaggcataaatgac

SEQ ID NO: 655276 - DNA, 106 bp, Homo sapiens
ttggagctcggtaccatgctgctgtctagtttttatatgaattcccgcttccaacgaatcctcaaagcaatccaaatatccacttgcagaatccacaaaaagagtg

SEQ ID NO: 655277 - DNA, 641 bp, Homo sapiens
gtgccacttggcctgcctccgtcccgcgcgcgccacttcgcgcgtgcctccgtcccgccgcgccacttcgcgctggctccgtcccccgcgcggcggccaatgccgtgatggccggtcctcggataacttacgacgtccagcgaaccttgcaccaccgtcgcacaaagaacggtgacgccgtacgactcagcgttcggcgcactcgaaacgcattgcatcaacagtcggcacgatccaacaattcctccgctgccggctgtccagagaaggaccagacactgaccgtgtgcaccaggcaccctaaaaagaatacggacatgcaggcacgctaacacaccctgaagagatgaaatcccatctgctgagcaaaccaacaccgtggctgtctgagaaacgggagtacataggaggagcatcgctagtggttaatcaagggaatccacaaaatgcctacaaagaccattggaacaaacccacagcgccacgctgaacaactctagccgcctgcacacaaggcatcccagaaaacccacagcaccagcctgggcaataccaaccacaaagaaaaccaaccgcgcaaaaggaacaccagataacaggcacccaagcgaagacaacaagggcgcacaatacagcaaaaa

SEQ ID NO: 655278 - DNA, 471 bp, Homo sapiens
  misc_feature (75)..(75): n is a, c, g, or t
  misc_feature (111)..(111): n is a, c, g, or t
  misc_feature (432)..(432): n is a, c, g, or t
  misc_feature (434)..(435): n is a, c, g, or t
ccttcctgtacgagaactgggtggtgggaaaagggggcttgtttttcctttctttgtattcactgtaggtgtganatgtttgacaatttgacagtctgtgacatggttcanagatgtggttcctgcatgttatcagggcttggccaggttcaggcaggcctgcaggctgtccctacaacgggcagattgaagtgtgcacagatgtccgtgacagggctgtgaccagcctgtgatcaggctgtgaccaggttgctgcctggaccaggcagagctttgtcccataataggggtgctgccagggagtctggcacctggagcacagccactggcttggacatgagccatcaaacagcatggaataaaaatagaactgcttcagccggagaggagacaggctgagctccttgctgggaggcctttaaaacaagaacngnnttcattgatctgagactagtaaggaagttgctaggg

SEQ ID NO: 655279 - DNA, 409 bp, Homo sapiens
  misc_feature (15)..(15): n is a, c, g, or t
  misc_feature (22)..(22): n is a, c, g, or t
  misc_feature (125)..(126): n is a, c, g, or t
  misc_feature (138)..(139): n is a, c, g, or t
  misc_feature (265)..(265): n is a, c, g, or t
tctggtccttcgggngtgaccnctgtatgaagctgctgacgcactgtgactccagccagagcccccccacgaaattccttgagctcataggcattgctcaggggtcagactgacagttcgtgagnnactcacgtgagnnttgctggaacgaggggagaggctgccacggcccgacaaatgtccctgtgaggtctatcatctcgatgagagaacctgctgggacgacagaggcggtcgcggtttcgccccaagccgtgtcggaggnaagccgtcgatacccagttctgaagacagtccatgagaagtacaaggccaggccccttcagtgttgcagcagtgtgctgacggcagcgaatggcagccactgcctgggagacggactgggaaccaaaaggcagttgggcatggg

SEQ ID NO: 655280 - DNA, 871 bp, Homo sapiens
gcgacggctcgtcgagcccaccaggagtggaacatacaagtacagatcagctattgaaaagatagatgactaggtggagtgtaccattgagtcatactctgcaagatgatacatgtcacatcaagacaatacgactgcgtgatagacctggactataccatcggagatacccgatagacaatgaactcacggatgtcacgtcacgtcaatggacggaatcaagttctagtgtagtcctcatgtagacctggacggaagccatatccacctgcaaagcatacaagtttaaccactcttttcttgtgctacatacgccagtggaaggacaaccgcgcacagggctccgattcgctcactcgtgagtcgtcagtcacgtaggccgatatggagaaccattgaaatgagtgcttataccatgaactcaggggggaccacttattttggcccatccggggctggtgcacgtccacgtctctcctagggcatgagacttctaaattaggaactcaactagttgagttaaacagatacaacttggcgacgtgcaccgctttggagcgaagggccctccaacctaggcttgtagacttattcacagatacattcctttcaatgacaggagatcggcggacacattgtaaaaagctgcgccatttgctgggtcgcaggcgcacctagaaatagctctggacattcacattacctactcggagtacgtgacgaccattgttggggcttttctaggtgttcgggaccttggcaaggggatagggggggcctttggagtctaccaactaccagaagattgaaccgtgtgagccagaaaacctcatttctaagttccctagggaaagagacacacatgaccatg

SEQ ID NO: 655281 - DNA, 267 bp, Homo sapiens
cagtggctcatgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactcttaagaagataaaaagtcgacg

SEQ ID NO: 655282 - DNA, 953 bp, Homo sapiens
cgcaagtggcgggagctgtagtcccagccacttgggaggctgaggaggagaatcactagaacccaggaggtgaggttgcagtgagccgagatcgtgcaatcgactccagcctgggcgaagagtgagaccctgtctcataaaaaaaaaaacaaaaggaaagcaaagcaaaacaaaaatgacgcaaaacaagaaaaatcagccacagttccgctagattcacagtcaaccaaaacccaaaacagagcccaaaaccgctacaggttccactagattcaccagccatatttcctaagcaggagcccaacattagccacatgttcaacgtagatcacagctcaaccaaaccccaagagaggcccaaacctgccaccggttcccaggtagactcacaggtcatacacaaaaccaccaaaagaggcccaatctaccgccaaagttcccacttagtaattctcaacgccaaagtcccaggagcccaaccacagccacccgcttcccactaagcattcacagtcaaaccaaatccccaaaagaagccccaaaaccacccacagtttccacttaacatcacagtcaaccaaaccccacagagaccaaaaaccaaacgtttccggttcacaaaccaaatcccctaggtacattgacccatccggtactcagcattcacggacaggccacacccctgaggccaaatgcggatgacttgttgcactccttctgaatccaccgtgtgttttctacacaccactgatacctgaaaacagacgagagcagcgaggtgagagcagcgccatggtagccacgatgcctcagctacctctgtgcttgcccaggcaactgtgggaactttcagggtacttatagcatcggtgccagcgatgtattaagaaatgaagcagcggttaataaacccggggcgggccatgacacgggatcatatcggaaataccgag

SEQ ID NO: 655283 - DNA, 375 bp, Homo sapiens
  misc_feature (149)..(150): n is a, c, g, or t
aacggtcgcgccaaaaagggccgcggccatgtgcagcccattcgctgcacgaactgcgcccggtgcgtgcccaaggataaggccatcaagaagtttgtcattcggaacattgtagaagccgctgctgtcagggacatatctgaaggcanntcttcgacgcctacgtgcttcccaagctctatgtcaagctgcattattgcgtgagctgtgccatccatagcaaggttgttaggaatcgatcccgcgaggcccggaaggaccgaacacccccaccacgattcagacctctggcgctgcacctcgacctccaccaaagcccatgtaaagaggccgttttgtaaggacggaaggaaaattaccctggaaaaataaaat

SEQ ID NO: 655284 - DNA, 776 bp, Homo sapiens
agcggatactctccagtgacgcggccgtcgccgcacctgcgcggcggggcgggaaggagactcccagcgccggggggaagggagtctacgactcgggagggaggtgggggagcacgggagagagagacgggaacaagggagacacggacgagacggccggacaggcggacggggcggaggggcggaggggcggaccgggcgcgaggggcggtccttcccggaggttcttaggtccttcacttcctgtgttgccggcacttcaaaatccgggtcaaagggtgtcgctatcgcgtctcattctccaccggctgatcccagacactctccgtgacagcgcctcctgactcagcccaggaccggcttccttctcacgacctgctggagactggacgaccacacctgacccggaactcggcaggcgtgcttcctcaccaccacgacggctcaccagccccgggctctgaaggcgtccccagcacgtacaggacacagacacataggagagagagagcccgaaacagggacacccttcggtgagtcactgtatggcctgaaactgcgggaaatcgcagaggcacccagtggcgcccgtgacgcgccgatgagtatacacggggaccctacatgaggacgcctcttaaaaggccaagcacatgcaagggtggcagggaccacattcacagagaatactgcccagcgacgaccaaatagactcacaccggcacacgggcaattggacaatcggggtaatcccgtgacgtccaataaaaatggtg

SEQ ID NO: 655285 - DNA, 286 bp, Homo sapiens
agaattatttggctcgctatgtctctttcccagctacagtcattaactttgcagttctgtaagcctcattgatgccatggatattaatgtggcctttatccatgaaacaggaagcttggagttggcttaatcagcatgagtcagccacgctcacctgcaatgtgccttttaacctctgttgtcatttgcctctggatccctcagatccagttttttttcctagggctttgacctgaaattcggaattgagtctgggacaacgatgtgtctcaggggagttgcatgg

SEQ ID NO: 655286 - DNA, 576 bp, Homo sapiens
ttcatatccagtgcttcactgcttagttcatagctccatctaatcctctgtgctaagtgaaagctcaaggtgattgactattgtagcgcacgaactactatgtactaaaaagcagatcatttcagtgtcttacactttcagcatataaaataaaggcttcattaggatagtaaaagtgctgtggagttaaaattcatggattaacaatagcatgtcatgtcttatttccccatcaatttcttgctttcgctcctaaaatctaaaagcaaaacagggccacatcgtttagaatgcattctctctaaaaaatgctatagtgctatagatcatatctgcctcatccaacacgagtaagctactaaattaaacgtctgttctagctgatgtcgtgaaaggccattacctcatagttgattggcaagatatgagttcataaagaatttgcctttctgcttaggaggataaagcaatacaataattaaaggatatctaatatgcaaaagtctatattaagggaaatattacatattctctttacaatgtccagtgtcataatatgttatgtatccatgcttt

SEQ ID NO: 655287 - DNA, 254 bp, Homo sapiens
ccgaatcaactctgcccattctataatctactgtgaaatatcttctatcttgatacattcctctattacttcttcatagtcttatctctggcctgcaaggtattttattttcttcccaaaagggtcccatctttgctatctgttgatcagccgtagaaaatctaagtatgatcaataaattttaatggttgatggcatcctgtgtcagctggagtagttggttgtgaatattaaaacctagtactattttccct

SEQ ID NO: 655288 - DNA, 1011 bp, Homo sapiens
  misc_feature (36)..(36): n is a, c, g, or t
aattccatccgttagtacacacacatacaaggaacntagacgcagaccctacaatgaaaagcggcagcatgaaacagttaaactatatgacacacttgatcgaatatgacagacactgaaaatcacgattcatacccctccagcacctctacctgttgtccgtcgatcacagacggaatgcacatcgaaagattacctggggtcatgcttcaactgcccactagcggactatgtagactctaaattcgtatgaaggattcgactgtgaagcatagaatacatggcagcgaatgtgaaatacctaaattgcacaagtacctcatttctatatataagccataccgtttcccttgctatttatcttgataggtactcatgatttacaccgccgtaataatacaattagtagctatctaggttaaataaaattatccaaaagatcactcattatgtcatactacacatacatttcactttcagcgcaagaaaaagtcacaccacaatgatttccaactttgttatcgtatattaaatcaaaatcctcatatgccgcatactaagtatagctccattcgacttatactgtacaaccatcgattatcataatacctcataattaatgtcatagataatgctatgttatagtaacactacatattagagagtcatacactctctactatgcgacattaacctcccaccttccatttataatacacacatatattatattctctatcataccattgaccaccaccatccagaaaagacgctaccaaaccgcagatacctgattaagaaattactatgaagtatagactatttattagaaaaccacactagtgcggaaagacgtgatcaatttccacaacatgtccctctccacgctttgtaccattatacaacctatatcgaacctctcatatacacccaccatcgtagatcctatatttatcctacatatattctccgcaacgccccaccacaaacaaaatcatattatatttatta

SEQ ID NO: 655289 - DNA, 282 bp, Homo sapiens
agtccggtatggctcgcgcatctgtaccggactttttcgcggtgggccgtcgctcggcttccttgatgtccagggtgatcacgccccatttggcggtgggccgcggtggtgggcgcgttgcttccaggtcgataccgatgaagtcgaaggccaggcccagccctcctctcggtcaacgcttttgggcaccacttgcaggcctagactgatcagttgcgccaccaacgcggccgctatgcgcggggggtttttctcaaacccttgacgccagcgttcggggtt

SEQ ID NO: 655290 - DNA, 151 bp, Homo sapiens
tgccccacacctggacatcctgaaaatatgctaaggccatatagacacggtcgccctgcagctcagaagctgggcagtgtaaccagccagcactcacaatggctccaatgttgcatgcaactgtggaggctacgtgtccaccactgccttg

SEQ ID NO: 655291 - DNA, 342 bp, Homo sapiens
ggtcgacctgtgactgccatagatggatctgagcagagtacattgaaaaccttctggaaagaattcaccattctaaatgccattcatagaaagaggtcaaaatatctgacactggctgggcatggtggctcatgcctgtaatcccagcacattgggaggccgaggcggatggatcacttgaggtcaggggttcgggactagtctggccaacatggtgaaacccgtcctcactaagaatacaaaaattatctgggcatggtggtgcatgcctgtaatcccagctactggggaggctaaggcaggagaattgcttgaacccaggaggcggaggttgcagtgagc

SEQ ID NO: 655292 - DNA, 449 bp, Homo sapiens
cacgaggggctgtcaccggcttgggctcgagaatggtcagcttaagcgtgtagaagatcaccgagtcgatgacgaaagtcgtcgcgcccacgagggcgaacttgatgagctcatggtgccgctcggcgaagggccggatcgggcggggtagccgcgcaatcgtggcatcagcgaaggacacgaggagcaagtctacggaaacaccctgccgaaggtgaacctgtgcaggtcaccgccggtaccggtcggcccggatgcgggtcgcgggaggcatgacaacatatgtgccgtgccccgaacgcccagtgactcccgagcgcccatcgtcgcgatgatcggcgggggccagctcgccagaatgacccatcaggccgccatcgcgctcgggcagacgctgcgagtgctggccgccggacccgacgatcctgcggcacaggtcacacccgatg

SEQ ID NO: 655293 - DNA, 1800 bp, Homo sapiens
acagtgtgatgtcctttatgaatccgttgtgtcactgctcgttttgtcctactcggctgtcgactcgtctaccctgctatcgtcgctgagactcacgtgcatggtgctgcggtgactagacgtcgggtggcattctgctgggccctgcttgcgtcatgctgttactatgtctgttgctgcgattgtcatgtctctgtgtcttgttccatcctttgtctgtgttccgctgtgtgctgtggtgtcgctgttgttaggatagttctcgctgtgatgttatcggcctgtacacctgttcagcttgccactgggtatatagttggtttcgcctgtactgcccctatcatcctcgtttgagtgggatgtgcttccgtactcggtattcttatctcgctctctcatcgctaattgtgttggccgctggtggctgatatgatcgtgcgcgtggtgccgctgcgtgtgtcggacgtggtgtgtgttcgagctggccctttgcgggccgattgccgttgtttcgttgttggcgcgctggagtgtgtccggtatatgtggcttgcgatgtgtccgtctgtgtggtttgacctatccgtgtgtgcgtcgtctgtggggaggtctggtctgcgtgcttctgtgcttagattttgttgtcggtgttgcggtgttcgtctcgtctcgtgaggtgtttgttcggcgtacgaggctggcaaggtgactgtgggtgggttgttgcttgtgtcaaggggttggtggtggcaaggcggttggttgtgtcccgcccgtgtctcgttgtcgtgttagccgtttaagctggtgcctagttgtgtagtcctagagtgtgatactccgctttgaagtgtggatgcactgggggttctgtccgtcgcctatggcttcttctaagtggggtgccacttttggtcgtcgatccgtctctgtgtctgtgggcctttgcctctgttggtttgtcttttgtggcggactcgatagaagcctgttaacgcactggtgcgtcgggcgaatctaatgggctctcgatggcagtgtgtatgtgccaagtttgtccctagggtgtgacctctaggggtggcgatctcggttgtctgtcagcttgagaccccgtgagcgtgttgtgacttttatggtctggtttgggtctcagctcgctatcctaactctctcttggagatatctagtctgtagcatctggagcatgcaggtgagatcccttgtgtccgtggtccctcctgtttaggtctgggtagtcgctgtctagtgagtgtgtagggtctgtagctcttgtaccgatagcatatggtagttgtcctctgatatagcctgcagcggtctcatgtaggatcatagtgacctaactttaagcggcgtataggatcgcgaggtttatatactggcttggtagatcacatgtggagtctataattgctttgatatgagggtactctatgtggtgagcgcgatagctcgcgcatgatgtcgctcactgtgccctgtagcatgctacacgcactgtctctggtaggttggcgtgctgctagactgctgccgctacctcttgtaggtcacacagtgacttatgtcactagtaagacgatcggggtatccgctgttaggggtagccaaggtccagtaagtttgggaggtaggtagtcccgctagagtctctagaagagtgggctctttggagtacagggtccccggcctcttcctttatagattctctccccagctggaaggccgtatgactgggtggtcgggtagggagacttacagctctcctttctgtcg

SEQ ID NO: 655294 - DNA, 1062 bp, Homo sapiens
  misc_feature (10)..(10): n is a, c, g, or t
  misc_feature (85)..(85): n is a, c, g, or t
  misc_feature (172)..(172): n is a, c, g, or t
  misc_feature (176)..(176): n is a, c, g, or t
  misc_feature (231)..(231): n is a, c, g, or t
  misc_feature (241)..(241): n is a, c, g, or t
  misc_feature (250)..(251): n is a, c, g, or t
  misc_feature (261)..(261): n is a, c, g, or t
  misc_feature (268)..(268): n is a, c, g, or t
  misc_feature (270)..(270): n is a, c, g, or t
  misc_feature (273)..(273): n is a, c, g, or t
  misc_feature (446)..(446): n is a, c, g, or t
  misc_feature (448)..(448): n is a, c, g, or t
  misc_feature (450)..(450): n is a, c, g, or t
  misc_feature (452)..(452): n is a, c, g, or t
  misc_feature (471)..(471): n is a, c, g, or t
  misc_feature (476)..(476): n is a, c, g, or t
  misc_feature (521)..(521): n is a, c, g, or t
  misc_feature (525)..(526): n is a, c, g, or t
  misc_feature (551)..(551): n is a, c, g, or t
  misc_feature (571)..(571): n is a, c, g, or t
  misc_feature (637)..(637): n is a, c, g, or t
  misc_feature (1062)..(1062): n is a, c, g, or t
ttttttttcnccaaatctgggagaattttcaaaataagaaaataacctttatatgatatactatgactaggctgtgtatttcttntcagggatttctccaccctcagggtgggatgaagtgcagttactattaccatagccaacctgtagttttacataaacattttcttgnggancaatagagttccccattttacagaagcattttaaatgtagtttgaatattttccncaagatgccncaatgtgcnntatccccccntttatcncnaanaaagactaaactggttgtcagttacatctgacagaaaaaaaaaaaaaaatcactgtgtaaccaggttaagtggtaaaataatccaggcgtcagtcaaaggcatttggctgactttaatattgattatatttttaacaggaatttaagaaaatattactggaattaaaaatatntntntnttaaacaagaattttcttngctcngtctagcttaaactactactcaagctgcttaagttcttaagtatngttnntaatcaccaataaataagtgcattngtaattcatcagtcattatnagcttttattaaaagaagattacgttttacaatgtaactataatctctggaattggggtatcttantaaggagttttaaagatgtaaaacctaaccttttttaaaggctccatggtcttatggttttgagaggcttttccataaacatttttcttacatataataaacttttcaaatctgtgcaaaaaaaaaaaaaaaaaaaaaaaacaacacaaccaaagccaaagacacaccacagacaacaaaagcacaaaaaaaacaaaaactgtgttgggggggggcccgcgcccaagagaagtttcaacaaccacctgtgggggggggcggccccagtggtagaacaacgccggacaaggtgtccaaaaaaaccgcggcaaaaacggcgggggtccccccacaaaaacaagccggcggagaacgcgcggtgacaacacccaccggggggcgggggcaggggtcagaaggggccgacgagcacccgcgccgagggn

SEQ ID NO: 655295 - DNA, 1096 bp, Homo sapiens
  misc_feature (408)..(408): n is a, c, g, or t
agtaggaatcacagcttcatgagacatgcctaatgacctggtgtcaagatgctacacgtggagtccccaccagtgcctcacagttaacgtcaggttctgcagcactccatgggtcacccgagaaagacaagcttccctcataagccagctgtcccaccaggacctacagtctctgtgaacgtggagcctctgggctgccacggtactccgtgactcaacagctccaagcctcaccccccagcgtgaagcccattcgagtctatccatccatggagcacagccggtggagttgagtgaagtttgctctatcgcacgcacgcctgtgagtgacaccaggggcattctgggccgatacgggacgggtgcatagtcctttgacatgaggtcatgcatagctatctccacganggcgatgcaaggctgggaaaccacatgtggtcgcagatgcggaagctgtggacatccgcgaggagggcccgagggcaacgctggccaggtcctcatgacaccacgcccgtacattgacgtggtgtgaagcaagtgccattctccgttccccaggatggacgtcttctcggcctcatcgctcgtgcgtggtggaaagcgattcactgtataaacgtatatccctatgcacaaccaacatgggcatcaaaccacccatggattttcacaacgatcccattgtgcctttctgggagcagaaacagccattgcgggccccaggacgggcactgagtcacagctggggctctcgtgaagactctttagagcaagactctgggatcccaccctggggaaccactcaatgattgggcccaccttgtagcccatcttgcaacacgagcctccgaagaacatgtcccagttgtcaccctcgtctccagaggcattcttgccctggtcatatggcaggaaacttcaattctaataccccgcaatcagctacctatatcacggttcctagtacgaggctggggaagttcctagcaacccacttcccgtggcaacaatgcagtgggtcaacagtgttcctgtccggaatacccgcatcaaggcaccgagagtcctgcttgtctacagcacggggatcccc

SEQ ID NO: 655296 - DNA, 815 bp, Homo sapiens
ggcggatcttagctgtcgccacctcgcgccgggtccgcgcggcccacgggaccccccagtgatgctgcccggcccgcggatccacatggacgtgtggtgggcctgaagcctccggcgggtgctcgctgctgtatgcgtgataaaatctatgtcagtgaacttctaggaacatattgcaagactcgtgacgtgacataccatttgaaaagccatccacggaatggaaggacaatcgggaagaagtcgctaattgagagaccttacacgaaagcaagtgatcgaaagtgactatagactgtgtagcacagcgtggacaatttgcagacacacttctacttaccatgacacaaatactgctagagagcaccctaatctggcaggctatgctctgatagtattgtgacgaatggccgtcctcctacacggcatagtcacttaagggcttacactcgcgtccatgacggtgccggcccgtcactcctaaccagggacttcggtcttctcttgaggaaggaggatcggcaagggtggctccgcctcgtgtctcttctcgcactccgttgcctgggcagcacatgaagaaggggacgcgccggtcggtcattcggcaatggaagacgtcctcccccagaaatcacacggagcatcacccttgattctggagacttccatgaacacacaagaagctgtgagaaatgatcacacgtttgcttgttgttttgagcagccaggtctggaacgtattgtgttgtggccggtcctggggtaagaggtaatacgatatgcctcacgattttgaacagatagagtgttca

SEQ ID NO: 655297 - DNA, 335 bp, Homo sapiens
  misc_feature (335)..(335): n is a, c, g, or t
ccggtcttggtcatggttcatggcaccactcctttataacaatgccctctctcaccactcctattcaacatagtgttggaagttctggccagggcaatcaggcaggagaaagaaataaagggtatccatttaggaaaagaggaagtcaaatcctccctgctttgcagataaacatgattgtatatctaggaaatcccatcgttctcagcccaaaatctcctgagctgatagcaacttcagcaagtctcaggatacaaaatcaatgtgcaaaatcacagcattctatacacattacaacagtgggccaatactgagtgaactcccattcacaattn

SEQ ID NO: 655298 - DNA, 149 bp, Homo sapiens
gattctcgagccgcgacagcttctccggccgcacagcttctcccacacacacaacacccacgtatgtatatataataatgagatcttaatgagatctttatggacaaaatcctagacagtgacttatgagtttagcagcggagccacgc

SEQ ID NO: 655299 - DNA, 373 bp, Homo sapiens
aagccacaggaggtttagccccagattcaaaagggtgtccaccgccagctcgattgacttgcctcccttgcccccccccagctttgggaggggggttgtggccgtttttcccaaggggtcaggctgttccggcccaaggccaaggcccaggcccaggcccagggttcaacaagggcccgggttcagcccccgcttcagtttcaggtcagggttcccaaagttccccgggcccctccaagggtttcaagttgattttttttcccaccttagggcaaaagggctggttgggcccccccccccccccccttgggttccctttgccttggggtggggtcctcctttgctttttgttccaattaaccttaggccggga

SEQ ID NO: 655300 - DNA, 857 bp, Homo sapiens
tgggtgattaactcctttccctggtgtccttttcctctccgtatttgcctctctcctcccatttctggggtcctacccattcattggccttgtagactaggggctcgtggccccttgcggtggcaccatgactatccatgagggtatggtttagcctgcatctttgtcgcatctgtaacgcctgcaagacctatttgtggatcaaagctttggatccagactcatcgaagggatcccatcgaacaaggaaagcttacttgagatggtgtgtccgtattcactgggatgtacactgtagtcatactttgtcactcagttgatgtatgtcaccacgcattgaggcaccgcatgaactctatccttcaggacagctgaggtggcatgaagctgccattactatgtacttagctccatctggtcctgtcttcctcgttgcctcctcgttcctcttgcttgtctctttatgcttttctttggcttgtctttcttgccacctcctcctcctttgtcttcttcttttcttccctcctcctgcctcctcgctctctcttgttcctttcagtttcagatctgtgggagacaaatgtgctatggagactgctattcttgtgctccttgagtaatgggggggatgttccctctgcgtgctagtgcaaggagcaaagctagcactatttggtgctgaagaggagccgagatgaacgtcgaatgttcagtccctcggttcctcttagaaagcaccatgtgttcctttgaaggtgaaatgtgttcgaatgcgttccgagcagaccccgaatcaccttctacgtgtaccctgacagcgactatatgtatctggcatagagctcaaattaccg

SEQ ID NO: 655301 - DNA, 442 bp, Homo sapiens
cccatctatcttaacaggatcaccacataaactacagattgctgcctacatgagacaaccactatcgtcaatactggaaatcttcaaatatcttatgttgggaacgcgtctccccattgccagttcgagttcactcaattcttctgtgacacaggttgcaccggactcactcaactatggagatcagatgtcctcaggaaaaaaaaaaaaaaaaaaaaaaaaaatacccccttaaggctgtgtcccgggcctcctctctcttcctgacacattcccaaaagggaatttagggattgtggggaaggacaaggggtgaggaatttctaggacatttataaacgcccattgtaagcaactctattgcttgaagggccatgcacaataaacctcttgggcctgtatgcgagaagaaaatttgggtgtatgctgcctcatggtttgc

SEQ ID NO: 655302 - DNA, 540 bp, Homo sapiens
ctcggctctagttgtcctgagcacacattcggcctggtgcgtagcagatgattagttgagaacaaacgggtcagagcggtcgggaacacagcagtgtgtctcctctacttcagagaacagcgtcctaattctgcttttcagataaatctttagactcatcctcccacgactccttaacatgagatcaccgggttatatatttaatgaagaagtaacagatgttccttatggtgcagttctacttgagttaatgtatttcaccagccaatactactgtattccctattcagtaaacagtatatttaatacatatgtagtacagtaaatgctcttgcattggaatactgcatgtacaatctgatgaaaccctaaactctgtagtttagttaaatggtattgtagcattgtcctgggtcctgcaaatgtgccgtggttatgtacagatgttatcactggggaagctggatgacgggtatgaaggcacagtctgtactatttttgcaaattctcgtgagtcttcaattatatcaaattacatag

SEQ ID NO: 655303 - DNA, 1343 bp, Homo sapiens
aagtttgcccccagacaggggtcatttttgggggggtttttgacaccccccttgtgggagagagcgtgtgataaaaattggtccccctccccccagtacaaggtgtctgagtaaccagggggggcacccttctttgggtgccacacaaaggaggtttcacaccttgggcggccacaaaaaaacaaatcatttctacggggggggcccccccccaacagttatatttgaggccgagagcaacttcgtgggtcttcccgccgtgatagaaggatcccccgagagatgatggggagaagcctttataggagccccacacggttatgacccttggggtggtctacacagcgctaacagagggttgttgtaggaggaggaaggggagtggccacctcccaaccccaacacgtggggggtactaccgcaccaccacacgaccacagcgtggtgttgaacttctgaagggagttctttgagagagctttgctcttggagagagcccgaaacacgtgcgtctcaacacacagagagcctcttgagaggtgtccggtggacacacagtggtccccacagtggtgccctctatgggagagagtttctgacgacctctcggggagactcctccactctgagagagatattctctctgagaaaggggccctacacgcgttgtgggagagagacacacagctctcttgagagggtgagaagtagtgtgtgagagagcgcccggctgagacacgcgtctctcatcacacaagagttgggagcgacacagtcgtcttcacacactggcggggagattccctcctgcgttggcaacacactccttgagaggttcaccagagagcttggccgaccacagagacgctctcgggccacagagaggggagacacaggcgcgcccacagcgcgcacacagagagagtgataagagaggcggcctctctgggctgtagaacatcatctatagagggttaccaaacgctgtgagagaggctcgagagagatatgggccacactctatacgccacgcgcgcgctcgtcgcctgtgagaagatatgtggacgagagagagactctgtagtaatatctgtggtgggagatgcgcctcgtgtgagacacagcaggcgcaacctctcacatgcacaataccacatctcacaaaagagcgcacccaccaccgcccggagatatatgtgtgagatggcacaaaggtgggggttttgagagagccacaatgagacacccacaaaggttttgagggcacattaagaccccccagagagcagggtacacctttgggggaacagggaggcccaatataaaagattcaggagttctca

SEQ ID NO: 655304 - DNA, 1230 bp, Homo sapiens
gaagagacagcgccgcggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaa

SEQ ID NO: 655305 - DNA, 807 bp, Homo sapiens
  misc_feature (145)..(145): n is a, c, g, or t
  misc_feature (317)..(317): n is a, c, g, or t
  misc_feature (344)..(344): n is a, c, g, or t
  misc_feature (408)..(408): n is a, c, g, or t
  misc_feature (452)..(452): n is a, c, g, or t
  misc_feature (467)..(467): n is a, c, g, or t
  misc_feature (490)..(490): n is a, c, g, or t
  misc_feature (512)..(512): n is a, c, g, or t
  misc_feature (534)..(534): n is a, c, g, or t
  misc_feature (538)..(538): n is a, c, g, or t
  misc_feature (551)..(551): n is a, c, g, or t
  misc_feature (555)..(555): n is a, c, g, or t
  misc_feature (565)..(565): n is a, c, g, or t
  misc_feature (585)..(585): n is a, c, g, or t
  misc_feature (638)..(638): n is a, c, g, or t
  misc_feature (681)..(681): n is a, c, g, or t
  misc_feature (693)..(693): n is a, c, g, or t
  misc_feature (695)..(695): n is a, c, g, or t
  misc_feature (702)..(702): n is a, c, g, or t
  misc_feature (704)..(704): n is a, c, g, or t
  misc_feature (709)..(709): n is a, c, g, or t
  misc_feature (714)..(715): n is a, c, g, or t
  misc_feature (722)..(723): n is a, c, g, or t
  misc_feature (729)..(729): n is a, c, g, or t
  misc_feature (731)..(731): n is a, c, g, or t
  misc_feature (737)..(737): n is a, c, g, or t
  misc_feature (792)..(792): n is a, c, g, or t
agcggggtgtggcggggaggcgaggcggtcgttcgagcgcgctagtcagctccctgaagggagtgacggcggttgggtgcccgcggccacttttgccttcccgggagatgtccttgcttctcagatgtaaatgcactttaagttngttattcaacagtgaaaatgagtcatacagaggttaaattaaaaatacctttgtgaaataaattactagatgctgttgttggtacctaacaagagcttaacatatggaataattcttacacatggagcatcaggagatatgaatcttcctcattgtgatgtcactggcatcncatcttgcatctcatgggtttttctgncctgagatttacctgtaaaggccttaatattgtaccatagaattaaggcgtataaatcagtttngaattacctgaagacatcaggagaatacaaacttgcaggtgttntctgtggaggtcgtnccaatgggctcaagagcagctgnttctgtaatgtgtcacattgangccagatgatggtgaatgattncgtncggggtctcattngtantttcttaccnaatgaaccatccaaagcagnagaataaactcagagatgaagacctctttcgtttaaaagagcctgtactgttngtgtcaaggctcagcagatgaaatgtgtgacaagaacttgttnggagaaagtggnanagaaaangnaagtncccannaaaatcnntggatngngaaggnaatcattccatggcagtgaaacgacggtcgacaatgatgtttcaaagaaataatnccagattttgtttgg

SEQ ID NO: 655306 - DNA, 120 bp, Homo sapiens
tttataaaaagtattaataaaccaagatgtgcctaaatattagggtacttcatgctaaaggtcatagaaaatatatgcgtcgcccgagagttttggaagcaacgcacccgatgctttgct

SEQ ID NO: 655307 - DNA, 2686 bp, Homo sapiens
gaagagacagcgccgcggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggttagttggtctttgtgtgacagtgggaagaagtggagagaacactctgtctccccgacttccttcttgaccctccttccgtatctttcattcttccccactggcctttccagatgaggtccaaaagtaagctcactcttcagggaaaagtgatactaaacccaggcgtgaggagtcatccttctgctcttacttttccctgcatttccttaggctggcccagactctagattcctgggcacttacctgtatctgagacccttagacctcctgtctcagtttctccacctgtgagatgggcagtcacacagatgagtgtgcatgagggaatcagaagcccatctgggttgactcagaacccgggctctccccctgctgtgggtggaaacaaaacaccttttcacagaagctgttgtccctcccccatccctgataccatcacccagaagctgggtggggaatgggaagctggaggagggggttagagttagaccaatgcgaggagctagtaagagctcgcctctccgtgacttccccccatgcaagggtggcccaaggcttcccctgatatccaaagcaggacagcagccccttggtgggattctaactgctgctactctgtttctttcctcactttgctttccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaa

SEQ ID NO: 655308 - DNA, 734 bp, Homo sapiens
  misc_feature (244)..(244): n is a, c, g, or t
  misc_feature (271)..(271): n is a, c, g, or t
  misc_feature (335)..(335): n is a, c, g, or t
  misc_feature (379)..(379): n is a, c, g, or t
  misc_feature (394)..(394): n is a, c, g, or t
  misc_feature (417)..(417): n is a, c, g, or t
  misc_feature (439)..(439): n is a, c, g, or t
  misc_feature (461)..(461): n is a, c, g, or t
  misc_feature (465)..(465): n is a, c, g, or t
  misc_feature (478)..(478): n is a, c, g, or t
  misc_feature (482)..(482): n is a, c, g, or t
  misc_feature (492)..(492): n is a, c, g, or t
  misc_feature (512)..(512): n is a, c, g, or t
  misc_feature (565)..(565): n is a, c, g, or t
  misc_feature (608)..(608): n is a, c, g, or t
  misc_feature (620)..(620): n is a, c, g, or t
  misc_feature (622)..(622): n is a, c, g, or t
  misc_feature (629)..(629): n is a, c, g, or t
  misc_feature (631)..(631): n is a, c, g, or t
  misc_feature (636)..(636): n is a, c, g, or t
  misc_feature (641)..(642): n is a, c, g, or t
  misc_feature (649)..(650): n is a, c, g, or t
  misc_feature (656)..(656): n is a, c, g, or t
  misc_feature (658)..(658): n is a, c, g, or t
  misc_feature (664)..(664): n is a, c, g, or t
  misc_feature (719)..(719): n is a, c, g, or t
agcggggtgtggcggggaggcgaggcggtcgttcgagcgcgctagtcagctccctgaagggagtgacggcggttgggtgcccgcggccacttttgccttcccgggttaaattaaaaatacctttgtgaaataaattactagatgctgttgttggtacctaacaagagcttaacatatggaataattcttacacatggagcatcaggagatatgaatcttcctcattgtgatgtcactggcatcncatcttgcatctcatgggtttttctgncctgagatttacctgtaaaggccttaatattgtaccatagaattaaggcgtataaatcagtttngaattacctgaagacatcaggagaatacaaacttgcaggtgttntctgtggaggtcgtnccaatgggctcaagagcagctgnttctgtaatgtgtcacattgangccagatgatggtgaatgattncgtncggggtctcattngtantttcttaccnaatgaaccatccaaagcagnagaataaactcagagatgaagacctctttcgtttaaaagagcctgtactgttngtgtcaaggctcagcagatgaaatgtgtgacaagaacttgttnggagaaagtggnanagaaaangnaagtncccannaaaatcnntggatngngaaggnaatcattccatggcagtgaaacgacggtcgacaatgatgtttcaaagaaataatnccagattttgtttgg

SEQ ID NO: 655309 - DNA, 130 bp, Homo sapiens
ccagctccaggggctcagcaggcaaagggaatcactgagtggggcaccacccgtggactccattatctcaacctctccctccacaggttggaggtggtaggaacaacccccaccaaacccagagccgaaa

SEQ ID NO: 655310 - DNA, 247 bp, Homo sapiens
ttgacagataggaaatcaatgcctatcaccttctcccctctgaagcacagcttcataggttctaggaccaccctgatccagcaaagaaccagaaacaggtgacagttaaggcaagtaccgtctggtgaaagaccattacgtatcaagtgttatacaggaatcccttctcactgcatggttagcccatcctgactggcctgtgtcatgctggtttcgaaatattaggaatatcacctccattgacaat

SEQ ID NO: 655311 - DNA, 2632 bp, Homo sapiens
gaagagacagcgccgcggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggttagttggtctttgtgtgacagtgggaagaagtggagagaacactctgtctccccgacttccttcttgaccctccttccgtatctttcattcttccccactggcctttccagatgaggtccaaaagtaagctcactcttcagggaaaagtgatactaaacccaggcgtgaggagtcatccttctgctcttacttttccctgcatttccttaggctggcccagactctagattcctgggcacttacctgtatctgagacccttagacctcctgtctcagtttctccacctgtgagatgggcagtcacacagatgagtgtgcatgagggaatcagaagcccatctgggttgactcagaacccgggctctccccctgctgtgggtggaaaccagaagctgggtggggaatgggaagctggaggagggggttagagttagaccaatgcgaggagctagtaagagctcgcctctccgtgacttccccccatgcaagggtggcccaaggcttcccctgatatccaaagcaggacagcagccccttggtgggattctaactgctgctactctgtttctttcctcactttgctttccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaa

SEQ ID NO: 655312 - DNA, 2632 bp, Homo sapiens
gaagagacagcgccgcggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggttagttggtctttgtgtgacagtgggaagaagtggagagaacactctgtctccccgacttccttcttgaccctccttccgtatctttcattcttccccactggcctttccagatgaggtccaaaagtaagctcactcttcagggaaaagtgatactaaacccaggcgtgaggagtcatccttctgctcttacttttccctgcatttccttaggctggcccagactctagattcctgggcacttacctgtatctgagacccttagacctcctgtctcagtttctccacctgtgagatgggcagtcacacagatgagtgtgcatgagggaatcagaagcccatctgggttgactcagaacccgggctctccccctgctgtgggtggaaacaaaacaccttttcacagaagctgttgtccctcccccatccctgataccatcacccagaagctgggtggggaatgggaagctggaggagggggttagagttagaccaatgcgaggagctagtaagagctcgcctctccgtgacttccccccatgcaagggtggcccaaggcttcccctgatatccaaagcaggacagcagccccttggtgggattctaactgctgctactctgtttctttcctcactttgctttccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaa

SEQ ID NO: 655313 - DNA, 473 bp, Homo sapiens
gagaggccgatttgccctgagcagttcccagcttgaaggggcccaagatattttcctttcacaccatcctcagaggaaaccagaaggactattacagggttaaaatcagctgtttatgcttcctataattcttgaacatccacaagtatgagatggctgcagagtcaccagaggtacgtgagccctttagtctgataaacatgccaagagtaccataagaattcacaggtaggatgttttttcagttaatgataataaaaaataagagaacaggtttgcactttgaagaatgtggatttgcaaaggtaagggggaaaacatttagataaatgacaataagcactgaggcaaagaaatattggttatgtttgaggaaggctaagtattaaaaaaaaggtaggtgaagaggagtagtaagaatttcattctttaaaatgcaacagatgtttatgctgctttggttgtatttttag

SEQ ID NO: 655314 - DNA, 370 bp, Homo sapiens
  misc_feature (366)..(366): n is a, c, g, or t
aagaattaatgtcagagatccatatgcttcctacaggtatttattatataattatgagaataatatatttttactgtagaaaatataaatacacgtaagatgaaaagaagaacaaaaaattacctttaatcacaccatcctttccaagccactgttaatgttttagtctagtcccttctagacatattattgggcatcaaaaaataaacttaagccgggtgtgataggttcacgcctggtaatcccaggcattttggggagggcagagggtggagggattgcttggaattcaggaaggtttgaggacccagcctggaggcaaccaaaaggtaatacttccatctttataccaaaattttaaaattngccc

SEQ ID NO: 655315 - DNA, 659 bp, Homo sapiens
gttgccaatgtgtcatgcagactgaggtggagccggaaacttagggcgccacggtgcagtccacggaccatggtccgccactaggacatagcaccagtgaaagctccccgagacgcgccgtcgcgataagtgctgggtgtgtctgcaatcagtgacccgctatcagccttcgacgaatatccacccagtgctgcctttgggagaagattgggaatgccagcattgatcgcagctttagagagcgaaggcatcagcttctgtcgccatgtgtcaaccttgtcaagagttgtttgactttgcgtcatctcgaactgagacggttcaagatgctcgctaatgaacgaagactgagtggcctgcttcccaatcaattttgatagtgggtggctgaatcgtatcgtactatgataagttctgttgcaaaggggtacataagctcccagatacgcaatggccgtggtcaatcagatcgtaagtgccccatgaattccttcagctcgaagtagcctgtatggtagaaagtattccaagagtgttgaggggaggcctgtgtccgtggtgagcttgacaggcccagcagtgggaaggggaggttttcagtgtaaaagtagctaagctaacctttttaattagatataccctggaaccccacaactttt

SEQ ID NO: 655316 - DNA, 1884 bp, Homo sapiens
gttgatgctgaagtcgattctataggatcctcaccagtggtcacccctgctgtgggtggaaacaaaacaccttttcacagaagctgttgtccctcccccatccctgataccatcacccagaagctgggtggggaatgggaagctggaggagggggttagagttagaccaatgcgaggagctagtaagagctcgcctctccgtgacttccccccatgcaagggtggcccaaggcttcccctgatatccaaagcaggacagcagccccttggtgggattctaactgctgctactctgtttctttcctcactttgctttccaaggtggtatgtgatccccagctcaggcctgtgcagacaggaaattctcccctgcagcaagtaggggaggtgggttgtgggatgtgacctccttccagatatcaggcagtgagtgtaaacctgccacctccagccctgatccattctcacctagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaa

SEQ ID NO: 655317 - DNA, 301 bp, Homo sapiens
cctataatcccagacactgggaggctgagacaggagaatgcttgaactggggaggtggaggtggcagtaagctgagattgcaccactgcactccagcctcgtgacagagagagactccatctcaaaaaaaaaaaaaaaaaaaaacccgattttttgggtgcttgcctgcatccgcagttccccgggaggctgaggcaggaaaattcactgaaccccgggaggcagagttttgcagtgacccaaaatgtcgccatcgcacctccagccttgggttgacagagcaagattttgtctcaaaaaa

SEQ ID NO: 655318 - DNA, 1888 bp, Homo sapiens
gaagagacagcgccgcggccgtggggagcggacgcagtgatttgctccccctcgtgcagcaacccccacacccagcaccaggcccccagaactctccttccagctgaactccctgggaacaagtcagttgggctgatcactgaactcacatttctggacctgaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaa

SEQ ID NO: 655319 - DNA, 1766 bp, Homo sapiens
gaagagacagcgccgcggccgtggggagcggacgcagtgatttgctccccctcgtgcagcaacccccacacccagcaccaggcccccagaactctccttccagctgaactccctgggaacaagtcagttgggctgatcactgaactcacatttctggacctgagatctttcccattttccctccctttcccttaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaagcggctacaggaagctgtgtctgttcgatttggtgggaggagatgtgcagggagctgtatcttgtcctccgcttgtgaaaaactcaaggatgtggagaagagtagaccgtggaaccctgctcttctgcagccaagctgaggggcaggatgcgtgtgggacagtggtagagaagcaggggatagactcataggctgcaacaaaggtgactctgtccctggacactgcctccgtactttctccttgcttcactggccacagcatctccctccagccctcgctatgtgcctctgccatcttcacccatcatggagcagaggtgaggagaggcagcctgggaatatggagaccagtgaaggaccaggcctggagagcacagggtcctacctgggcatccagcagaggagcccctaaaggccaggagcaccccaagaggagggagggcagccagcctccattgacggcgagcctccagccctctcctactttgatcaccatttctctccaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaa

SEQ ID NO: 655320 - DNA, 1502 bp, Homo sapiens
  misc_feature (1012)..(1012): n is a, c, g, or t
cggtgtgtgttgggggggggcccctccctcttgggggtggtgtagttgttgtgttttagtgtgcgggcggcgcgtcgtcgatacatgtgggtttgtggtgctgtgtggtgcgtccgctccgcctctgttgctggggtgggggcggttctctcgctgccgcggtgcgtgtggtggtgcgctcgctacattggtgggggggtcctcctctctgtcgtgggtggggctgctcgtcttgtttttgggttgtgggggcgcccccccctggtgttgatggtgggtgagcgtgggggggctgtcgttgttttggtgggccgctgcgtcttcgtcggtcgtcgtcacgtcactgcgcggcgtagtgtgggcgtccgcgtgtgtgggggtcgcggtgctctttcgcgccgcctcggctcgggtgggggaggagttggttttgcctcgccccccgcgcgcggacgacatctgctgtgggggtgtgtctcgtctctgtctctgaggatggcgcccctccctctgcggtgagagagagagggccgcccctctctctctcgcgcgtgtgttcttctctccccacggcagctgggtggtgtgtagagtagaggaggagtgtgtaatcatagtgcttctcgctctctgtcgtctctcgggcgccgcgcttctctctccttctctctctctctccggcgtgggtcgcgcactcgcctctcgctcgcgcgactactactagagcgcgccgacgcttctgtgtgtgtgtgtgtgttgtgtgtctcgcgcgcacactactctgttgtgtgtctcacacagcagagagagtgtgtattgtgtgtgtgcccgctctctctctctccacacgctctctctctctggcgccgacagagagagagagggggggcgaccacagaatgtctctctccgcgcccgctcgtgtgagagtgtgtctcaccacaccgtctctctcccccgctctgctgtgtggtgtgttgtgatgtgtgtgtctctgctgtgtgtgtgttgntgtgtgcgtctcttctgtgtgtgcgcaccgctgcgcggctgtgggggcgcggcgaccacactctccgcgactcctctgctctctgcggcgcgcgctgctctatatagatagagagtagtatatgtgtcgtctctcatcagctggtcgtaccacacgccctccagcacactctctcggcgagagaacaacacacacgcgcgtgtgtgtgtcttgtttttgagagcgcgcggtgtgacacacacaccagagtgttgagaggtgttgcggggggggaggggggtgtgggagccgtgggagccccctcttgttggtgtgttttttttcccccctcttggtgagacgaacacgctctcggtcgcggcgcgccccccccccggttgcgcccgcttttttttttttttacgcgtgctataaccacccttttttctccccccgcggttttccccacacacactctttgtaaaagagaaaaaaaagttgccccccttta

SEQ ID NO: 655321 - DNA, 1300 bp, Homo sapiens
gaagagacagcgccgcggccgtggggagcggacgcagtgatttgctccccctcgtgcagcaacccccacacccagcaccaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggctttctgcctccgagatgtggcaccatagtgcggtgccctgtggcttcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaagcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtggcctaaaagcctccatgtcatttgacctacgaattctatctttgggaatttatcctaagaaaatacttaaggatttagttagtgataagatgttcatcccagcattgcaatggagaaaaatgggaagcaatggtttggttgggaatttattccttttctgctgtaacgaaagtttgcaataggggattgcttaagtaaattattgtatctccatccagatggtggagtaccgcgcagacattaaaagtcatgtaaaagaacatctgactgaaagaaaaatgctccttgaatattaaaaggttgtaaaaatagtgcatgttatgtgatttcaattttgttttttaaaatatgggtgtatgcttgtatacgtagagcagataaaaaagacggaaggcatactaaaaaatgttgagtggttatctttgtatggtggaacaaagtcactgtaattttcatctttggtttttctgtaatttccaaattttccacattttgtatttcatataataaatataatttaagaaaaaaaaaaaaa

SEQ ID NO: 655322 - DNA, 736 bp, Homo sapiens
tattaagtaaaatctttttatttcaaaaaaaaaaacccccaaaaaaacaaaattttcccaccccccccccgggaggaattatggggatagggggaggtgtctcttgcaccactctccaccccttgccccccaccccatgtttggtgtttttggccacacataaggggtatttggggataagtgccccaaaaaaataaaagtggttgtgatgactgttgtctattgggaagaacacagagtgttcacaaagcgtggtagggaagccgcgagttaacaacggagagaaggggagaaccaacacacagaggtgttcaagaatccgtggagaaaccgcccagaaggtgtgtggaagggcccatattctcaattaaccatcttttcttgtgttgagatctcaaaaaccccccgcggtggaaaccactctattctttgcgccccctaataacgagagacgagagatcacataaacagcgtctatgtatgtgacaaaagatatgtatgaggataaacaaaaagatgacacctatgagacaacgggtgttgggggtggccccccaaacccgaggtgggaccctcttgtgggtcgtaacagcaaagagctctcccgtgtggtccataatatattccccccaaaatcctgtggagaaaaacgtaagtaaggagtctccccaggaaatacaccacgaaaaaaattttatagtgagccccccccaagagttttttttaagcccacatt

SEQ ID NO: 655323 - DNA, 152 bp, Homo sapiens
gattttgatggtgatagaactatatccagactgatggaaggatgaaatgacattagcttatggctggagtcagtagaccggtaaagattcagagggcgtgctgcacattacccaaaggtggagagttcaggcagaggaagggtaaggggatg

SEQ ID NO: 655324 - DNA, 247 bp, Homo sapiens
ctacacattctttaccttccattaaaggcactatcatccatacgtaagatatacaataattacctaggtttatatttttttaaaaagcattccattaaagtattatacaaaaatgaaaacaccatctttttaattttggcaactagggagaagaaaaaaaaacacaccaactttgtacaccaatgatttctctcaaaccgtcgtcttcagtttccctgagccagaccgaaagcggaggatcttcttc

SEQ ID NO: 655325 - DNA, 365 bp, Homo sapiens
  misc_feature (123)..(123): n is a, c, g, or t
  misc_feature (129)..(129): n is a, c, g, or t
  misc_feature (138)..(138): n is a, c, g, or t
  misc_feature (162)..(162): n is a, c, g, or t
  misc_feature (171)..(171): n is a, c, g, or t
  misc_feature (233)..(233): n is a, c, g, or t
  misc_feature (261)..(261): n is a, c, g, or t
  misc_feature (323)..(323): n is a, c, g, or t
  misc_feature (360)..(360): n is a, c, g, or t
aagaagacactctgggatgtgtcccatatgtctcaggaactgccactgggataattgattaatctgaggtggtcattaattgtttgatgtctgttgtagaggaggatagggtggtcccagggntaatcntgatatganggatagccatgtggtgaatgacangtatctctnattcctctcatgtccctgccaaggtccccggacattcaaagtgagcttggcaatatatctanagcaaagaaaagcagagacatgtggctntttccccaaatggggcgctttcattgtcccattcgtgtcccctttgtttactgggctctcanaagaaaccatgacgaaccatatttgtctctatttccntctcc

SEQ ID NO: 655326 - DNA, 222 bp, Homo sapiens
tggtgatctagaggatcccatgcgcgacgcttcatcaacttagccaaagcgccttgtcttccgagttcagctgtgtgaaggcgacagtggtgcaggtcttcctgtggactagacgtcccagtcttgcctttcccttgataatgcagtaagggacccccattttacgacacagggcaggcaagaagacaaccagcttgatggcagcgtcgcgcatgggtaccg

SEQ ID NO: 655327 - DNA, 154 bp, Homo sapiens
ctatcagctgacgcaatgcatacattaattcggtctcttcttttcttttctattaatctgtgcggtaatttgtaggtatccttaatacatgagagtcatggaagagagaaaacaataaactaaacattcattcactggatttaacaataccctg

SEQ ID NO: 655328 - DNA, 326 bp, Homo sapiens
cttgcacttcctgtacccaatcattgcctgatcacttagctgtgtgtcatcatagtcaggcttaaaaataataaactcagaatttgaaaagaaaaactggtaaaaagaagaaatagaaactgagtagagacatcgatattgccacacatcacatgggagacagattttgtagatttagtcagggcaaattactaaagaaataacacacgtgaaaaattacagtttatagttgctacaattatattatctaaaacatctagttttttaagattatgattatgtctgtaatttattatggttatgtctgtcagcgaaggttgctaggt

SEQ ID NO: 655329 - DNA, 615 bp, Homo sapiens
gggcgggcggtgccactgacctccctcgtgcggcccggcccgggcagcgcccgagcccaggcagccccgacgacgtgagggtatatacatgggccatgaggaacattgggcagcgggaggatcggagccgtaacgagggcatgcccgtctgatgagtgaagtagcgacgcgccgtataccgcggacgcaattttgtcacagtgagtgtaccgtagaggctagtcgtggtaagtcacatcgtgagtagtcgtatggcgcataacacgtacacgatggacttcacgcagcagatatctcggagttacagaatgaagggtccgtcttggactgtcagcattggacatgccactaaactctggacgcaaccagcatgcagcagcgcacagaaagaaccatcctagtaccgttcaaggcgggacgcatgccaaggcacgactcaagggggctgcaaatccagagagtcagtgcgtgttgccaggcaagaaagtggcgagcgaggagtttagacgaattatgagcctgaacagtcaagagaagttcgggaacaagaccgggagacaggggacatctcttagaaggcgaggtgaggttaagaggaaagagatgtgagagagg

SEQ ID NO: 655330 - DNA, 145 bp, Homo sapiens
cccttggtgccctcttggaggcctggctcatgaagcagtaggtgtctgtgtaggactgggctagaaaataactctctcctagtttgtctggggagggggtaaggccaggatgccaatttagtcactccaggttaagttgtaggac

SEQ ID NO: 655331 - DNA, 1186 bp, Homo sapiens
ctatagagagggacccctttttggtgtgccactctctggggatgaagcgcctttttaccccagactgggggatattggaacacattctccaacgagggtgaatcgtcaaattattctcctcatgggttctaaatattccgcggggaattttatatttatgggcgcccaattgtgtgagagaaactccgcggcacccacgaatgtttactcccctacgaatgatataatgggatgccctttataacacaacacttcgggcgaagataaacttgtgtgagcgcccccattgtgggaacctctttgaagttccctctgggggaagaaaacttttgtagaccccacacgcgccggtttttctttgactgcggccccggttaactcgtagctcggtgtttggcgaaaaattttgccgctgtcacggcttaaggaccccactttcccacgtttgattgggcgacacaaatagccgtgtctttttcaacaccgggataattcaggtcacacacatgggccacctttctgttgaaaacagggtttttataaaaaaatgggttaagattataatataataaaattggaaacgtatctcttgagaattggcagaaaattaaattgcagaatattgccacacactaatggtgttaactggggttcaaaaatagcgttgttcctttgcttgtttttatttcacacggcacacgcacaaggcacaaagtggcgcttcaaaaagtgcctttggcgtatataatatatttctgaatataagaaatctcctaaagaagcaccccttgggttaaaaagaatcgcacactcacgaaggttctggaaagtatttctgaaagcactccactttacccgtccacgcttgacacacaaggtttgagttctcctcgcttgtaataaggtgaacttgggtggcccaatgggtgaacacattaaaagggaacaatgctgtcccacgggcctgggcggacagactcaatgggcaggatagtgtgctgggtctcagaccccatagtgcctcgcttgctgggccaattagtataagggccaaaccttcctttgcggcgaacctggctgctaggcccattttttaggaaccagctgcgactcattaagacccagaagcataaataaactttccaaaatttatttggcttttttgtttaaaactgggccaaattta

SEQ ID NO: 655332 - DNA, 416 bp, Homo sapiens
  misc_feature (215)..(215): n is a, c, g, or t
  misc_feature (239)..(239): n is a, c, g, or t
  misc_feature (247)..(247): n is a, c, g, or t
  misc_feature (286)..(286): n is a, c, g, or t
  misc_feature (313)..(313): n is a, c, g, or t
  misc_feature (326)..(326): n is a, c, g, or t
gcgtcgacggcatgtccggggtcaccgtttttaagtcccgaaaaaaaaaaaaatcacttttttgtgaaaatggttaaaaattattttcggggtcctttccagaatggcgcaaattcggcatgtccggggtcacagtttttaagtcccaaaaaaaaaaaaaaaaaaaaaacttttttttgaaaatggttaaaaattattttcggggtcctttccanaatggcgcaaattcggcatgtccngggtcacngtttttaagtcccgaaaaaaaaaaaaaatcacttttttntgaaaatggttaaaaattattttcggngtcctttccagantggcgcaaattcggcatgtccggggtcaccgtttttaagtcccgaaaaaaaaaaataatgcccaccacagcacaaagacctcgtcgacgc

SEQ ID NO: 655333 - DNA, 255 bp, Homo sapiens
gacttgggctgtagctcacaaatctgtgcatgtatttggtatatttaaatcctgctacatgcatattctaaccaactagtaagtaaatcatacactgacaagtgtgcccattagaatcatacttaattattggccaactggcattccccaattaaactgtgtcgatataataattgtgcctcaggccacctgtgcgcactgtgtcacacctgttatccccggaatttgggaaggctaaggcgggggatcacgagg

SEQ ID NO: 655334 - DNA, 452 bp, Homo sapiens
tccggcgtcaaaaatgtaaaacaagaacgtggtgggtcctctggtccaaaattccgaatttccttgggtcttccgttagaagctgtaaccaattgtgctgacaacacaggagccaaaaacctgaaaatcatctccgtaaaggggatcaagggacggttgaacaaacttcccgctgctggtgtgggtaacatggtaatggccacagtcaaaaaaggcaaaccaaagctcaaaaaaaaggtacatccaacagtggtcatttgacaacgaaagtcaaaccgtaaaaaaaatggcgtgtttctttattttaaaaataatgcagaagtcaaagtgaacaataaaggcaaaatgaaaggttttgccattacaggaccagtagcaaagaagtgtgcaaacttgtggccccggattgcatccaatgctggaagcattgcataattctccagtaaatttgt

SEQ ID NO: 655335 - DNA, 1012 bp, Homo sapiens
  misc_feature (878)..(878): n is a, c, g, or t
  misc_feature (881)..(881): n is a, c, g, or t
  misc_feature (895)..(895): n is a, c, g, or t
aagtctttaagtggacagtacgcatgcgccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgatattttctaagctggtggtaataacagtactgtctcattgaaaaaaaaaaaagggggcggnaanaatcccgaggggcnattcggccccgtttggaaagaggccaagggggtaaacagagggggggtaaaggaggaaaggggatggaagctcggggatggacagaggcggaaagggtgggaatgggtctaaaaaaa

SEQ ID NO: 655336 - DNA, 888 bp, Homo sapiens
tttccaacatatacgaagtatcagtcgcggtaccgacatatgccggaatcggccatacgccgggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 655337 - DNA, 657 bp, Homo sapiens
  misc_feature (517)..(517): n is a, c, g, or t
  misc_feature (528)..(528): n is a, c, g, or t
  misc_feature (533)..(533): n is a, c, g, or t
  misc_feature (543)..(543): n is a, c, g, or t
  misc_feature (578)..(578): n is a, c, g, or t
  misc_feature (590)..(590): n is a, c, g, or t
  misc_feature (606)..(606): n is a, c, g, or t
  misc_feature (608)..(608): n is a, c, g, or t
  misc_feature (622)..(622): n is a, c, g, or t
  misc_feature (633)..(633): n is a, c, g, or t
  misc_feature (648)..(648): n is a, c, g, or t
agcgggcggtcgtccgtcgccccgccctgcgcgctcgggctggctcggctgctgcggcaggcgggcaggtgggctggccggtccgctgggtgcgcggagaggctggtgccctctgtgatagtgtgggctggggtgcggttgtggcagagcggtggcttgaggccaggggctgtgcaggctgactgctcgaggcctgtggcgcgagagaggaacagtgtcgtggccacgacacatgcgacctttagacagctgaccagaatgactgagcggtacgcgtactgccgcgtgcgatcgtatacattacaaccaacggaacagtgttagcaaggtctcagcaggaaggactgaaaatgcagggtcacggactggaggaacatgacgtgcacgtcttgagagtgacgccagcgtgttgaggaaaaaccgtatcaatggaccgacggagctagagaaacagtgtcatctcatacggaagcgatgagatacaaatgacacagaatactctgaagcgtgcaaaggntcagtgaaagnggtgncagtgattgnacgaagaaacgcaagacacaccgatgatagacacncaggaagatggncgtacgacgtaacgantntgcgaccgtaggantcacgtggaangcaagacgtggcttngtgcaacct

SEQ ID NO: 655338 - DNA, 852 bp, Homo sapiens
aaacaataggctaggtacgaggcctggtgttaatcggccgagggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 655339 - DNA, 848 bp, Homo sapiens
  misc_feature (37)..(37): n is a, c, g, or t
gaacggctaggtacgaggctgggtgtgtaatcggccngggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 655340 - DNA, 532 bp, Homo sapiens
  misc_feature (485)..(485): n is a, c, g, or t
tatgcacagttcgaagaggtcaggaagattccgatagggcaaagtcgactaaaacagcatgtggaggcttgataattcaacccacgcctatccaacctcataccccatgtcctccccctctgcttcccgggtccacttcagcggtacttccaggctcacctcctcatggttcttatggaggcacatcagctcctccttcaggtactcaacctgggcctccaggtcagccttgcacagagtgagatcatccaggatcctgcgcaggccattgatgtcggcctccaccagctgccgcatggccagctctgcctcgtacctgcacaaggacagggtcagcaaccaagggtgaaacagaatgcagaactcagggaaggccttaaactgccggcactttccaaccctccgtgaaactaatggaaagttgccccagagcctatgaggacaggtcctccccagctccagccccccgagtgaactcacttggncctgaagtcatcggcagccagtttggcattatcaatgttcacaacca

SEQ ID NO: 655341 - DNA, 1236 bp, Homo sapiens
  misc_feature (37)..(37): n is a, c, g, or t
gaacggctaggtacgaggctgggtgtgtaatcggccngggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaacaaacaaaaaaaaaaaaaaaaaaaaaaaaaaaaaagggggggggccaaaaaattcccccggggggccccttttctcccctttttttttacaaggggcccctaaggggctatataaagcaaaggccggcgcggtttaaccccgtcggcgggaaaccggctcgccgggcgctcttggggagaccgcctcctcgggcgcgtctccctctttggcccctccccggggattacgcctggaaatttaacttcggttttgtgtgctacccggctgctcccggtgaaatttgtccggctttgagtcgcggcgcgatacagtcgagggcgcgtgggcgtccacgttaaggctacatccgccacctgtctctttcgccgccatcctctac

SEQ ID NO: 655342 - DNA, 1272 bp, Homo sapiens
ttctactgtcaacgtggacaatgcctatcctcgtagactcctcagactctacatggattcatgtctgctgatgcaggaaggcagtccggctctttgacacatccccaagccaaaaaggatggctaaatgctcctgggagatcaggcgcagcctcacaccagctgcctccatccactcagccattcccagtggtacccaaattgtgcccatgggatagccatcgagcactttgggctcatcgcatacagccgtatggcattagcagatttattcatcaacagacatattccagtatttaaccgtccaatcatatcgtaacattgacccgtatattgcagaaagcacatatattgtacgtaacacactacttggggtccatgatcagacccatcacacgagaacacgccccagtggcttatacatgcacagccacaaggaatcctatcattaaagggtccttaatcatcatagacgactactgaggcaggatgtgaacgcacttggcaggtggcgactcggctgggacccagggatgggataacgtgatctgcaaacatcttgcctgataccactgaatattcacgcagggcattaacccaccctttccaagaccaactcacggcacaagataccccggtgggcacatgggccccgagaagaacgccaacggggcatgaccattggatatcttgggcaagtacatgtcagtcctacggatggacccatttggcccctggagaccacacatccacttggtggacgcacagagataccgtccatggacatacgcttataccttcatgactaacaccccattgggaaacatatgggcccttcaatcctacttcatttcccttggggattccagacaattgccacctcccttacaatgggtcctacgttagaaccttaccacatagtccaaggaacagtacataccacacgggttggagcagctagaccacgctcgcgactggagccacagcgcaccgtacggcgccattgcgcattgctggtcacccagtgcagatcacgcgttacatggttgggcgccaagaccgaactcagccaccacacaacttgagcacggcgtggaccatcggcatacagatccggcaccggtggacaccaccctgagtacagcgacacaccgccagaacacgcacagacgcgccaggaccatcgaacacaacaccccccgacagtgacccgcggttgagccccacaactcaaccatgtcccacggcgacgacaaccatcacacctaccggc

SEQ ID NO: 655343 - DNA, 847 bp, Homo sapiens
aagtataggctaggtagcgaggctggggttgggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttcaatttgagagcaggtactatttattaaccaaccagcttag

SEQ ID NO: 655344 - DNA, 899 bp, Homo sapiens
  misc_feature (774)..(774): n is a, c, g, or t
  misc_feature (782)..(782): n is a, c, g, or t
  misc_feature (797)..(797): n is a, c, g, or t
  misc_feature (837)..(837): n is a, c, g, or t
  misc_feature (848)..(848): n is a, c, g, or t
  misc_feature (851)..(851): n is a, c, g, or t
  misc_feature (860)..(860): n is a, c, g, or t
  misc_feature (867)..(867): n is a, c, g, or t
gtatcaacgcagagtgcccattacggccggggcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgagtggatgagaaaagacccccatttgtagagggggatgctggcacgggggccgatcacaggtttgaagagnctagggtnccgatattcctacgnggaaaaagacgtcataaaaaaaaaaaattgggcgcccaanttaactggggnccngagagaagnagaggangggcaaacgggggacatggtgtacaaccgacg

SEQ ID NO: 655345 - DNA, 816 bp, Homo sapiens
aagtataggctaggtagcgaggctggggttgagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctc

SEQ ID NO: 655346 - DNA, 170 bp, Homo sapiens
tccgtaaccttcgttaaggtcttcacagccgcagttaaaaatagaaagttaaaaatccacataatcatcctcccgccgtctcctcgtccgcgttagtacaccccttacaggccgagaggaagtataaaccgggatcacaatcatggtattcatctccagcgttcccccgt

SEQ ID NO: 655347 - DNA, 222 bp, Homo sapiens
tatttatactattttcatattatttttattttttttattagaaacaattagtaggttttcccgctgttccttcatagaacaatgactgatgttgcagattgcttgaaagttttcatgactggagcactcaacaaatggtacaagtacaatcatgatttgccagcacggataattgtgtaccgtgctggtgtaggggatggtcagctgaaaacacttattgaa

SEQ ID NO: 655348 - DNA, 917 bp, Homo sapiens
  misc_feature (915)..(915): n is a, c, g, or t
actgatccgaggatccctcctacgagcgaattccgccagaaacccttaagaaaaagcgaaggaatttcgcagagctagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattgaaaaaaggaaaaaaagtcgacgcggccgcgaatttagtagtagtagtnga

SEQ ID NO: 655349 - DNA, 880 bp, Homo sapiens
aagtataggctaggtagcgaggctggggttgagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagcgtggttatggcaaaatcaataagaagcgaattgctttgacagataacgctttgattgctcgatctcttggtaaatacggcatcatctgcatggaggatttgattcatgagatctatactgttggaaaacgcttcaaagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaatggcacaacaaagggggccgctaaagacccaaggccaattaaggccaagtatgaaagggcct

SEQ ID NO: 655350 - DNA, 472 bp, Homo sapiens
  misc_feature (353)..(353): n is a, c, g, or t
  misc_feature (419)..(419): n is a, c, g, or t
  misc_feature (435)..(435): n is a, c, g, or t
  misc_feature (466)..(466): n is a, c, g, or t
gtctcaaaaaaaaaaaaaaaaaaaaagctgctgaaatcaggcagcgcttttcagattcccggcccaggtgatttcgtaactcctgggcaccctggctactgcccttcctaggccctgccattaccctcttcctccatttagcacttggcccatgtctcttacatctccttacccagtttttacagggccgtgttagagccttcacccatggaacagtacaagacatgatgctactccgagaataccgacagctccagggaacagcagtccctactacccagccttttccccccaaccattcgcccctatttcaggcaaggaaggcaggccagagggacaacgggcggcccctnttgttatttaccttatttaaaagggttgggaatgtttaggggaacaagtttggcaccaggaacccnttccccaccccattgncaggtgttcccttaaccttggattattttgnagtttt

SEQ ID NO: 655351 - DNA, 257 bp, Homo sapiens
agacatgaaagctcaatcgataagatcttctggaaaaaggagatctgagttattcacagatgtagtggaaaaggaagtgatgtcttcaaatcagagtatctcttcacccgtgcttgatgctgctcccagcatcaccagtcgtagtagaaagaagtaagtctgcatcttcttcagaaatgaaagatggtttacccagtaactcaatcaaggtgtaagcaggtctgtgtctcctccagcaatttgtgatatgactggta

SEQ ID NO: 655352 - DNA, 631 bp, Homo sapiens
tagaggaattcgccactaggggaagagtgcacgagagacgagataacgcttgcaactgcaatagtggatagtgtgatatagagaacactgctaactatagcccgtggcaaagctcgagttctggcgaaacatttcagaggccacgacactgaagatggcgacacgttcattctgaatgaatcatcttgaacataaactttttaagattaagatctatcatatacctatttcagaaacggttgtagaacactcactcacttcatatagagtgttcaaagagagaccgtctacaattgatgccacaattggtcgaatcatgagatgagagagacgcttctgcacaatctccttgtatgacaagtggcaatcgagatggattcccactttaggctgcgaggtttagaaagagatcttatcgttgaatgaccgggactactttggatgagataaagaaagtcgtaacaggaccactgtatttgatcgaacggtggccttgcaggatttgctgtcgcattttggaaccaattggttaaccaacctggtgactcaacattattgtgcgccctttgtactaccgctgatccaatggggtgtcactaatgggaatgacagtgggacttttctttatagg

SEQ ID NO: 655353 - DNA, 322 bp, Homo sapiens
atattggtaaagttcaagtttatatatttacaaataagggcaacaaaatgtgcctgactttgtttctgttgggaattctgggaatatcgcctttggcattatggcacctgaaatcatgtcacccaacaggagatgcagtttgtgtgaacaaagggtaaagcttgaaataagataggataagacaggataaagaaccaggagagctttttaaataggagaagctatttgaaagcagaaaggagaacaggttcagaggataccaaaaccggagttatcacagaatgtctgtctgcacactcattcctgctgcctgacttggact

SEQ ID NO: 655354 - DNA, 1093 bp, Homo sapiens
tatgtgttgtcgtgcaggtagaggcttactaaaagtgtgaaaacgtaggcttggattaaggcgacagcgcattctctaggatagctcagtagcaattagcaattgtgacagatgataagctgtagagggcaagcgttaatgcgtctgcatatctgctagggctggccgcttcccaattaggctcgcatgacctccgctgcccgtgcactacctgcttccgcggctccaggcgctcacgccgcccgcgccttcctcgcgcgctcgacactcgcccctcgcgcctgcacctgcgttcccgccccccctcccgtcacctcctcgcgcggactcccgcggcgctcgccccgctgctgccttcgcgcggctacccaccgctgcggcctcgcgcgccctctccctccgtcgcttcccccgccgacccccgccctccctccctcccttgccgccccgcccccctccgcgcgcgcctgcgccaccgcccctccgctcccgcccccggcgctcgcggcccgcgctcgcgcccctccctcgcgccgcacgggtgctctggctccgcccgcgcccgctgtcgctctccccgcccgcgccgggccgtcctcgcctaggcgcccccctccccccccacttctcctgcggcccctgctcctccccctcgcccctgcgcgctcggctccccggccccacgcgccccccctccctcggaccggccccgcgcccgctcccccctctctgcccccgcccgctcgctcggcctccctgcgccgctcgcgctctgcccggccggcgcgcttcgggccccccggcccgcacccgccttctgccccggtcggcgcgccccgtccgggcgctcctgctgctggcgtgccgcgcccgcgccgcgccgccttcggcggccgccctgtgcctgcgtcggccgcgcgccgcccgcgcccgcgcgtctgcgccgccccccgccccgctccacactcgcgcgcccgcccgcgcgcgcgctcctcgtcgcgatcgcgcgcctgcactctccgtcgctcgcgcctcgcgcgcgccgccccgcgctcgcgcgccacccgccctcccgctccgccgcgcccctcat

SEQ ID NO: 655355 - DNA, 443 bp, Homo sapiens
tttgaactctgctttaatccttgtctactgcatcttaaaatattccctctctcattatatacacggagatcacattgtgtataacatatctatataactattacagtacgttcttgataatacaaaattgtacaccttcatcaaataaattaggataaattaaaccaattaattatgacaagtcttcacacaacaaaatacaacaacgaaaattcacaattgaaattgcctctagcttacaaacacaatcaagtagtcatgaaattgactttatcattccagttcttgtactatattcaaatcaaagggtctttattacacaaaagagcttacataatgctcactttactatatattgctagatcatatagaggcagtgctttgtcgcggtttatactatatacatatgataaatggctgggacaatatcgagggaagccatg

SEQ ID NO: 655356 - DNA, 378 bp, Homo sapiens
atgccagagccagcgaagtctgctcccgccccgaaaaagggctccaagaaggcggtgactaaggcgcagaagaaagacggcaagagcgcagcgcaccgcaaggagagctattccatctatgtgtacaaggttctgaagcaggtccaccctgacaccggcatttcgtccaaggccatgggcatcatgaattcgtttgtgaacgacattttcgagcgcatcgcaggtgaggcttcccgccttgcgcattacaacaagcgctcgaccatcacctccagggagatccagacggccgtgcgcctgctgctgcctggggagttggccaagcacgccgtgtccgagggtactaaggccgtcaccaagtacaccagcgctaagtaa

SEQ ID NO: 655357 - DNA, 875 bp, Homo sapiens
  misc_feature (104)..(104): n is a, c, g, or t
  misc_feature (153)..(153): n is a, c, g, or t
  misc_feature (162)..(162): n is a, c, g, or t
  misc_feature (189)..(189): n is a, c, g, or t
  misc_feature (192)..(192): n is a, c, g, or t
  misc_feature (204)..(204): n is a, c, g, or t
  misc_feature (211)..(211): n is a, c, g, or t
  misc_feature (217)..(217): n is a, c, g, or t
  misc_feature (230)..(230): n is a, c, g, or t
  misc_feature (243)..(243): n is a, c, g, or t
  misc_feature (247)..(247): n is a, c, g, or t
  misc_feature (253)..(253): n is a, c, g, or t
tcttaagaaaatgatgtatcggcaagcagtgtaaacggaggacttggggaaaaaggaccacatagtccatcgaagaagagtccttggaacaagcaatggctatngaaaaggttatttgtaacatttgtctaactttttacttgtttaagcttngcctcagtnggcaaacttcattttatgtgccatttngtngctgttattcanatttctngtaatnagtgaggtgaacnattcagatttcantatnggattnggatattgaggtaaaatttcatttgtgtatatagtgctgacttttttgttgaaattaaacagatggtaacctaattgtgtggcctcctgacttttaaggaaaacgtgtgcagccattacacacagcctaaagctgtcaagagatgggacctcggcattggccttcattccttaaaattaaaaactacaaaagtgtggtgtaaatttgtatatgttatttaccttcagatctaaatggtaatctgaacccaaattgtgtataaagacttttcaggtgaaaagacttgattttttgaaaggatgtgtttatcaaaacacaatttctaatctcttctcttatgtatttggggcactagggcgcagttgtgtggcagttgagtaaatgctggttagctgttaagggtggcgtgtttgcagtgcaagagtgcttgggctggttcccggttttctccacgattggtcctgtgtaaagatgccttggtcgtgcagaaaccaatggtggtccagttattaaaatggccggagaagtgtgcttcaagtaacccggcgtggtataagaaggagaaaggggcaccttttggtgtgaaaacctttttcctcttcccaaaggggagggaattaag

SEQ ID NO: 655358 - DNA, 180 bp, Homo sapiens
tcaataaatgaaagcatttaaaaaaaaggcacgtattccttgaataggtaaaaaaagctccccatctgtcccctcccttttggagggagcagccccttagtgggaactcgtttgggataccccagaaaacatcagaaaagcaaccattaagccctctaccgtgcacgacaacacataaag

SEQ ID NO: 655359 - DNA, 948 bp, Homo sapiens
  misc_feature (104)..(104): n is a, c, g, or t
  misc_feature (226)..(226): n is a, c, g, or t
  misc_feature (235)..(235): n is a, c, g, or t
  misc_feature (262)..(262): n is a, c, g, or t
  misc_feature (265)..(265): n is a, c, g, or t
  misc_feature (277)..(277): n is a, c, g, or t
  misc_feature (284)..(284): n is a, c, g, or t
  misc_feature (290)..(290): n is a, c, g, or t
  misc_feature (303)..(303): n is a, c, g, or t
  misc_feature (316)..(316): n is a, c, g, or t
  misc_feature (320)..(320): n is a, c, g, or t
  misc_feature (326)..(326): n is a, c, g, or t
tcttaagaaaatgatgtatcggcaagcagtgtaaacggaggacttggggaaaaaggaccacatagtccatcgaagaagagtccttggaacaagcaatggctatngaaaaggttattttgtaacatttgtctaactttttacttgtttaagctttgcctcagttggcaaacttcattttatgtgccattttgtaacatttgtctaactttttacttgtttaagcttngcctcagtnggcaaacttcattttatgtgccatttngtngctgttattcanatttctngtaatnagtgaggtgaacnattcagatttcantatnggattnggatattgaggtaaaatttcatttgtgtatatagtgctgacttttttgttgaaattaaacagatggtaacctaattgtgtggcctcctgacttttaaggaaaacgtgtgcagccattacacacagcctaaagctgtcaagagatgggacctcggcattggccttcattccttaaaattaaaaactacaaaagtgtggtgtaaatttgtatatgttatttaccttcagatctaaatggtaatctgaacccaaattgtgtataaagacttttcaggtgaaaagacttgattttttgaaaggatgtgtttatcaaaacacaatttctaatctcttctcttatgtatttggggcactagggcgcagttgtgtggcagttgagtaaatgctggttagctgttaagggtggcgtgtttgcagtgcaagagtgcttgggctggttcccggttttctccacgattggtcctgtgtaaagatgccttggtcgtgcagaaaccaatggtggtccagttattaaaatggccggagaagtgtgcttcaagtaacccggcgtggtataagaaggagaaaggggcaccttttggtgtgaaaacctttttcctcttcccaaaggggagggaattaag

SEQ ID NO: 655360 - DNA, 193 bp, Homo sapiens
tggtggtgaagctaggaaaaaggattccaggaaggagcgtgtgcctatcctctttctgtgtgcttcagctgaattaagtgcttggagagctcaaatagttcaagatagccaagatgaccaattctgccaggtggcagcctgatcttgcaattttgattaaaataaagaacattccccaagaacagtttgttgc

SEQ ID NO: 655361 - DNA, 306 bp, Homo sapiens
cacgaggcccttctacgcccgcagcgagctcgcctcgcgctttgccggcgaggaggtggtggcggtgcaggaaagcctcgacatgcgccgcttcgcctcgccgcttgtgcagttcatgctgccctaccggatgccgcgccggaagggataggcagcgccgggccggcatgggagcgtcccgccgccggactgccttgtagttaacccgatggtgaagtttccgcgcccatagtatggtgcggctgtccgctcatgctctgccacacaaggacctgacgacaatcggcagaccacttgcgggaaatg

SEQ ID NO: 655362 - DNA, 1162 bp, Homo sapiens
ggatgacggagaggcaaaaacacatccagaaccttcggtcttctgctccctgacgtgatctgcttgcgtcctggtgcggtcgcggccgctgatcgttgtcgtcgtgtggtcctcgctgttgttgttccgaccccctggctgtcatctcgggttgtggacaacggctgttgtgccgtgtgcgtgacttgctcggtggggttcgttgtgtggctcgcgcggccagtttgagcctttcgttagtcagtgcagtcgcaacccgtgcggtggttctgtagttctatcttgcgtgtatttgtcgtgttgctcctatgatccggtggtatgcctggtgaataacctttgatggtcctgcagctgggccctgatccctctcctgtgtgtttttattggtctagtccttggtcgcatcttgctaggcattttccacacttgggtgaattgagtgatatccacatattgcagtgctccggggaattggtagttggacggtgaagctgttgtgcagctaacgttagttctgtgcaatcttgtggatgggtttagtagctgttggaggtgtctttgtagatatcttaatagatgctcggctcacctggagttccactaacctgtaaggcagtcgtcttggcaaggcctgctatgacaggtagctacagacagcatcacttggctcgagcctcactggggctcacacctacgctagtgtgagtatggggtaagatcagggctccagctaccacaggacgggctctcgggttatagtccgttccagtgcagggactagccgtggagagaccagggaccaggaagtcagacagtatgagctatgaaccagtggagtataggtactaggtcaatcctccagataagaggtaatggagaagaaaaagacggcacagccatggaggcagagtccgctgtccatgcgccctcacgtctgctggttgcatgctgtcaaggatgacacatgtcctgatgggagccatggcctctgcattgcatgaagaaggagacgatgcctttttcaatggtgtctccgctcgccatcgtgcagaagagcttttgattggcttctctcccgagattgtgcctgattctgtggcccaaaagcaagtcagttgttaacatcttcatgtgtatttatcctctgatctgttcatta

SEQ ID NO: 655363 - DNA, 109 bp, Homo sapiens
cccctattgggggcccccgggtttttttttccccccccccccccccccccctggggtttaattatggaaagggggggggggaatgaataaataaaggggttttttgcca

SEQ ID NO: 655364 - DNA, 243 bp, Homo sapiens
tctagaggatgccccacgcggagggacaggctcggagtgactggcttctgaaagtcggtcttgtaacaatgggatggatgccttcgaagagcccctgtccctatctatgcttgaaaacagcgtgcagtcctaaggtacaagaaccaggaccacataaaaacatggctccccttctgcggcttggaaaacgacccctaaattcggtgctgggatccgatccaggcacgggtatggctcagcgcg

SEQ ID NO: 655365 - DNA, 530 bp, Homo sapiens
tatgtgtggccgtgcaggtaaaggcttcctaaaagtgtgaaaacgtaggcttggattaaggcgacagcaattcctaggatatcagtaaaattagaatttgtgaagatgataagttgtaaagggaaggtataagggtgtgatatgtgctaggggtgggtgctctccaatatagggtgcatagattagggtggccttgcagtaagtgtatagcggtataggcgtacggccagggcatatgggtgtgaagtgagataggcgtgagtggtttcgaataatacaccttagctaattggggggcaataacgggcgggtgatagcggtgttcgcccctgtgtgtggttcaaacgacaaggctgtgcgccatagaggcgccaactcttactaaaaaacctccatataaacgacgacagacaaaccgccctaaatatatctcaaccagtgacacgcccccgtctcgatattacaggggagagatttgcgccaacctgcgctactaaagggtctacaatcagactacagtgagagagata

SEQ ID NO: 655366 - DNA, 106 bp, Homo sapiens
atctcctcctcatcttcctccttgtctcctcatcctcctcatcctcatccttggtctcatcatcctccttgtcctctgcctcctcctcctcttctgccagctggct

SEQ ID NO: 655367 - DNA, 212 bp, Homo sapiens
tatggtcggaggcctggagaggatgtcctgtccttccccaccaccaagacctacttcccgcatttcgacctgagcacggtctgccaaggttacgggcacggaagaaggtggcgacgcgctgaccaatgccgtggggcaggtgtacgacatgcccaaggcgctgtccgacctgagcgacctgcacgcgcacaaggttacgggtgggaccgggt

SEQ ID NO: 655368 - DNA, 120 bp, Homo sapiens
caggacaggggtatggttgcatggtagaaggattctattggcgaggagcccagagcatgagaggcatctctaccctaagtatccccatcgagcacggcatcgtcaccaactgggacgacc

SEQ ID NO: 655369 - DNA, 237 bp, Homo sapiens
aaaaagacgccgcagtagcctttgttatgccttctgctaaagagccggaactaagttgcaggtgactaaaaaatgggtggatgatattgatcgcacaaaacgacccgatcaattcagatttggcattgggcgcaaaagtggcgcaatcagataactgaatagcgggcagataggcagctcactagcgcggaaaattaggcaaaagactatcacccaagggatgcaagaccgggaatc

SEQ ID NO: 655370 - DNA, 242 bp, Homo sapiens
ctccctccctccaaaacccccagggtcccaggaaaccggggcctgggtggccctcctacccagggtggcccaggccgggaaaaaccccctggcaggggtccccctcttgggctttgaacccacacgccagctcctctttgaaaggactttcctgtttggaacggcaaaaaaaaaatttttttttctctttttggggggggttaaaaggggaccccaaccctttaaataaacctttcccaata

SEQ ID NO: 655371 - DNA, 376 bp, Homo sapiens
aacaatgatgtgccagatggatgacacagcccacatgacaggctcaggcatggaagggggcatcgaccatctagacatctgctcagcacagacatcttccactgaaaagagagcctcatctgaacacgctgggtgcttggttgacaattttctctcggtacattagggaagtgatacggtttagctgtgcccccagccaaatctcaacttgaattatatctcgcagaattcccatgtgtggtgggagggacccgggggaggtcgatcgaatcatggggaccagcctttcccgtgctattctcttgatagtgaataagtctcacgagacctgatgggtttatcagggtttccacttttgcttcttcctcattttctc

SEQ ID NO: 655372 - DNA, 208 bp, Homo sapiens
cctagtattatttgctggctgcaccatcgggatgtcctgatccaacatcgagcgtaaaccctattgttgatatgtgactctagaatagtgattgcgctgttatccctagtggtaacttttgttcccgttggtcaacgttatatggattcacttagagtaatagtaagttctgcttttgacttggtgcaagtctatagcattgtaactt

SEQ ID NO: 655373 - DNA, 191 bp, Homo sapiens
ggagctcggaccagattttacatgaactaggtcattttctgtcttctatcagatacctaggcagaacctaagacaggaaatgaccgtagtgtccatgttagattatcttgcgctagatcaataccagttgtaatcagtgctacctgagtagaaaacacacccacagagcctacaaggttgtaagaacgacg

SEQ ID NO: 655374 - DNA, 149 bp, Homo sapiens
tctgagcaagctgtgaagtagcccttgaaagcagactgtctaaatgctacgtggtgctgctttaggcagttagatgctcgcctgagggtgtgggtgttagtccaggctgttacatgctcacctgggtgtgcgagggttctgctacaggc

SEQ ID NO: 655375 - DNA, 1563 bp, Homo sapiens
agtgtggtgttaggatagctgtagtgctgctcgctgcgtatgggctccagtgcgtgtgtgtcggccgagttgaggcagcatgagtgcgtgcacctggtcggggtgttgggctaggggcgcggagagcggtacatgctgcccgcggtggtgccgcggttggctcctgtgccgtcggttgtggcgcgtacctcgttgtagctccattggttgtacgccaaatgggccggcggggtgttgtcggcgtcgcgggattttctcgccggtgatttgtgcgtgaatgccacatgtcgtgtcgcgcgttttcagctcgactggtttttgcatcggcctgtgccgtttgcgccgagagcgctcggtttgcgcggcgaagtgtgatcttatttgggcgcgtgttgagtgtctgttgtgagaccgcgtcgtgggcgccctcagtgaggagttatgtcgtgtcgcggccgtccatcgggggcgactgtgagcgtttgttcctgcaaggtggtgattgcttcccgcagtgcggcggttgtaggtatctgaccgccgaactgcgggcgctttcattcgccccgctttgtatggcacgtgttggtgggcgagttgaggtgggggtcgttgtatgtcttgagtggtgatatgttaggctggttgcggcaatggggggtggtcggtccccccaatgggggctttgggggagcccgccccgccggggtagattgccgcgcaggtgccgggagggcgcttataccgccgtatagggatattctgcggccgttgaacatgggtggcgtcctgccccggttgataaatgggtgggcgcgccgagaattttggtggggggcttgcgattgtttatatatggggtatagaagagggcgtagacaaaaacttcttatggctgaagggaccctgggtgtgaggatagaaacttggggttttggtgcccacacagaagataggagatatgtctgtagagtgtcatcaaccggtgtcaaataggttgtgggggcccacccttgagaaccccctgtgctttgtatatagttcccccccctctggctgtaagatagtttcaaacgtgggttttaggtcccccctaagagtgagggtgacacccagactttctctgtgtgtgacacactgtagggtgaagaaaacacccctcttgtttagaagggagatagatgtacaacaaaatgtttgtacacacccctatttagtttagggcgctttaaagccaggcgccacccaattgataggaagcggtgtctaagcggtctagtaccaccccgcgtaccttgaaagatatctccctataccattgtaacgtgatacatccttccactaccgccgattggggcccaaatttgatccaccctatagaagaactaatgttagtataagtgtaccatgggaacatgtcttcctccgcgataagcctgcggtccagagtttagaacactgaactgaccaattgaccagccccaatatttgccaatccaacccacaagtcattattaccctcactgtcaaccccacacaggcatgttcataaggaaaggttta

SEQ ID NO: 655376 - DNA, 422 bp, Homo sapiens
  misc_feature (163)..(163): n is a, c, g, or t
  misc_feature (166)..(166): n is a, c, g, or t
  misc_feature (222)..(222): n is a, c, g, or t
gctagcatctaagatcggcgtcggtgggtgtacagtcatcgatacagcatcatgagcagttcttagcacaggtgcggaacatgcagtgccctggtgcaggatgaggcgtacaagcacagagcgagcggctgtcacttgcaaggacagtgtgggcttgcgatcngtnccccagtagctctgcgcacgggacgatggagagcttggcaggatgatggcccacgnatggcgggtgccacctccttggagcacttaacacccagaccgacgtggccattgtagtccccggtagcaacaaatgccttgaacctggtgcgctggccggcacgggtctgcttctgcactggcataatcttcaaaacctcatccttgagagaggcccccaggaagaaatcaatgatctctgattccccagcccgggccgg

SEQ ID NO: 655377 - DNA, 266 bp, Homo sapiens
aagtgcgccgagcatgcgacagctgatgtgcagtggccggggtgcaacgggcaccgtgcccatcacgataatcccaaccagcgccatcggagtcaggaacacgaggtcatacatgaccagggtcggcatggcggtgtcctgtcctctctctgtctgtggggaatactattatgcgtgcagtatagacagcgtggcgcaatatacaaggtctttgccgatcggggttgagccgaagcaatgcgagcagtagagaccgatcgcggccg

SEQ ID NO: 655378 - DNA, 445 bp, Homo sapiens
tctagacgtgaactatgtgggatacaggtcatgggcagagctcctggcctcagtgatgcctcctgtatctatccataggcctggtaagatcagcactgggatgacgatgagcagaatggtcatgaggatgcccagcaatcaggtcccagatgttcaggcacttggccggtggagtgcataagccatgggctcccggtcacgtcgccaaccagtcttcctgtccctatacttcatggagtaggctaagtgctatgaagcccaggcagcaagggttcatgatgagggtgttgaacagggaccagacgacatggtccggcacgggggtcccctggcggatgtggatcacggtggacgtcgggggagcagggttgtggggcgcccccagcacagccacctcgtgctcctccttgagcatcacatagttcagcgtctgacgggtaccgag

SEQ ID NO: 655379 - DNA, 353 bp, Homo sapiens
tagctggaactaaagatgcatgcacctttacccagctaattttggcatatttttgcagagacaggcttcaccatgtgcccaggctggtctcaaacttgtgagctcaagtcatcctccagcctcagcctcctgagtagctgtgataacaggtgcccactagcacgcccagctaatttttgtatttttagtagagacgaggttttgccgtgttggccaggctggtcttgaactgctgaccacaaatgatctgtctgcctcggcctcccaaagtgctgggattacaggtgtgagccaccacgcccaacctagcttttcaccacacaatagctactttgtcttctgtcacttgactt

SEQ ID NO: 655380 - DNA, 328 bp, Homo sapiens
ctgccacacccgtcgtgtcctaccacactacactcataaacgtcacgcggagtttgaaaaaagccacagcttgctcatcttccgacaaagagcggattcacagtccgttcgatctcagagaactgagtacggcacccacttcatggggccaaccccactaaccaaaaaatggcttcgctgccccaagatcaaccaaactccgaaggcctgcgcgaccctcgattgttttgaaaactcatggctcgtggtcaaaaaagtaaatgctcttcaaaatgttttgaaaaccctcaaaaaaaaacagcacttccttaaaaagaaaagtctatta

SEQ ID NO: 655381 - DNA, 1239 bp, Homo sapiens
gcctcgcgacggccatggccctttacccctgtactcactgctgcagcgcacgccctgctctgcgtcaacgccatcgcagctgctgcacgaggagcgattcctcaagaacattggctggcggaacagaccagggcaacttggctggactttggcagcaagagccgggacacttaacactcacagcttaactgaaccttactccgactctgtaagaaccgctgactgacgagctgccactctgactacactagctaaaccttccaacttgccaactctgctgctccacctctctctactctactctctggcactgcacactactccacgctgcgcacgcacacacactgcgcacgcaccctcaacgcacacgcaacgcgaccaacttgccataccgacttacgcacaccgctctactctacccctctctgccgctccacctctacctctcgcgcaacctacctctctacttaactccctcataagccctgccgcccttgcaccccctttgccaaccttctgctccaaaaacaaactgtctacaaccgcctcgcacacaactctaaacaaccccacggcgggcaatccttccactaacttcctaccttccctcgctctctcaccactcacctctctcccaccctcgctctccgcacccatcctgcactaacccttctccccacttccaacccacaccacacccattcttcaccacactcccagttggacaccacgctggccagcactcacccctttccctcccccagggggacccctggggcaacactacctccctctcgcacctcgggccccttcccacgcgtgcctctcaaccattacgccttacggccctcctcacttgcacctgctccgccactcgaccccacccttgcgctcccacacccaatccgcggcttgcccaatcaaccaaaccacttagcccaccacgcccaacacacccatacactctcacaacctcctaccagaaactaacctctgcggccccgcctacacatccaacacccatcacaaacctacagccctaacaagagccgacactttctcacacaccacttctccctctatcccccctccaacaacacagatccactaacgaaacagacattcactcctattacgccacaaacatctcactaaacacccccaccgcatcacatcctcctcgacacacccctctcgcgtcacatcatactccccccctacacacgactcatcacaccg

SEQ ID NO: 655382 - DNA, 228 bp, Homo sapiens
agcagcggtctgtataatagtcaatgccttcacaattcacagagcaacttatccatctagtcattcttagtcatgcatttattagctgcccactgtaataaaggcctttttctaactctgtgtacaaatagacctcttcccaagatagacaagatgtatgcttttgacctggtagtggattgaagaaagctattaaatttataaccaaatatattaacaagatgattg

SEQ ID NO: 655383 - DNA, 761 bp, Homo sapiens
aggaaggaaagagtggacagaataacaccgtggggttgatccaactgaacctggcccaaggccctcaatgcactttgcgatgtgcctgattgacgatgctcaaccatgtgccctgaatgaccttcgagtgagtgaccctgtgcccttggtgtgtgccatttgtcctcaacctggctggggataagtgccttttgcagctgtgagcttgatatcaaggaaattgcagaaccttgagtttccagtgactgttactccagcaagttcttgaatgcactgggaccaacctcacccaggtcaagaagccagtcatcgctgctgtcacatggctatgcctttggctggggtgctgtgagcttgccattgatgtgtgatatcatctattgccggtgagacacggcccagctttgcacatgcctggagatcttacatagtgaaccattcccagtgttgcgtggctgtgtacccagagcactcaccactgtgctcgctaggagaaggtcgctttggccatcggaagattgggtccctcacctggttacccggtgatctcagccccaggcacgcccaagcacagcagggtcttgtcatgcaaagatttaggtccttggttgaagacacctgggtgcgagagaaacgacccatcccgtggtggccagcaacataccctttcccccgccacatttcttacacgcatccggaaccgtcagccgtaatgtgcccacaccccacatacggtgtgcaaattgcacgcatctcctgca

SEQ ID NO: 655384 - DNA, 147 bp, Homo sapiens
ccaatccccccatttccttttggaaagttgggcctctcataaagcggcttggccattttaagtgttttgtaaaatgcattaaagtgttgagttttgtttgctgtaaaaggcatttccctatgttgattaaacttatcttttttccca

SEQ ID NO: 655385 - DNA, 357 bp, Homo sapiens
  misc_feature (144)..(144): n is a, c, g, or t
  misc_feature (231)..(231): n is a, c, g, or t
cagtatccaattcctccagataacaagtatttgggagtcttaggttctccaaggatctttgggaagcggctatctttgcttagcaggggcagtttgatgtgcactcctgcccgaagtccagtgcccaggttagatggacaggtncagatgtatcccaaaacgctcattccacatgaactcccagccacgttcttggataaaatctctccaacctctttgagggccctcggnaagaatctttcaaacactctcttcatgttaccacccttctccatgggagaatcacccggtgtatgaatcctccctcacttcaaccccgaatcagggaaggctcttctacattgttgtgccacaatt

SEQ ID NO: 655386 - DNA, 191 bp, Homo sapiens
cttgcatgtaccgggaccgggcttgcatgtacccttgcatcttccgggccttgcatctaccgggtacggaggaattaattctaagacgattgtgcattaaactgtggtttgctccacagatttcagatcattgaccgtagtatacccccggatacatggggataccgagtcttcgaagttcgtaactcatg

SEQ ID NO: 655387 - DNA, 192 bp, Homo sapiens
acggggtgcggtgtctgctgctattctcgagcttcgcaattgccgcctaaggacgacaagaaggaggaaggacggttggaaagtcggccaagaaagacaaagacccagttaacgaatccgggggcaaggccaaaaaggaggaggtggtcgaaggcaaggtcgggacaagctaatacttagctttgtttgcaa

SEQ ID NO: 655388 - DNA, 791 bp, Homo sapiens
  misc_feature (435)..(435): n is a, c, g, or t
  misc_feature (614)..(614): n is a, c, g, or t
  misc_feature (635)..(635): n is a, c, g, or t
  misc_feature (660)..(660): n is a, c, g, or t
  misc_feature (662)..(662): n is a, c, g, or t
  misc_feature (665)..(666): n is a, c, g, or t
  misc_feature (677)..(677): n is a, c, g, or t
  misc_feature (722)..(722): n is a, c, g, or t
  misc_feature (736)..(736): n is a, c, g, or t
ggcacgaggggaattgtgccctcataaaagggaccccagagaactgctgcaccccctccaccacgtgggacacagtgagaaggcactggctacgaaccaggaaaccctccccagacaccagatctactaacaccttcatcttgggacttccagcccccagagcagtgagaaatacattcctgttatttgtaagcctcacggtttacagtgttttgctatcacagctcgaatggactaagacagcaggaaacagaatacagagaacatggagagaagcaaggcttttctgggtgtgaacttcccaagcatgcaaaaattttacacaatcaaaaaacaaaaaattaaattgtaacatttaaaatgaactaaaattaatgtaactgcctatcaagccagtgacacaatcacacaagcaacatttctggtgccgcgaanacaagactgggcccagcttccatgggacatgttctaaggagtgagacgctgcaaagaagcgcagatgccatccggagctggactggtgcttactgttatcggtaatatctggagtgctattttgaaactaaagattttagaaaccgaatttttattgtaagagatgcaatataaatccnagaagttggtaaaactctacnctgttaatttgaattggaatattancntgnncactttttaanatccattacttctaactctgtccctgaaaatggtcagagccctgnaccctgacagcatnggcacccgagtctcattccggtctaaaaatctttctcttccaagcccagggcttc

SEQ ID NO: 655389 - DNA, 207 bp, Homo sapiens
aaaaccttttagagagataaaaattaacaccatagtaggctaaaagcagcacaattagaaagcgttcagctcacaccactacctaaaaatccaacatatactaacctctcacaccaattgaccattctatcacctgtagagacctatgttagtatagtaacatgaaaacattctcctccgcatagcctcgtcagattaaacactact

SEQ ID NO: 655390 - DNA, 118 bp, Homo sapiens
tggtttcccagatgcttaaaggaagacatatccctcccctggacagcaaggagacaatgggagagagagagaacataagagcatgtgaataaaatggcaaaaaatactgaacgcggga

SEQ ID NO: 655391 - DNA, 263 bp, Homo sapiens
aaagctgtatatatgacaataattacccctatacatcacatctaatgatacactccccataaccatcaagtcactggtctctctcccgtacacattagcacacaggtacagcactacgaaacctgagagaccacagtttactattacaggttataagaaattagatatatctccacgtatcatatagtgttagtacttgatttcagaatccctatatcgtggagtgcgtgattctgtgggtgtaccgaggctcgatatttcgt

SEQ ID NO: 655392 - DNA, 694 bp, Homo sapiens
  misc_feature (6)..(6): n is a, c, g, or t
  misc_feature (32)..(33): n is a, c, g, or t
  misc_feature (45)..(45): n is a, c, g, or t
  misc_feature (50)..(50): n is a, c, g, or t
  misc_feature (59)..(59): n is a, c, g, or t
  misc_feature (72)..(72): n is a, c, g, or t
  misc_feature (83)..(83): n is a, c, g, or t
  misc_feature (297)..(297): n is a, c, g, or t
  misc_feature (537)..(537): n is a, c, g, or t
  misc_feature (551)..(551): n is a, c, g, or t
  misc_feature (559)..(559): n is a, c, g, or t
  misc_feature (561)..(561): n is a, c, g, or t
cggggncgtcacatgtggtaccccctgatganngagtagggaggngagcnacactaggnggcggtctcgtcntcggccccggncagcagcagagggtgctacctctgacgttcgggggaacaagtaggaaactacatctgtctcgtactggctcgctgccactgtggcagcagactgcgctaagtaccgctcctatgcaggcaccctctcgtttgcaactttgaagactgcttagaccacgaagaagtagacatcacctatcctagatccccccagggctagccgtgcccgctgcangaagtgttagaaagaggctactttgcctgctaagactctctgcaggcgagggtattacaccttggccaaggctatagccccttacttctgcagcagaaaaccaggttatgaccaagtgattacccgctggatcaaggtgtgaacctacacttaggccccgcctcctgcctcctcagttactaacaagtaggccaccagtcgtactagtaggctactagctgggtccgcacagacaccacntatttcagcacggngccgcctngntgttagttggagctagacaaagaaaatcgtcggcctgatttttttaagatccacacgccacacgtacaagggacactaaccctcccattgctacatggaccgtactctatcatgcagaaatttccacggtaac

SEQ ID NO: 655393 - DNA, 1153 bp, Homo sapiens
  misc_feature (871)..(871): n is a, c, g, or t
gccctgaacaaaaaaaaacaaaaagaaaaaaaaaaaaaaaggaaagaaagaaactgataaaaagaggcattccagcccctatgttattggatggaaaaagaaaaaaaaaaaaaagcaattcttcgcagtacatgtgtttacttgtgttcgaaaaaattctccggacaagaattaccctttgttttatgttttctcagtatttctgaaaattaccagtgtgttgttgcgcagttctcgcagaattgtttaccttaaaactgtgcttgaaactttgaaccgggcaagaaagtgtttcttgcgcggtttctcttgctctcccttcgaacaacttgtgaattgtggagggcttgtctcgaaccttcttccttccgcggtggggggcttctccccagagggtggcctatattcttctctctctgtgaaattgagtctccattggcgcagaaaggttctcaccactatatattctcccatggtggcaagaaattgtttagagtttgtgcgtaggggatatagtggggtatgtgtgggtatgtgtggtctattatagagaaaaaaaattatctatttatctacaacttattattacatatagagatatattctatatctcgcgcgatatatagagaatataatctcgcgattataattacacaattagagggggcgttattttatagagaaggagaagagaaccccaaaaaaattttctaagtggttctctcttacaacacatctatctatttttctaaatgtgggggccaatgtgcgcacacaagaggctgctttctcccgtggcaatttccccgggtgtccgtggaaaccttttttagcaaaaccgacgaaagcggatctgtggctatttttgccnacaagggacccaaaaagtctgtgcaaatgttgttcacagggtggaatccttcccgcgtgttaaaccacatttgtgtataagagcgggttttcttccgcctctttctctccttgtgaaaacttttacttttaccttttccaccaggccagtctggccctaatagggggcccaaattattacagtgggtttaagtcgtggggaaagcggttccaatttttccagggggtgtaatgggaataataagcttgttattatatacgactcgtggtttttatcaaacgt

SEQ ID NO: 655394 - DNA, 673 bp, Homo sapiens
agcggaggttgtaccccagcaccagccgctccaccaccctcggctagtcttcgtagtgcagtaatggtcccgctgtaaatgtgggaggacttaagtctccccagctggaaaacaagaccctcatggttcgacacgaagaactacgcagaaggaacagcgtggcaggggctgggaaccccggggtaccaccccatgcgcgagaccccggagaccaaaagagacgaacagtgtactcaatacaacgaatgatgcagcctcccaggaggcacccacactcgagcgaacaggtcaaagaagaacaacgcaggtagcgctagatgtgagtcctcccacacgagagaccaggcacccgaaatgacacagaagcaaggaacgattgagcacaccccccagcacctcacaaaagaacatcccacaaacacacgagaccaaccacgaggacatgcaatgatgaacgacgacagtggcacacaccgcacgcgccagcacacgcgtggagcaacaccgccacgcaaagcggcacacaaggcgggaacacaaagaaaacaacccggaaaagacgcaagcccaaaagacagcgcaccacacagacccggaacgcacaggcagatagaagagaccgcaacaaaacgcaaccaacgcggagcccgagcagagagaaacggcggacgac

SEQ ID NO: 655395 - DNA, 341 bp, Homo sapiens
  misc_feature (42)..(42): n is a, c, g, or t
  misc_feature (103)..(105): n is a, c, g, or t
  misc_feature (128)..(128): n is a, c, g, or t
  misc_feature (218)..(219): n is a, c, g, or t
  misc_feature (224)..(224): n is a, c, g, or t
  misc_feature (252)..(253): n is a, c, g, or t
  misc_feature (260)..(260): n is a, c, g, or t
  misc_feature (336)..(336): n is a, c, g, or t
agaggcttttctggaaatccaagaaaaagaaataaccattantttgttcaatgataattttctagatcttcctcgtgtccaaagctatatattttctcctcannngccgccgctcccagacctttctngccctctttttctccctcttgctggggcgggctaattcccctccgcccccacctctcttctttcagtgacactgtgtgggtgttgatggnntgggntctcaccggtgtgggggtttgtcctttnngccagcngcccccgggcggtggcgcccggggcctcaccggcccgccccccaccccggcccatccccggggcgggggccacggngctgg

SEQ ID NO: 655396 - DNA, 201 bp, Homo sapiens
  misc_feature (12)..(12): n is a, c, g, or t
  misc_feature (139)..(139): n is a, c, g, or t
cccgccgtacangtgcgtgagactttgttcgtgggcgagggcgggcctgtcagaccccgccgtcgcggctgtgaggtcgccgcgttataggccgccggcttccgacgaagcaacgcgccagccgagcgtcacgacaggngaaagatcgcgtcccccggacgttgatgcacatccgcaactggtacggcggggggtaccgag

SEQ ID NO: 655397 - DNA, 159 bp, Homo sapiens
acggacacaagtgcataaggacacagaacacaggcccaggagtcagcttcttcctcacttggtggcagtgaagaggcatcacaaataaatttaaaaacgttcctttcttacttcatcttcagtttccttgacatacctcagatcctgcaacgatatgcc

SEQ ID NO: 655398 - DNA, 525 bp, Homo sapiens
  misc_feature (329)..(329): n is a, c, g, or t
  misc_feature (405)..(405): n is a, c, g, or t
  misc_feature (464)..(464): n is a, c, g, or t
  misc_feature (484)..(484): n is a, c, g, or t
  misc_feature (508)..(508): n is a, c, g, or t
tctctctcaagttaaagttcacaaatcctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagcatttcaacaagtctgtaggaagttccaaactttcccacattttcctgttttcttctgagccctccaaactgttccagcctctgcctgttacccagttccaaagtcacttccacattttgggtatttcttcagcaggtcccaatctactggnaccaatttactgtattagtccgttttcacggtgctggataaagacatacccgaggactggggaaggaaaaagtggntttaattgggactttaaaggttccacatgggctgggggagggctcaggattcatgggtngggagggcaaaagacaattntttacattgtgggccaggaaaaantgagggaggaggcaaaa

SEQ ID NO: 655399 - DNA, 576 bp, Homo sapiens
atgacagacccagatgttcctggcccaagtgatccttacatgaaagaacacttgcactggatggtgacagacattccagggacaacagattccacatttggaaaagagttgacaagctatgagaaaccaaagcctaatataggaatccatagatatgtgtttgtccttttcaagcaaaaaagggggaacaagtactccattacatgtcctttttcgagggattacttcaacacacgaaattatcaaaatgaccttggtgtccctgttgctgctgcttatttcaatgctagaagggcaacggctcctagaagacgctaggggttaggctactatagccatccaatcagaagccgattatcatgactttatggctatgattgaaataacagctttagcttgctttagattgatttagctttcttgtgtttgtggagttgttaagaacaaagatgttagaagttaatgaaattcagaagcatggatattgttgtgaatgccatgctagctgattgatgtttgtttgtttagaaaatattggagcctttggtgtgggaaagcccaatttctttctgggtt

SEQ ID NO: 655400 - DNA, 201 bp, Homo sapiens
tcgcggcggactcggatcgctggcaagtatgtacgaggaccagcagagaaaatttctatcttagctgtgaattattccatgtccacatagaatctggatgtgttacttgtggtgttttcacttcaaaaatttattttcattgttggaattagtcttataattcaatttgctatatgtgtaaaggtaggtgttttagtttgg

SEQ ID NO: 655401 - DNA, 159 bp, Homo sapiens
aggatatgagttctgggattgaggtaacatggagcccaccagcatccatgagcattgggagttaggggcactcatgattctgagaagtcactcagccacgcagtacatgatatacattttaatcgaaacacagttgttcaccatgaaaagggaaactat

SEQ ID NO: 655402 - DNA, 102 bp, Homo sapiens
cgctctcctcttatcatcctcctgacctcctgcatctgttccagatcctcctcctcttcacaatctgtggccatcctccttgtcttcttcctcctccttaag

SEQ ID NO: 655403 - DNA, 1296 bp, Homo sapiens
  misc_feature (1004)..(1004): n is a, c, g, or t
gactcttccgggtgacgtagtctgtaggcactcataatgttccagcgtctgacgatacccgacgtattgctttcgctacaattatcgagctcctctaatcaatatactaggcgtgttcgctgaaccgcctgagtaatagaattagtgttacctttaatcctcataggaacggtttggagaatacggtcgacccatcatatcatgcatgtgagtgatgttgcaccagtgcagtagcttcgaagggtggcttctgtgccttggtaaaagatctcacatatgttcctttatcgagattggtccgatgcaaccaaagcgagcaagtggtcagcgaggggcctatggttgagttcccattagtcgtgctaaatgtagttcagtagactaggatcacatccgtgctttaccttatcgaggagcatgaacaactcggtttgtggacaacgatgtttgaatgcgcacaaaagcagcagaggttcagaacaggctaaaataacacacacaactgcaacacctttttttcgacgctacactacacaacacttgacaatacgatcggctgttatggacacacacccacataaagagaaacgagcgcaaaaacacgagccacctcacttttgtttgaggacccgggtgcgctacggagccctattgggagaaacaccttgtgatcctttacaccacccaacttgtcatctcagtatgtggccggccccaggtttggccccacaagaagaaagtgttaccgtgcggcggaccaccttccgttgcgatcatatactcgccttgttttccccataaaggcacaaaactcgccgtgtctccccttcatgaccaactatgggtgcccgctggtggatattactctcgacccgccaacattatatagagcaatatacggacccccggtgttgggtgcaaccacccgggcaaggctgttcttttggggagcacagacaaccgttgctagagtatctcgaggaccatcgtcatggagccgacanccacatccgagggggcgtaaattccattagtacgaaacgagggcaactgtatcaccaacggagggcagcacggctcgtcaatactgtatcacaataaattgttagggcccccggcggcgatcgttagcgtgagacatacctgtcgccacgtcgcacacaaaacactattgtgtacaaacgttatactagcgtgcacaaaacacggctgtagctgacatagccacaacgacaacacccgctacgcgccatgacttactagcagcaggcacgtctcatccctaactcatcaccc

SEQ ID NO: 655404 - DNA, 739 bp, Homo sapiens
aaggatccccctgatgctgaacgacagtggctcagtcacagttccatgcccaagtatatgccggcagttctccctggagcacgtccacggctcgggcccctactcggccccctccccagcctacagcagcctccagcctctacgccgcctgatgctgtggcagctctgtgacccaatcatctccgacatcaccgagctggctccgtgccagcctcctatgggctcccccggcgggagcatagacgagaggcccctatccagcagccccctgggtgcgtgtcaaggaggagccccccagcctcgcttcagagactccccgggtaaaggaggcgagtcccggggcccaatcttccgtggaacacccatctgtgtacccgaaccggcctcatgtgagctccatccatgcgggagagtgaacctgtccccgcgacctccgtgagagccctcactggacggcaagggggccaacagcgggacaccggaggggcacggggtcctcggacatccccgcagaggttccagacctcttagcaaccccgttgacccagaggtggcccccaatggtgggcctgatgtggggacaagacacttcacgcgtctagctcaaaagacctcggaaatgctaatcccggacgtccccccagggattaagctgccacaccagtggcgtgaggcaggtcacgagcgttgaaccgagtacccccgggcgccctgctaggacacaggtgagggcctgggg

SEQ ID NO: 655405 - DNA, 142 bp, Homo sapiens
tcttcatttctttccaggtacattaaattgtcatttcatcttagagggaaactgattagatgggtgtgttcgtgttctgatggagaaaacagcaccccaaggactcagaagatgatgtagccggtcagaacaggtgggctag

SEQ ID NO: 655406 - DNA, 743 bp, Homo sapiens
caactatgctaatgacgagacttgtgttatttgcgtcgccagcgaacacatcgctcagacaccatgtgggaattgtgaatggtcggagtcaacgtgatttgtgtcgtattggtgcgcctgtgtcaccagtgactgcttattaactctgtgtaaatgtgtgatatagtttgccatcaatgaccccttcatttgacctcaactacatggtttacatgttccaatatgattccacccatggcaaattccatggcacctgtcaatggctgagaactgtggaagctatgtcatcaatggaaatcccatcaccatcttccagtgagctgagatccctccaaaatcaagttgggtgcgatgcttgtgctgctgagtactgtctgttgtgatgtccacttggctgtcttacaccacacatgtgagaagtgctggtgtgctcattttgcatgtggtgtgtgatgccaaaatgtggtcatcatctctagccccctctgcttgatgcccccatgttctgtcattgggtgtgaaccatgagaatgtattgacaacagcctcaagatcatcagcaatgcctacctgcaccaccaactgcttatcacccctgtgccaatgtcatccagtgacaacttatggtatcgtggaatgtgactcatgaccacagtccatgccatcacttgtcacccagaatgactgtggattgccctccgtgaaactgttggcgtgatagcgctgtgctctccagaaactca

SEQ ID NO: 655407 - DNA, 262 bp, Homo sapiens
acatgagtggtctacactaaagcagtagcattgaatttcagaggagtggcaactaaagaagctgttgagtgtggtaaatttgacaaagtttgcgggttgattatggttggggtgtgagggatactctgtaatccccgacttgtcctagagctcttgttggcccgtggtgtagtgtgtggcttgctggttgactgcccgtattcgtggttggtggaggatccctcatagtagatcgaccttgcaaggctatggcaagctatgg

SEQ ID NO: 655408 - DNA, 446 bp, Homo sapiens
gcctactactactaaattcgcggccgcgtcgacccgcgcccggccctctacaaaaaattttttaaaaattagccagatgtggtggtacgcacttgtcctcccagcttactccataggctgaggtgggaggatcgcttgagcccaagaggctgcagtgaaccatgattatgccactgcactccagcctgggcaacagagtgagactctgtctcaaaaaaaaaaaaaaaaatgccggacaaagtgctgggattacaggcatgagccaccgcgcccggccctctacaaaaaattttttaaaaattagccagatgtggtggtacgcacttgtcctcccagcttactccataggctgaggtgggaggatcgcttgagcccaagaggctgcagtgaaccatgattatgccactgcactccagcctgggcaacagagtgagactctgtctcaa

SEQ ID NO: 655409 - DNA, 236 bp, Homo sapiens
acatgcaccatgggtgcgaactagggatgcacgtttcccgggggccccgcgcagaggctactgggaaggcactttcgtccgtaggttgacccaggggcaacttctcttcctctccatgtttttcaacaggtgcctctacctcccctttcaagacttgtcttccaatctgggccttcttcccgatttttgctgcccctggcatgtgggacacacatcgtgggtgtgaacgagggatg

SEQ ID NO: 655410 - DNA, 374 bp, Homo sapiens
tgctgcttcgtcctcctcgatgacttgccttgactgacgcaccccccgggtctgtctcctttctgaattccctcggcatggtaccatgtgaacgtgggcagaagggagtgggtttcacattcactccgtcttagtcttccccattaccctgtgagtcagttgcgttaacgtgggcatgttacaaggagagttggggctcgagcatcctggtattttggtgcctggactcctggtcgttcccttctctttgtcctgcatcgtgtagactggagctactttcatgcctgcgagtctacccttttttgtatattgctcctggggtggcaggatagatgcgtgcggggggcgaagggacatgacccttcatactttgc

SEQ ID NO: 655411 - DNA, 1052 bp, Homo sapiens
ggggaagttagatgacctccatacccacccctccctgggctgtcccctgcccacatgactccggcggttttcttcataaccagtgttggaggtaaactttaaatagcccccggactcagggagttaaccaaatgcttcttgaacctcacttaaattttcaacgcacatgaaaagcaccacaatgaaaggctacccaaagcttgcacccactgccaccttcctgccatgactggttaaggcagaagggacacattattttgtcattacacgatctgaacacccccttttgcacagagtaatggagaggctagactcttagacatccctggaatgggtcgggacagcaggggcccaggctttagagctctgggttgactctgctcccatccccaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaa

SEQ ID NO: 655412 - DNA, 609 bp, Homo sapiens
  misc_feature (360)..(360): n is a, c, g, or t
agtcaagaatttgattcagttttgtttcgcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtggctgaccagattacaggtcagccttcgtctcagtacaacctattacatatggtccttcacattcagggtctgctacaacagcttcccagcagcttctcatcccttggctagttaccgctttctgggccaccatctnctcagcttagcctatgccttaccaatctcctagctcaggaactgccctcatacccgctccagccaccgaatgcattcttgacagacttcacttatgcccaagtactggccaggggggcctttctgacctttatcctttatatgtaccagttgtgtgaccagcggcatttcacttgatgggaactgttacctttaaccttgacccggagaatcagggcttactttgcacccattgtctgcagacatactt

SEQ ID NO: 655413 - DNA, 1310 bp, Homo sapiens
  misc_feature (679)..(679): n is a, c, g, or t
tggatttctattttaattggcactgtggtctgaaagtgtgtctggtattggttttgggtctcttttgtgcattctgtgcgtgattgtgcttttattgtctccgatttatgtgtggctcattttttaagagttattgttgttcatgtgtgtggcaactacaaaaaaagtgtatttttcatatgtttctttgtggatgtggacagttctcgtgttaaaggtctcttattatagaatatacatttgtggtctctatagtgtgttgtagagtttatagggtctccgtgaaattattctttgtggtataatttttctctgtggcttataaatgtgaatctctgtgtgtctctatatatactgtgtctcgcgtgtggaagtgtgtttacaaagctctctccccaatatattctattgtgcgtgtttggagacgcctataaaggttctctcatttattataaggggttttctaatagagacaaacctttgtgtctcttatatgtagagaatctctgtggagtgtgccctccctgtgtgtgtttgtggaaggtgtggacaatatatttatatatttctctacaggacactttaccgtctttagagcgactaatatctctcttgtgtgctgtaggaaaccttttgaaatgttggccttgttatccacacaattatattatcgtggttnataattggccgccccctgttgttggcctcctgtaatatttcttgctagagaaacctttgttggtggtgtctccagattatattcaaagaagcctccagtaggtatatagggttctttgggacacaaatatttctgaagagggcgtattttgacaaatatggccctgttggccaatttttgtgacacccgtggaactttctaccccaatttgttgtggcccttagtgacttaaagaaaattttttctcacctttctcaaatatcaccccttttttgtcatatttttatggggaaaggccccctatattgtgggcaatgttgctttacactttgtagcccatgttgtgtttggaaacgaaatgtgaggggactaccccctgtggaaaccaccaaccgggggcgggtttaacattcacgttggcgagaaggatctaatagtgccccgttgtatatgatataaatatccccacggtctagtttgccccgcacatatcctatatagggccccgtattttttcactaaacatataggaggggccaacatttctaaagggccctattattgttcaaacacctcttccccaagcgggggtgatcaccatacaatatctgtgggacaccacaatcgtctg

SEQ ID NO: 655414 - DNA, 600 bp, Homo sapiens
ggggaagttagatgacctccatacccacccctccctgggctgtcccctgcccacatgactccggcggttttcttcataaccagtgttggaggtaaactttaaatagcccccggactcagggagttaaccaaatgcttcttgaacctcacttaaattttcaacgcacatgaaaagcaccacaatgaaaggctacccaaagcttgcacccactgccaccttcctgccatgactggttaaggcagaagggacacattattttgtcattacacgatctgaacacccccttttgcacagagtaatggagaggctagactcttagacatccctggaatgggtcgggacagcaggggcccaggctttagagctctgggttgactctgctcccatccccaggatagaagcggctacattgacgagcatgagctggatgcccttttgaaggatctgtacgagaaaaacaaaaaggtgagcagccaagcctgaggcccggccactgtccccagggcacgggagaggcttctgcaggagaggaggggaaaggtgcctggtcctgctctctactcccctctgatctgccacagcaaggcaatagacattttg

SEQ ID NO: 655415 - DNA, 1372 bp, Homo sapiens
agcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaacctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaa

SEQ ID NO: 655416 - DNA, 453 bp, Homo sapiens
  misc_feature (207)..(207): n is a, c, g, or t
gtactctagaggtcctggtcaatgattcttgtgctagcctccgagtagctggatacaggtgcaccaccacacctggctcattttttgttttagcagagacaagttttgcatgttggcaggctggtctcgaactcctggccgtcagtgatctacccaccttggcctcccaaagtgctgggattacaggcgtgaaccactgtgtacggnctgtggttttttcttttcttttcttttcttttcttttttttttttggagatggagtctcgctctgtcacccaggttggagtgcaggggtgtgatatcggttcattgcaacctccgcctcccggtttgagtgactctcctgactcagcctctcaggtagctgggactacgggtgtccacaaccaggcctagctaatttttggtattttaagtagagacggggtttcactgtgtaagctaggatggtt

SEQ ID NO: 655417 - DNA, 513 bp, Homo sapiens
tcggtaccctataacatctatggatcaagagcgcggtgtttgatactggtatgaaaaacaccacttaaaggaggcatttgcttatcagcgacaataagcacaaagcttgaagggtatgttattctctcaatactacttctccacttcgcaggcatatctattcaggagggcatcttgaaagaggagcagggtcacccacgacttcttatatctcctgcagtgcactggccaagtgtgtgtgtattgatatgcttgaagcccctagggttctcaacatgccaaatcacaaaggggttcaatttgtggcctgcaacattgcccccaagcaagactgtcatccagtccctaaaagacttgaagcctggcattgctttggtctacctcatggatcaaagtcctttcaggcatctgtttccagaatagaaaggtttcatccatattgaaaatttgttctggcaagtgattttcctccagactcagcttatctagagtttcccaaaattcttccgctgc

SEQ ID NO: 655418 - DNA, 1282 bp, Homo sapiens
agcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaacctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaa

SEQ ID NO: 655419 - DNA, 1004 bp, Homo sapiens
tccccccctaaaattgtttgttttgggggggggggcggaagggggtgtggcttttttttcacaaaaaaaaaccccccaccctttttaacgggggaaaaaaaaacggggggcacacccggtgtgggccccccgagaggagggggggcctctctctttattagaagagaggtgggggggggcgacggccccgtgtgaggttggttggggccaagctgcggttgacaccccctcctcgttttaagtagtgggttggtattacaacaaaagaaagtgagactctctgtggtgggagaacccccccagcgatgctacgccgttggtgggatgtgttatcttttcctctttgcagcgagcgagaggtgttgtgtttagcgaccagcgtggctctctcgtttgggtagaaatatatatcctctctcgcgtcgggcgagccatcatctatgaggtggtttcttctctcttatcttctctcgcgcgcgcccgcggagggtctctttctagtgtgggacagagagagccactttacgagagtgttcctcgcgagcgcgggagtgactaggaagagagtgtgtctcgtggcgaccccagagggttctttattaacgagcgtgggggcggcgcccactgtttttcaagacgcgggtccgatctattgagggcgtgttggtatgatgaggacgcccctcctctctctctcgctcatcacagataggtggtggctgccccgaacagagacggagagagtgggtgtatctccccgctaattaaaccagcgcgggggggggccacactgaagtgagtggggacggaacaacagaacgatctgaataagcaaagcggggcccgcacgagaggtgaagacactatctccctacactactatgtgatgggaaaaacataccctgtctgaagtgagggatggagacacacaaccatgatgggcgcgccggtgagggggaacaacaccacacagtgtgtgggagagtcaattacaacgaagatgg

SEQ ID NO: 655420 - DNA, 636 bp, Homo sapiens
  misc_feature (366)..(366): n is a, c, g, or t
  misc_feature (387)..(387): n is a, c, g, or t
  misc_feature (492)..(492): n is a, c, g, or t
  misc_feature (506)..(506): n is a, c, g, or t
  misc_feature (587)..(587): n is a, c, g, or t
gcacgagcgcctgtttaccaaaaacatcacctctagcatcaccagtattaaaggcaccacctgcccaatgacacatgtttaacggccacaataccctaaccatacaaaggtgacataatcacttattccttaattagggacctatatgaatggctccacaagggttcaactatctcttacttttaaccagtaaaattgacctgcccatgaagaggcagacatgacacaacaagacgagaagaccctatggagctttaatttattaatgcaaacattacctaacaaacccacaggtcctaaactaccaaacctacattaaaaatttcagttggggcaaccttcagacagaacccaacctgcaaacantacatgctaaaacttcaccantcaaaacgaactactatactcaattgatccaataacttgaccaacggaacaagttacccttaggataacaacacaatcctattctaaagtccatatcaacaatanggtttacaacctcnatattggatcaagacatccccattgtgcaaccactattaaaggttcatttgattaacaattaaaatcctacgtgatctganttcaaacgcggataatcccttcatttctatctacttcttcgtcctttcc

SEQ ID NO: 655421 - DNA, 105 bp, Homo sapiens
accgagctctgtacagtatcaggtatctcaaaagacagggtggggcagatgtgcttgagactcaggaaattaagcagcagaagccctaagatgagacacctgact

SEQ ID NO: 655422 - DNA, 175 bp, Homo sapiens
agtggatggtcaatcatagctgtatgagcttgatctcccgagctcaagcaatccttctgagtagctgggtctatatgccattatttttttttggaaatggggatctcactctgtcacccaggtgggaggggagtagggggacctgggttcactggcaaccttcggcctcccaagg

SEQ ID NO: 655423 - DNA, 105 bp, Homo sapiens
tagttactctgagtatcccgctccaaccaccaaatggttaagcacacggaataaagtcccctcgatctatattcctgtgtgctttaaccctttgtggtttgcgtt

SEQ ID NO: 655424 - DNA, 175 bp, Homo sapiens
tgacccctgggttcacacaatgcagtgtcgtgtgctgttggccgcaaccacttcgtgtcactggcagctgcttttcatccttgtgacagcaggggctcctctcacagttgcacctgccagtgccttccctgcttgtgccactggcctgtctgttttccccacgtctgttgcactt

SEQ ID NO: 655425 - DNA, 328 bp, Homo sapiens
cccgccccccggggctccagcgctggaagaccctcgccctaggccctgcttctgaatcgctggttttaaaatgcgccaattcctgcactttgccgatttgggtggatcacgaggtcaggagatagagaccatcctggctaacatggtgaagccccgtctctactaaaaataacaaaaaattagccgggcgtggtggcgggtgcctatagtcccagctactcaggaggatgaggcaggagaatggcgtgaacccgggaggcacagcttgcagtgagctgagattgcgccgctacactccagcctgggcaacaaagcaagactctgtctc

SEQ ID NO: 655426 - DNA, 280 bp, Homo sapiens
tcacacgtacaccgctctcttttcttctcggtgcagactcttctgcgtgattaattatggctacacgatgacaggctgctttgggagctttccctttcccagcagctttgtagtagcccgatcgcaccacatacgaatatagggagcagcgcccagtcttagtatttagcacgcattcacccgtagtctgttcactagaccaaagtccacacatttgtcaaggagtaacacgttagggcagacagctctaggtatcctctttaaaggtgggtaaatagct

SEQ ID NO: 655427 - DNA, 242 bp, Homo sapiens
  misc_feature (133)..(133): n is a, c, g, or t
tagagttgtacatgtcggcgagttaggtatgatgggcagtgaggggcgatatgatcctaggctataatattcggagtatcgtagccggtaatgtaacaacggtacctctagaatatagctagcatgcgcaaanttaaagcgctgatatcgatcgcgcgcagatctgtcatgatgatcattgcacttggatccatatatagggcccgggttataattacctcaggtcgatgtcccatggccat

SEQ ID NO: 655428 - DNA, 230 bp, Homo sapiens
cccgtcaacgctgactatgtggatgctgaggaagtgtcgcgacaggaagagaggtggcgtgacctggtgcgatgctgaccgaatgtgatctcgtgacctgcgaagataggtggcgtgacctgtggcatactgaggaagtgtcggtgacaggaagaggggtggtgtcacctgtggatgctgaggaagggctggtgacaggaagaggggtggtcacatagttcagcgtctga

SEQ ID NO: 655429 - DNA, 516 bp, Homo sapiens
  misc_feature (58)..(58): n is a, c, g, or t
  misc_feature (355)..(355): n is a, c, g, or t
  misc_feature (358)..(358): n is a, c, g, or t
  misc_feature (361)..(361): n is a, c, g, or t
  misc_feature (370)..(370): n is a, c, g, or t
  misc_feature (372)..(372): n is a, c, g, or t
  misc_feature (417)..(417): n is a, c, g, or t
  misc_feature (425)..(425): n is a, c, g, or t
  misc_feature (430)..(430): n is a, c, g, or t
  misc_feature (437)..(437): n is a, c, g, or t
  misc_feature (501)..(501): n is a, c, g, or t
gctgtgtcactgaggcaaacaggaaaagtgattttggctaggcgtggttctcatctgngaaattccacagcgcaatgacaggcgacctctctcccacccactcaagacactgtcaggaatgtcttaagacctcaggagaccacttctttagcaagcaattttgttttttgtctttttttgagatggattctcactctgtcactcaggctggagtgcagtggcgcgatctccgctcactacaacctccgtttcctgggttcaagcgataatctcacctcagcctcttgagtagctgatactacaggcatgcgccaccacgcccggctaattcttgtatttttagtagagacagggnttnaanaggctgggntnaaaccccttgacctcaggtgatccgcccaccacagccacctgaantgctgggnatacngcgtttnctaccttccatcccctggcaaggaatacatttttaaaaattagtaagaaacatacacattcaanttttccaataaagaa

SEQ ID NO: 655430 - DNA, 511 bp, Homo sapiens
taggctcattctactgtcttctcgcagggctcttctatgaaacagttacaaacctacggccatgccaggcagtggcttcacacctgtaatcccagcactttggaatgctggggcaggaggatcacttgaggtcaggagctcgagaccagcctgggcgacaaaagcaagactccgtctccaaaaaaaaaaaaaactttgcattagtgtggtacattttgtaacaactgatgacccaataatgatccatttattataagctgggtgtggttacctgatgttctcagctactccaggtggggctcacttgagctcaggaattgaagttcaagcatgggcaacatagtgaaaccccatcgcaaaacaaacagagagatactttgttatttaactataactgtaacctcatgtctatagttaaaataaggttcccctgtatgtgttgtacagtcctgattttggacaaattatccaccataacagtatcatacagaatatttccactgccttaaaa

SEQ ID NO: 655431 - DNA, 117 bp, Homo sapiens
atctatatctcctagctcagagaaatccactgattccctctgtagcatcttcaggtaccatcttgacaaattcctctaaatccccaggggaagagtatgtaatagcgactccgtgga

SEQ ID NO: 655432 - DNA, 116 bp, Homo sapiens
ctcatcaaaataggaattgtagactgggtttatgttcgatgacaggatatcgatgaagggtttcgatgaagggtttgatgacagggtttcgatgaagggtttcgatgacaggcttt

SEQ ID NO: 655433 - DNA, 82 bp, Homo sapiens
gaactcagatgttatggttttgtaaatgtctgcaatcatggataggaataaaatcgcttatttgagagctttcattaaaaaa

SEQ ID NO: 655434 - DNA, 473 bp, Homo sapiens
tacttgtggcttaagatatacttccctataatgactttatccacagattcaaaaatgtacgtttatcttaaacaacttctgtgacattttaaaatgatgtggcttagaaaattgctaggtatctaagaatggctctattgatgatgtatagtgtagcacatgaagagcttgaatataatagatcgttttgaattgtgcaaatggaaagaacactccttctaaacaattatttccccgtcccttttattgacgtatacatacagaacagatatcatgtcgtaagtgtgtagctcccgtgagttactccaaagttggatatacctggttaagcaccaactgaatgaaaaaaacagaacactgcttcatatggagaagcccctcctgcccctcctggtcattgtcctttccatccctcccacaggtagtcactgagttctaataccacagagtcttttgactatctattgagcctt

SEQ ID NO: 655435 - DNA, 745 bp, Homo sapiens
  misc_feature (1)..(1): n is a, c, g, or t
ngggaacaggtcagattttgttatattctcgaggtagagccaatataatttgccagtgagtcagacacagggtgtgagagaaagacaggagtcaggggcactccagggcttttgaccactggacagtggcactgccctcagctgagatgggcagagttgcagtagacagagccgacttggaggatctacggagtgccgcattacaggtggcgctgggagtttcttttatgtccaaacataggtgcaggtgggcagttgcaggaggcccaaggacagggcagaggcccagtgcggaggtaaatttggtgtgatattgtgtttaaagccatgagactgaatgcgatcaatgagaggaaagacacgttgggtttgggccctgggcaccccagtttctgcaggttgaggtaatgaagatggcagagcaggcgctgccgcgtgttctgaagctggtgagaaaccgagctgcgtttctcccttgagagaggtgctagctcccgaacaatttgcccatgtgtcagcgtggtctggttcaacttgatgcttatctggttcctttgagcaatgagacgcctgtgcaagcgtgttaagcaccctactttagaagacctatataggcgtatattttccccaatcttgggctttcatatgtgggcaggcctggaacttggccatcacgttcccgcgataccatggctcggaaccggcaccttacctcacccaccacgcattcggtctcctccttgcc

SEQ ID NO: 655436 - DNA, 1049 bp, Homo sapiens
tgccctcatgtacgtaaattatactagcatttaccatctcagttctaggagtagtagtatatcgctcacacctcatatcctccctactatgcctagaaggaataagtactatcgcatgttcatgtatagctactctcataacccatcaaggaccacagctcccgctctatagccagagattgtgcctatgtgccatactaggtcttggccgcctgcagaagcacaggcgggttgggcactagcccacatactatgtctcaagtctcacaacacattagtggcctaagaactacagtacataaacgctaaaacctagctccaatgctaaagacgtaaatcgtcccaaacacattatagttcagctaaccaactgaacatggagcttatccaaaacaaccagcgtacatttggcaacttcacgcagaaacgaccacagccattaattattgtcagcaatcactcccttctaactaattgtttaacacaacatcaaaaacaacctattttagcctcgttccccgaacctattccttcaggaccacaataaacaatcacccatcataatacctagcgtactggattcctaacccttcataatcactggccagcccacgcacaacttattcagtgacacaactatcagggaaaaagaccgttaaggtgtcttataaggaagtgtgccgaagagactcccagtacttatacaaggttcagcccatgaacctacaagtcgtgatcgcgtgggacccacttattccgatgtagtacaccagggacaacgaccaacgtccgccgcagcgcgatacacgaagtggaaccacataggaagatgacaaccagcgctagatccgtccgacatggcaaatatcagacgcgtggccctccctctcctcctctcttttgtttgctcgtgagctaacaaacaagaaaacgcaactcgtagacgaggcgcgacaacgcacgagcgagagaaacatccgagcacgacgcacaacatccgcagacaaaccaggagagaacaagtcagcacaagagcgacagcagcgatg

SEQ ID NO: 655437 - DNA, 592 bp, Homo sapiens
  misc_feature (592)..(592): n is a, c, g, or t
tctcattctgtcttccaggctggagtccagtggcgcaatcttggctcactgatgcctcaaccttccaaactcaagtgatttttctgcctcagcctcctgagtagctgggactacaggtgtgagccactgcaccgggctaatattttttgagacaaagtctactacaaaactacaaaaactagccaggtgtggtggtacatgcctatagtcgcagctacttgggaggctgaggcaggaggatcccttgagcccaggaggtggaagttacagtgagcagagattgtgccactgcactccagcctagaagatagagggagactctgtctcaaacaaaaacaaaactagatgtgtcactgtacaggacacttaagattccttgacatcaaaaatgtttaagaatctggataagaacttaactaagataagacaaagaatattcctgtcctcaaggtggacagtcaaaagtgaggtcctaggtcttacttcagaccctctactgaatttcgtaactacaaatcagaaaaagctttttactttaccttgattttaataaggcaaggatttaaaaattcaactctacctaaagatttcn

SEQ ID NO: 655438 - DNA, 211 bp, Homo sapiens
ctatggcgacgataacaccttgcaaagatctatttgaaccctatcctaatggaaaccctagcagattctatgtgcatgccgtcgcaaatgtccgagcatggcctgttctggcccacaacgagtaagaatgtgagaagaagaggtcgttaccgcgagttgtctccggtcgagggccaatgttgggtgggggactcctcgtagacggtcgacc

SEQ ID NO: 655439 - DNA, 111 bp, Homo sapiens
aatatttaaagcacactcagcagcatattgttaataccgttgctaggtactatgtgcgacaaagagagataaacgacgtattctctacccttgagtttaataatcagattg

SEQ ID NO: 655440 - DNA, 336 bp, Homo sapiens
cctgtgcatgctcaggtctcacccagattaggatcctcccagccaccatactctaccccaagctggctgtggtggagcctgcattccctgagacaccccagcttccttggagtcctccttagccgggtcacatgactctcaggattcacatactcctgagcgttctcctcaggtctcttcgagccaggagacatgcagtacgagctgaacaggaacaacgtgacggatccgtcactctccgagatggtggtggtggccatccagatcctgcggaagaaacccaaaggattcttcttgctggtggaaggtagggaccccgggtctgatgagaggggg

SEQ ID NO: 655441 - DNA, 134 bp, Homo sapiens
cgtcacgcgtcgacgccatcccgagccaggatcgacacgccttgcaggcaactgtctgtagaccgtagccatcgctcgggcgttggtatcggcaggtaactggcctgcgcgaatgccacgttcgacgcaatgca

SEQ ID NO: 655442 - DNA, 3076 bp, Homo sapiens
tttttgtgttcaataagatttatttcctctcaacaccttgctgggttgggtttacttcaggaattaacagaactgttgtgggtttgttttgtgttgtgtttggagagagggtagacagcagtgggaaggggacgtaactgagaagcatgaaacaccttgagtggaccatgagacctgcttagagttaggggaaagcttgagaggttcaaggatagaagaactcagggtggttcaggtgtgacatgggttatgtgggcatttctggattgctctgggaaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacgttgtccccccttttccaatcacatggcattttaagaatgccggaaagggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctg

SEQ ID NO: 655443 - DNA, 1226 bp, Homo sapiens
ctgaattactcatagtcagaatcgtaaacatctattaacgcacaaagactcaggctgtgccttggggtccatgagaattcggcccaatagctattgctttctgtactttgcatccacagttcctcatccgtgaacattatcttcagattctgagacattcccgcaacagaaaccaaagaaagattagaccacagtcactggattccagttactaagaagcaaagttggacccaagcatcttgaaatgattctcagaaacaaaagttgaaataaggtagtttctgcaactctcaggcaacatgaaaataaaatttaccctcgtacatagccttgttctcacagtttctgggcattatgaacaatggggactgctttttcattcattcattcattcatcagtcaacatttataaatcatctactatgtgccaggagttataattgggacaagggataaagaggtgaaaaaaattcaaacttgtgaacctagcattatctggaacaaagtgtgttgatgtgcaggaacacataaggaaccatttgcagtaaagacaacaaaaaatgccaaactctgcctggacagtggtggaggactccttgcagtagaagtcatgttgaattgaagcctgagggaaaactcaccagaggaacaagggaagggagcccagagaggggcacgagcattccagacttagggaagatccaagcacagagctcgtgcactgctgcatggcccagttagagcaccacatacggccctggggaatgaggggaaatgaatcagatactcactaagtacccagcacttgacacaagttaccacttacaacgtgtgtatccattctgcaaggccggtattagtgtgcccattttgcagattaggtacctgaggctcaaaagagttcaggaatcaccccaggtggtgtagcttctgagagatggaggtgggattccagttccgggactgtgtgtcacttgcatacctgtgccttggtaccacagggggttgacacagaggtgggagatggggaggaagacttttcactagcgtatccttttctaccttttgaaattggaaccatggggaacagcaggagtctttggggatgataagagtcatggatgtgatctgggtagatatttttatatttggtgtcaaataacaaatgtccaaggagtgactgctgaatccaattttgcagtgatcctgattccattgtaaagaaa

SEQ ID NO: 655444 - DNA, 441 bp, Homo sapiens
ctggggcattcttgtaataacctaaggatctccaataaagcctcatttccaaaactgtcaccacctcccaaaacagctgcaccatctgcaaaccaagcgtccaaagacaagagcctgtgggggacatttacattgaaactgtaatatacactacgaagttcactttgtgcagccatcatgattatatatgtttagaacctttttatcaaaggcagcttgaacccattaagagcccttcctacacaactgccaacctgcctgttcttggtctctctagatttacttatgtctgttcttggtctctctagatttacttatgtatacttcataattaattggtgctatataatgtgtgccttttagggtcttatcttttcatttaggaaaacattttcaagatttagttatctcttagaatgaattgtgttgttctgtcgacgc

SEQ ID NO: 655445 - DNA, 1146 bp, Homo sapiens
tttttgtgttcaataagatttatttcctctcaacaccttgctgggttgggtttacttcaggaattaacagaactgttgtgggtttgttttgtgttgtgtttggagagagggtagacagcagtgggaaggggacgtaactgagaagcatgaaacaccttgagtggaccatgagacctgcttagagttaggggaaagcttgagaggttcaaggatagaagaactcagggtggttcaggtgtgacatgggttatgtgggcatttctggattgctctgggaaggtaaacaatcattataatattgttaccctggtaaaatgcaacttgaaatccaaataactaacttgcaaagcaacttttgaaatacaacccattccaactgaattcttaaatggggggcttcttatatgggaactcaggaagaaagagagatccccaggcagcatttggtgtggcactgggaaaacaaagataggtcaaaagcttaaagcatagaatgagttagagctggaagaacatttgtccctggggtctgaggcaggcatgacctgttgaaaaccccaggccagcagagacacctgtccagggctcgatagaaaacatttcttgcatttaaggacaggaggtttaagccactcgggctacgttgactcttcattctagaatcttgggacagcgtattcccttttaactcctggggagcccagggccttggtctgagtttagcttcctccagggaacccgggtggaaaggagagacaggtaagaactccgcagaggcagcgaagcctgggtttgaggaagcagagggaggagacctggatcagttacaaatgagttgttaagacccagggacaattctacgggctgggtatgaaagggaagtcggctcaggaggaccgagtgagggcaccgaggcgggacgcacgcacccggcgaaggtgcagtgtgggcgcccacggagtgggggagctgggaagaaagggggctgcggtgggctggagagaagcgggacggggaaggcgctcgggaagctgtccccgcggcgtcgtgcgctctggggacagaggaggggaggtctgggcgggcgggtggcgtgtgaccgccgaggctgcggcggctggaacaggtgagcggccgctgggttgc

SEQ ID NO: 655446 - DNA, 313 bp, Homo sapiens
ttcaacattcgtgtcccttccgattactgagcgcaatacatcatcttttcattattgcctcgacttggaggcatcgtacaggccatggtcctggcaataccatacaaaggccatgatctaaccatgatcgtgtcgttgccgaatgacatcgatggtctcccgaagcttgacgagaacctcactgctgagacattgatggaatggacaagttagcacaatatgagagaagacacgtgtcaatttcactcgttacctcggatctcaaacgtcggaagcgagctatgacctcgcggacacgtgacagaaatgttca

SEQ ID NO: 655447 - DNA, 522 bp, Homo sapiens
tttttcatgaacaatgactatatttttattttagcaagaaattcgtagctgatcgctgggactgaggaggcaagaagtgagtgattgggaaaatggattgattgccatggttcatacttgtctctttttctctctctttctctctcagcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattgtaagtgtacttttctttagacagtgtgatttcatatattaatatttcattatgcaacataatgctgccttactcttattcggcatttgactgctaatgatgtgcttgcaagcccatgttttatttgatccttgaaaaacggtgattaggttcaattatttcaaacttctgttccctcgtgcc

SEQ ID NO: 655448 - DNA, 5076 bp, Homo sapiens
  misc_feature (24)..(24): n is a, c, g, or t
  misc_feature (46)..(46): n is a, c, g, or t
  misc_feature (50)..(50): n is a, c, g, or t
ctgctccgcggctccccttgcttnggggtttgaactggctgctggntttnttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacgttgtccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctatgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaaatatgatttctttatcacttaagctttgggctgattaatatctgtgtggggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgcaaaaaaaaaaaa

SEQ ID NO: 655449 - DNA, 252 bp, Homo sapiens
ggaagtcagtaatatgttgtgattttaaggtagggggtgtggagctggaaggcttcttaacgggtgggcggctttaggcctactaggggtgtaaattttttactctctctacaaggttttttcctagtgtccaaagagccgttcctcttgggactaacagttaaatttacagggggatttagagggtccggggggcaaatttaaggtggacctaagattctatctggcacataagggggtagggtaccggag

SEQ ID NO: 655450 - DNA, 5181 bp, Homo sapiens
  misc_feature (24)..(24): n is a, c, g, or t
  misc_feature (46)..(46): n is a, c, g, or t
  misc_feature (50)..(50): n is a, c, g, or t
ctgctccgcggctccccttgcttnggggtttgaactggctgctggntttnttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacgttgtccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgctgtgtatttcccgtcacctcacctctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctatgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaaatatgatttctttatcacttaagctttgggctgattaatatctgtgtggggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgcaaaaaaaaaaaa

SEQ ID NO: 655451 - DNA, 301 bp, Homo sapiens
cgcatctctgctcgctccgagtagctggacgtagtgacacaacacactagctatttttatattttttttgtagggaaggttttgcatgtagccagggtggtgtaaacttcttacctcaggtggtccacctgtctcagcctcccaaagtgctgggattacaggtgggagccaccacccctggtcaaccatcataattacttcatttacatagtcactgttgaggagtatgttatttaaattctttgtaaatttatagtttctgaaatttctcttgatactgatttgtagttttattctgctg

SEQ ID NO: 655452 - DNA, 195 bp, Homo sapiens
acacgtatcatatcacacacactatcccacatatatctttcatcccatgaactgcgaaatccttccccgtaatcatgaccattgctaacaccatgtcgatggcttggtgatctaagaggatggctggaatcatgtgagactggtaaaaatccggggagaaaatgtttcaccttcagctcattcccaagtctctat

SEQ ID NO: 655453 - DNA, 5231 bp, Homo sapiens
  misc_feature (24)..(24): n is a, c, g, or t
  misc_feature (46)..(46): n is a, c, g, or t
  misc_feature (50)..(50): n is a, c, g, or t
ctgctccgcggctccccttgcttnggggtttgaactggctgctggntttnttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacgttgtccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacagccataggaatcacagatttgaggaactgaaggcgaccataatgaccatgtggtttgaattctcctggattccccgaagttgctgcaagccagcaagacttcatcctcctgactagtttcatctgtgttttctccagagtcacttggaggggaaaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctatgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaaatatgatttctttatcacttaagctttgggctgattaatatctgtgtggggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgcaaaaaaaaaaaa

SEQ ID NO: 655454 - DNA, 5200 bp, Homo sapiens
  misc_feature (24)..(24): n is a, c, g, or t
  misc_feature (46)..(46): n is a, c, g, or t
  misc_feature (50)..(50): n is a, c, g, or t
  misc_feature (1552)..(1552): n is a, c, g, or t
ctgctccgcggctccccttgcttnggggtttgaactggctgctggntttnttcccctcccctgtctcggtctctccttcttcttttaggttgctccaccccggtcaggatcaggcgagggggaaccagcctgagtgcagctgccaactcccgccgagtgcgtctgcgaactcccggagcggagtcccgcgtgccgccacctccccgcgggacgcactctcctcgctcccccgggccccgcgtcctccccccggccacccttccccacgttgtccccccttttccaatcacatggcattttaagaatgccggaaagatggcggtagcggcggcggcggcggcggctgggccggctggcgcgggaggcggccgggcgcagcggagcgggctgctggaagttttggtgcgggatcgctggcacaaagttctggtgaacttgagcgaggacgccctggttctgagcagcgaggagggcgctgcggcgtacaacggcatcgggaccgccaccaatggctcgttctgcaggggcgccggggctgggcacccgggcgcgggcggcgcgcagcccccggactcgcccgccggggtccgcaccgctttcaccgacctgcccgagcaggtgcccgagtccatctcgaaccagaagcgtggcgtgaaggtgctgaagcaggagctgggcgggctggggatcagcatcaaggggggcaaggagaacaagatgcccatcctcatcagcaagatcttcaaggggctggcggcggaccagacccaagccctgtacgtgggcgacgccatcctgtccgtgaacggagccgacctgcgggacgccacccacgacgaggcggtgcaggcgttgaagcgcgcgggcaaggaagtgctgctggaagtgaagtacatgcgagaagccacgccctatgtgaagaaaggatccccagtatccgagattgggtgggaaacacctccgcctgaatcccctcggttagggggcagcacctcagaccccccgtcatcgcagtccttctccttccacagagaccggaaaagcatccccctcaaaatgtgctacgtcactcggagtatggccttggccgaccctgagaacaggcagcttgaaatccactctccagatgctaagcacacggtgatcctaaggagcaaggactcagccacggcccaggcatggttcagtgccatccattccaacgttaatgacctgctgacccgagtgattgctgaggtcagagagcagctggggaaaacaggcattgctgggagccgagagattaggcatcttggctggcttgcagaaaaggtgccaggggagagcaagaaacagtggaaaccagccctggttgtgctgactgagaaagaccttttaatctatgacagcatgccacggaggaaggaagcctggttcagcccagttcacacataccctcttcttgccaccagcagatggagtctcactgtgtcacccagtctggagtgcagtggcatgatcttggctcactgcaacctccgcctcccaggttcaagcagttttctgcctcagnctcccaagtagctggaattacaggctggtccattcaggtccaggaaagggatcaccccaggctggtgtggatctgtcctttgcaacgcgaactggtaccaggcaagggattgaaacacatctcttcagagcagagaccagcagggacctctcccactggacaaggagcatagtacagggttgccacaattctgctgaactcattgctgaaatcagcactgcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctatgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaaatatgatttctttatcacttaagctttgggctgattaatatctgtgtggggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgcaaaaaaaaaaaa

SEQ ID NO: 655455 - DNA, 3467 bp, Homo sapiens
  misc_feature (1)..(1): n is a, c, g, or t
  misc_feature (30)..(30): n is a, c, g, or t
  misc_feature (35)..(36): n is a, c, g, or t
ntgtaggtgactgactctcttcctgaaccnccgcnncagcttgcacctacaaaaaccaggagtgccgtttgaccatacattatgagaatggattttctattaccactgaaccacaggagggtgcctttcccaagaccatcatacagtctccttatgaaaagctcaaaatgtcttcagatgatggaatcaggatgctgtatttagattttggaggcaaagatggagagattcaactggaccttcattcctgccccaagccaattgttttcatcattcattccttcctgtcagctaagattacaagactgggcttggtggcctgaagacaggggtgacttgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctatgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaaatatgatttctttatcacttaagctttgggctgattaatatctgtgtggggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgcaaaaaaaaaaaa

SEQ ID NO: 655456 - DNA, 142 bp, Homo sapiens
ctggaaggccgactttaaaggatcccccagagtccaaacagggccctctccctcctgctcgccctcctgctgcctcactgtcataagctcttggtgtatgaccttcacgcagccaggatcgacttccagatttggaggttga

SEQ ID NO: 655457 - DNA, 3344 bp, Homo sapiens
tttttcatgaacaatgactatatttttattttagcaagaaattcgtagctgatcgctgggactgaggaggcaagaagtgagtgattgggaaaatggattgattgccatggttcatacttgtctctttttctctctctttctctctcagcttgcacgtctcgtctcaatgcaagtagtccatgtgttgaaattcataatttcctgagatggtttctgcctttgagaaaagaagggctgcaatgccaccagagaacgtgatgtcagacaccatctgtagtgagcagcgcaccagatgtagcgtgctacagtcagctttagctctcaagagtcgtatgtaactgtcccagactcctctgtcagtttcagcaactacaagggataccctgcgaaagtaccatgagaaatatcagagtaaaactttctagaacagtacaaggttaaagaggtgaggtgacgggaaatacacagcatagctttgaaataatgacaaccaaggacatgaccattagaacagcatgtgcagatcttaatcatcccagttcctaggcaacttgttcaccaggtacgcaagggccgaatagttgagaaatggacattcttacctactcctcctagccccctatccccagtaacagtgatcccttttcttattgtgatttatttcctaattcttgctgagttgactttcccttgtaggaaaagaaaaatatttcaaatagaaacccaccttttatttaagtatgaagcagctgttactttttaaaaaatgaattatctttcaatggtgtagaatgattccaaagtgtctccattagcatatactgagcaggaattaaataaagcatcagatactgatctgagctgtaagctggtagaatctgagccaaagtagactgcttaaattgataagctttgctaaagagttgtatgcacaaaggatgattaattctgggactatactcacaccaaggtctgctgtcttatagccaagaattacagctttatttatagagagtgaattatgggtattttttcagaaaatattgtcatctgatatacacataaaacaactcacattgttggagttaactaattatccccatttcatggttttcagtggcaacttactgacccttgtttttgcctgtgcttgtatgcatgcattttcaagcaagtaataaagcagcctcatttaattctggataatgctgggttttacatatagactgaatgctataatcaaatctattgacagtatctgcagttctttcagaattccagggaaataatataacgacctgatatctttctacaggaatattttcagacattatatagcacattactgatttaatgcttttacttttatctttcaaaacaaattcactaaaaataacacctatgattttgaagtcacttttctcaaaccttgaaaatgagctctaggatctctataaacatttctaacacttttcctgtagtttacatagacagacatctgttgttagacctgtgtgtttttaaagaatcatatgttaacaaatacccatgcaaagagcttcaaaaagtgaaaccgtgttaaaggaacacaatttttctcactcagacatatttgtttattgaattgcaaagttttattttaaatcagcatttccccaaagaatatatcatatgacgctagttccaaggggcttgactgagtggtgttttgctggggggagacaggggtttgttaatacactttactaaatactgagctgaaaaatgttaaatagatttcacgattgcctccttgaagattttaaagttcattgtggttcttcaaggcgaaatccggtgaaccattcctcacacttacctacaggactcttttctaatggagcatcttgtgaagctagtgggtttttttgttgttgttatttgttttttttttttaatgctttagaaaacacagctttaggatattgactttttgtttatttctattttcaaatgctgaaaagtcaagtcccagtttgaataccatagaaaagctttgatgcatttgtaaattatattgcactctttcactatatattttcaaaatcactggaatgttgttatacaagagaattataattgtgtattgtaaataacatattaaaatacatatattaatgccaatagttaaattcaacaatatgtaatctaaggtgctcggttctacatgaagtatgagttaactgctcataattaagttgccaagattctattatatatttatagacaaattaaaatgatcataattacaaaatatgatttctttatcacttaagctttgggctgattaatatctgtgtggggggtcaatggaaactacattctctacatttataaacatttaatttaattatttatattttaggaaaatatatttgaataaaattaatgcattttctagagtaaattaaaatgttattagcaagaaatagaaaatttgactaagataattgtgtatatgaatcatttttcccccaagttaaaatgtatcataatagagaggctctaatgaatcaatttccaatactcatttctttcttattttgaattcaagttacaatgactttacactgtagattttaatcttgtctgatgtgtgctggtgtgtatgacacaaactcataagtctggatcatgcttgggtacagtcaatgaatcaaccgagtcactttgaggaatttgtttttgtccaatttgctctgtgctcaatcccatgaattattaaatttacaatgtttgtccccaaatgaaaaccaatataaatgaatgatgttttaatctgtactttatgggaagttgcctatttgtcagtagatgtggttaagtgagtcctctggtgcagtgacatccttttaagccatctcatagggatttaaagaaggccaataggaatatagatattggtttttctttctctgacttgaactaagtaggagaaaccaaaccataaacctattacaaactacccaggcagaggcatttacttaattcatcaactagtgcaattaaaaccctgaaaacacatgatccttgttgactctgcttggttgaagcaggaaagaatggtcttgatggtcagaaagttttaaaattaatgggcagggcctttctggaccctgttttccaaacacgttagatattccgtcttgaggggattggagtaggctacagtgagggggtaatttttggatgtatctggacttttaaaaaatgtgcctatatttatagcaccatgaatattatgtaaaatttatatatgaattaaataaatattcacctctgatttccagtgcaaaaaaaaaaaa

SEQ ID NO: 655458 - DNA, 443 bp, Homo sapiens
gggaactgttgacactcgggcccgttgagggggtttcttttgggcttttttcatgttttcttcacaaaccaaaatttgtttaactctcattgttagtatttctgggacaggttattacaggatttaaatttgaacctggctttctcacagctggacataattctaggaaaataatatactatgtccccacttgggcataatcatttagatggtggtgtacggcaaatctgttataaagactgttccgttttacccgccctgggcaggtcctctgctttgctgcaacagaaaggaaatgcccatgtctcagacttgtggatagtggccccccacgatccttgtaatcaattggcatgccgaaaggaaaactgacattagcttcctgaggcctccgcctgtgacatctcaagtttttgttaagtcaagaggtacacaatacccac

SEQ ID NO: 655459 - DNA, 637 bp, Homo sapiens
tgtcactcaggctggccggagtcccccgcaggatgctccacagggcaggcctaagccgcctaaggggctgcctcggctgtccatcagttacctcgtttccccgtcagggaaccaagaaacgtagcaggattagccgcagacaaaacttctcagacaccgagttgtagaaggaagggctttattcagctgggagcatcggcaagctactgcctcaaaatccgagctccccaaatgcacaatttctgtcccttttaagggctcacagcactaaagatttcacatgaaagggtcgtgattgatttgagcaagcagggggtacgtgacaggggctgcatgcgccggtggtcagagtgaaacagaacagggcagagagtttcacaatagtcttctatacaatgtctggaatctatgaataacatcggtttctaagttatgagttgatttttaactactgggtttaggccaggcaggcccaggcctggtttcggggctggtgccgggctgcctgtctttggttttacttccttgtttttctctcaaaacaggtaccgagtataaaacaatataaagcgatacgggagggtctctctcttccctcagagctgttatccccccagttcccttgtgcccacattac

SEQ ID NO: 655460 - DNA, 262 bp, Homo sapiens
cataccggaccttctccgtctacttgacacatcagtggtcagagagctcattgaggacgaagattccggaaagagccgttggtcgcccgaagagcccattggcgagcttctcatggttggtcgcaaagaacttatttgtcctcagtaactctcgcgtcgaccttcctgtatccccgtgaggcaggaccttctgcagatagtggcaacatcttggcggcttgcgtgtgcgcaatggcattggtgtggcccgaggtgttctcga

SEQ ID NO: 655461 - DNA, 352 bp, Homo sapiens
  misc_feature (352)..(352): n is a, c, g, or t
ctgaagcgccacttgtcagagacacagagctgtagctccgcctggagtggcagcaaaggcccgctggatcagctagagaaaggaggggaaactgctcagtctgcagatccccagtgggagcagttgaataacatcctgagcatgcctcttctgactgccgacttccacaaggaagacaccgctgccaacgactggactccagagggtgaggaggacgacgactatctggacctggagaagatattcagtgaagacgacgactacatcgacatcgtcgacagtctgacagtctacccgacagactctgacgtgagtgctgagcacgtacttcagctatatcatggcggccgcn

SEQ ID NO: 655462 - DNA, 661 bp, Homo sapiens
atacatatgtgtgtatatatacgtatgtatgtatacatatgtgtgtatatatacgtatgtatgtatacatatgtgtgtatatatacgtatgtatgtatacatatgtgtgtatatatacgtatgtatgtatacatatatgtgtatatatacgtgtgtatgtatacatatatgtgtatatatacgtgtgtatgtatacatatatgtgtatatatacgtgtgtatgtatacatatatgtgtatatatacgtgtgtatgtatacatatatgtgtatatatacgtgtgtatgtatacatatgtgtgtatatatacgtgtgtatatatatacacatatatacgtatatatgtatatatatatacacagtgaatcaggggattaatactataatctctggttcaaaggtaatatggaatatttgacacttgtgtaaaaggtgaactacctttgtagtgaatcttttcctcttggtagcatcaacactggggataaatcagaaccattctgtggaaatgacatgtttctcaagagcctataatatagtagatagtgcatattaaggatgtctggtggggatggtggtcatgcctgtaatccagcatttgggaggctgaggcggggaggatcctgagcctagaaagtagaagactacctggcgggacctg

SEQ ID NO: 655463 - DNA, 1044 bp, Homo sapiens
atgcggctaagggattttcctgggatgagagcgggttctgcctatcattttggatgcacatcccgcttaagccccggacagccttatggtaccggctacgtgtccctggggattctcggatctccgaggacaccggtacagggacgcgctatgagaccatacctactctaccgagcagaaggagacagacgtatatgctttccaagtgcacaactacagacacgcgcgcgcacacacgcaagcacacgcggcgagagaggaaccttgccggtccgaggcagctctgcgcgtcccctcctgcgctatagcatcctacggacccagacgcggcccgacaccgaacatggaggtgctggagagacggggagcagggcgtgctagcagtagggaccgcaagctgagacgagctgtcagagacccggaggacggcgaggccctcatagtaccacacgcacttctcagaacttctggatgagtatacccagaacgtctatagggtacagctcctgaatgatcctttcctctcagagaagagtgtgtcaataggagagtggaaccttccccgacgtacccggagacaatctcatccaggctgagcacaagctactccctgttgcgcggaggctcagggccaagtcgccttcaccacataaccagtgacaagcttcgatgaccgatgcaggtggcaagttgaaaatgcgtcaatgttctaacgactttcctatcagtccatcaagacagcaccaattacagagaaccaagcccagcatacatcacgactgtcctccgtacatcccacgccacctgaacctgagtgtacaaggcggaacctcgtctggcacatccacaagaggtgcacacagaacgaaccagtactcaaagagacgcgatctgtacgtgccaacgcagacgcacagaaagcagtgacctacatggacagttcgaagagcaagacgtggaaaaaaaccgaaaggactacacgcgtaagacaagcggaacgacaataaagcaaacacaagagaaaggatagagagcaacgagaag

SEQ ID NO: 655464 - DNA, 419 bp, Homo sapiens
atgtacagctagtgcgcaagtgtgtttggaggagggtctgactctgctaacgggagaaaaaattccccgaagctgacactcatccagtgcccagtggtacagtcatgcctgtgtttaaaatactgcagtgctgtcacaacggttgtggtgtatgtggctctgagggttcacacgccgagctctctccacatcgtatctgccattccagcccacgtccttcccagcagaaggcctcggaaaacatgcattctagttctgatcactcagtgcccattcctccctaattgctgaatattttgaatatcaccctggatatcaaagttgtgaatatagatttggagcttgatgtaaaagaagctagggaagcccatgtctctgattttcaggcactcgcatgttaaaaatcacctgctggaaag

SEQ ID NO: 655465 - DNA, 192 bp, Homo sapiens
ctcgacttctacatacctggactactatagggtgatagataggtccaattgggtgtagaggagttcagttatatgtttgggatattaaggtagtaggtgttgagcttgaacgctttcttaatataggtggctagcatttaggcctactatgggtgtaaaattttttactctctctacaaggtaaaatcctag

SEQ ID NO: 655466 - DNA, 643 bp, Homo sapiens
  misc_feature (533)..(533): n is a, c, g, or t
ggagtgcggtggtgcaatctcagctcactgcaatctccacctcctgggttcaagaggttctcctgcctcagcctcctgagtagccggggagctacaagcatgcaccaccacacccagctaattttttttttttttttggaagaggagtctcgctctggtcgcccaggtttgatgtgcagtgggcgcgatctcggctcactggcaagctctggtctccggggttcatggccattctcctggcttcagcctcccgagtagtcccaggatgtagctggggactacggtgtgcccaccaccacacccagctaattttttggtattttacagtagagatggggtttcaccagtgtttatccaggagtggtttggatctccgtgacctcgtgatccgcccgccttggcctcccaaaagtgcgtgggattataggcgtgagccaccgcccgggcaaattttggattttcagtagcagatggggtttcaccgtgtttggccaggagggtctcaatctgaccttgtgatctggccacctcgngctcccaaagtgctaggattaacgggcgtgagccaccattcctagccttatgcatattcttaaatatcccacggtcgcatttgtttgaccatccgcttggggctctaata

SEQ ID NO: 655467 - DNA, 325 bp, Homo sapiens
catctacgtatcgtattcacccagtccagtccatcacatccatgcatgcatctacctaccaacccatcgattcacccatacatccatctcatgcatgccatcaatccatccatccatccagctacctagccatcatctaccatctattcaagcatccatcacatccatacatccatctatccatccactcatctatctacgtacccatcatctaccatctattcacccatccctccatccatctcatccatgcatccatctatccatccattcatctacctacctacccgtcatctaacatctattcagctatccatccatctca

SEQ ID NO: 655468 - DNA, 295 bp, Homo sapiens
  misc_feature (91)..(91): n is a, c, g, or t
  misc_feature (159)..(159): n is a, c, g, or t
aggttgggtgtggtggctcacgccctcttaatcatgacacttgggcgcagaggcgggaggatttcttgaggacaggggattcaagaccagnccgggtaacatggcagggccccatctctactaaaaataaaaaaactaacagggcacaagtggtccaangcctgtagtcccagccacttaggaggctggagcagaaggattgctttggcccagtagatcgaggctacattgagccatcattgtactccactgcactccagtctgggcaacaaagtgagaccctgtcttaaaaaat

SEQ ID NO: 655469 - DNA, 455 bp, Homo sapiens
  misc_feature (45)..(45): n is a, c, g, or t
  misc_feature (64)..(64): n is a, c, g, or t
  misc_feature (93)..(93): n is a, c, g, or t
  misc_feature (102)..(102): n is a, c, g, or t
  misc_feature (107)..(107): n is a, c, g, or t
  misc_feature (114)..(114): n is a, c, g, or t
  misc_feature (177)..(177): n is a, c, g, or t
  misc_feature (208)..(208): n is a, c, g, or t
ggccctgaaagctggtaaaaaattgggcccccgaaagctggtaanaattgggccccccttcccnaagtcaaatgggctgggaaactgaaaagnaagctgggnaatgnaaggggnacccaatgtccccgaaagctgcaataagaagcaaggggggccccctggccctggccccccagnaaacccatttttcctctccctagggcccccnaggcctgtgaattgggaggggctgctgtgaaaggtctctgacatacccctggagacattttcacccattgtcttggcaattaacattttgctccttgttacataggcaaatttctgcaagaggctcaaatttctccccagaaaatgaggttttcttttctatcatattgtcaggctgcaaattttccaaattttatgctctacttcctcttgaatctttgcctcttagaaatttttcccccagagtg

SEQ ID NO: 655470 - DNA, 782 bp, Homo sapiens
gctgcacacagatcagagggccaaccacgaaggctcgtggccttcccatggcacacgccaggcccccatatggtccctcgactcacgggtggcggcggaagacaagtgcagcacgtgcgaacatagactgaggcagatagcgcgacaatgatattgcacaagtacccattcactaaaagctataccaagacccatgcatcaacactgcacacacgtagactgcagacatgagaaggaacacagacaaacagaacgacaattaaaacatcagaacaccacaaggaccccgagcacgacacaagagaacacatgaaaagaaagacaagcaaaaagcaagagaaaacacacgaagcacaggagaggaccgcaagcacaacacaagaaaacaacccagacacacagggcgcaacacagacaaccaaccaaatgacaacacgcaaacgagagcataacccgcacaaaaaccacaacaccacaagagacacagaagcaccggacaccacaaacgcaacatagcaagacgcaccacacacaagagctagaaaacaggaaaaaccaccccacaacacagagaaccgagcccacgcggacgcaacaagacacaacagcaaaacgcaaaactaaacaacacacgaaaaatccaccctcacagcacacagaacagaacccactagaagacaaacgccgcgataaacaaacgaaaagaacgagacaacacacaaacaaatcacacgcagcagccaagacgaaaacacaacacaaaccgatgaccaacacgcaag

SEQ ID NO: 655471 - DNA, 228 bp, Homo sapiens
  misc_feature (191)..(191): n is a, c, g, or t
  misc_feature (226)..(226): n is a, c, g, or t
gaggatccctgcactgttgttcatacctgcactgttgttcatacctgcactgttgttcatacctgcactgttgttcatacctgcactgttgttcatacctgcactgttgttcatacctgcactgttgttcatacctgcactgttgttcatacctgcactgttgttcatacctggtcgctgtatcggggggngtgggggtatgaacaacagtgcagggatcctctanag

SEQ ID NO: 655472 - DNA, 528 bp, Homo sapiens
tcctgttatttaggatttctgacaaagctggcttgagaagggtgggaagaaaggatatgattatttcttatgccattatccataagaggtgagaatgacaaggagctcttacgtaactgctcttgatggtgtaagaagggaggagatgcgacgaacgggcatgagcaagagacagcagaggacgacacagcagaggaccgacgagagtgatcacaaaggacaacaagaaataagcaaataaggacgacgcaataatcatagcagcgacaggcacgtaaaaccacgaatacacaccagaccaggaacaagggagcagaaagaaagcaatgcgagagctatgaacaaggaggaagcacaagaacgacagtgaagaaaaacttggaaacaagaacggcagaagaggcacgcgaaacgaagcagaaacacaagaaacaagacaaagaagatgacgacacacgctaaacaaacaacaaagaaacagaaaaacaaaacggcaaagcagagcgaaaacaaaaacacaaaagaaga

SEQ ID NO: 655473 - DNA, 336 bp, Homo sapiens
gaccagaagggaccagaagggcagctgcaggctgcacaagcagccagcgcctgtcaggggcgtcccgacaagaaggccgagtggagacagccgggggcgtgtgtgtgcgactcgaagagcacggggcctggccccaccccctggggaacaaccaagggccccacccaccgccggaacaaggcccactgtttgaggaggacacagagggccgaggtccccggcctctgagctcacactgaggccactcctaggtgtctcctaacagcctgccaggtgttcccagcaaccctacaacagcttctcctgacacagggctgcctgggagagcagcataca

SEQ ID NO: 655474 - DNA, 225 bp, Homo sapiens
  misc_feature (188)..(188): n is a, c, g, or t
gaggatccctgcactgttgttcatacctgcactgttgttcatacctgcactgttgttcatacctgcactgttgttcatacctgcactgttgttcatacctgcactgttgttcatacctgcactgttgttcatacctgcactgttgttcatacctgcactgttgttcataccccccccgagtgttacancccccccgataagcgaccaggtatgaacaacagtgca

SEQ ID NO: 655475 - DNA, 404 bp, Homo sapiens
  misc_feature (4)..(4): n is a, c, g, or t
  misc_feature (17)..(17): n is a, c, g, or t
  misc_feature (261)..(261): n is a, c, g, or t
  misc_feature (393)..(393): n is a, c, g, or t
  misc_feature (396)..(396): n is a, c, g, or t
  misc_feature (399)..(399): n is a, c, g, or t
  misc_feature (402)..(402): n is a, c, g, or t
attnagcaacctgggtncaatgttactaattgtccaaactattttttttgcctataaaacacatttacacacaatcttgtgtagaaaccccactatataaaacagacaagggcccaggtgcagtgtctcttgccccataatcccagcactttgggaggctgaggcaggaggattgcttgaaactagatgtttgagactagcctgggcaacatggggagaccccacgtctaaaatcatacgaaaattagctgagtgtggtgncgcatgcctgtagtcccagctactcaggaggctgaggcaggacgattacttgatcccaggaggtcgaggctgcagtgagctgtgatggagccattgcactccagtctagatgacagagtgagaccctgtcantantanatnaa

SEQ ID NO: 655476 - DNA, 381 bp, Homo sapiens
gtgaacacagcttggcaatctcttaaccatgggagtcaagtctcagaggtttattgatggaagtggttcatacttctaactgtctttactacgattcttgaatttcacatagttcataagtctgcatctgactacattactctctgtatctgtggaaacttcagactctcccctattactctaattctagtgagacattatctataagtgggcttacacattccggttgctttactgacacatgatacacagacttgaaggcttttttctgcttactatgctacctctacatgttcaacactttcctgatttcgtgatttgaggccgtgtaataacttactgacgctccattgagaccgcatattcgggacactgcgtctg

SEQ ID NO: 655477 - DNA, 551 bp, Homo sapiens
gaggatccctgcactgttgttcatacctgcactgttgttcatacctgcactgttgttcatacctgcactgttgttcatacctgcactgttgttcatacctgcactgttgttcatacctgcactgttgttcatacctgcactgttgttcatacctgcactgttgttcataccactgtactccaggctgagtgattctgtctcaaagaaaaaaaaaaaaccaaaaactataaaaatacaaaaattagccaggcctgatggtgcatgccttaaatcccagctactcaggaggaggtatgacaaattgcttgagcctgggaggtgaaggttgctgcgatcctcctgcctcagcctcctaagtaactggggttacaggctcccatcaccgtgccccgaataatttacgtattataagaaaagacggggtttcactatgtaggacaggatgatcttgaactcctgaactcatgaacctgccaaacttgacctctcacagtgctgaaataacaggcgtaagccattgcgcccggaaactatattatcctaaaaaataa

SEQ ID NO: 655478 - DNA, 698 bp, Homo sapiens
gtgagaacagaggcacaggtgccggccctgcagcccccagaacctggactggagggggccatggggcaccggaccctggtcctgccctgggtgctgctgaccttgtgtgtcactgcggggaccccggaggtgtgggttcaagttcggatggaggccaccgagctctcgtccttcaccatccgttgtgggttcctggggtctggctccatctccctggtgactgtgagctgggggggccccgacggtgctggggggaccacgctggctgtgttgcacccagaacgtggggcccaaatttccccccgggggcccaaaattgggggccccccgtgccctcggccagggcccggctgggaaacccagagccagccattctctctcatcctggaaggctctggggccagcagcccctgcgccaacaccaccttctgctgcaagtttgcgtccttcccaggctgctcttcacgtcccttatgccactatcaacaccagctgccgcccagctactttggacacagctcacccccatggggggccgtcctggtgggcgtcactccccaccacgctgcacaccggccccaggccctgccgctgggctccaaccatccctgcacgtggcagctttgtctctgttgagaatggactctacgctcaggcaggggagagggctcctcacactggtcccggcctcactcttt

SEQ ID NO: 655479 - DNA, 225 bp, Homo sapiens
gaggatccctgcactgttgttcatacctgcactgttgttcatacctgcactgttgttcatacctgcactgttgttcatacctgcactgttgttcatacctgcactgttgttcatacctgcactgttgttcatacctgcactgttgttcatacctgcactgttgttcatacctgtcgctgtatcgggggggctgtggtatgaccgggaccctcagaacagccacac

SEQ ID NO: 655480 - DNA, 312 bp, Homo sapiens
ttcccagtattgcacttttgccttccccatcttcctgtctgcccttcgtggcctagtcttgtggattctagcagcagtgggactattatgccagaagagagaatgaccgagatagagagagagacagagacagagatgcgagaccgttatctgcgtacagctaaatgagaacgcaccagagcgagagagagggacgcgtgatcactgtcctacaccaagtgtcttcaacggcgatgaagaacgatacagatactgggaatatgcagaaagaggttataagcgtcacagagcacgtcgagaaaaagaagaacg

SEQ ID NO: 655481 - DNA, 257 bp, Homo sapiens
gaggatccctgcactgttgttcatacctgcactgttgttcatacctgcactgttgttcatacctgcactgttgttcatacctgcactgttgttcatacctgcactgttgttcatacctgcactgttgttcatacctgcactgttgttcatacctgcactgttgttcatacctggtcgctgtatcgggggtgcgtcgggtctgtcgagagcgccagctatcctgagggtatgaacaacagtgggatcctctagaacag

SEQ ID NO: 655482 - DNA, 361 bp, Homo sapiens
agtcatctgtacttctgctgcgcagccagtgtgaggagtgcggatgcgtatcttcacgtgccaggtgacgacacagctcagataagaggactgcagatgtcttgtacacttgcgcatcagcgcgaggtggaggtggtggagattgttgaaaacgacatatctgctttcacctacgagaagaacactatgatggagcagaggtcggagatgctgaagcagatgcaggtgtccaagaacgagcaggagcgagaggcccagctgatccacgacaggaacaccgcgtcccacacctgcggcggcagccaggaaccaagcgccggctaagccttcccaaagcacagcgcctgtcccaagcacaggc

SEQ ID NO: 655483 - DNA, 241 bp, Homo sapiens
gaggatccctgcactgttgttcatacctgcactgttgttcatacctgcactgttgttcatacctgcactgttgttcatacctgcactgttgttcatacctgcactgttgttcatacctgcactgttgttcatacctgcactgttgttcatacctgcactgttgttcatacctggtcgctgtatccgggggggctgtacacctcggggggggtatgacaccgttgtcgggatcctctagaac

SEQ ID NO: 655484 - DNA, 338 bp, Homo sapiens
ttccccccctcctttttttccccggggtttgccttccgggggttttccccccggggcctttttgcccctaggggatttttgttcctttccaaggttttgggttttcctggccccttgggcggtttaagaaaagggggcttctggatttgggcccccccttgggggccttttcttcctggggaatgggttctaaaccccttgtaacccgcccttttgttggggtgggggttggggtttttgggggggggcccttttttgcctttccatttttttgggggtggttggtccggggggcccccggtttgggggcccccccgaattaaaggattttagaaata

SEQ ID NO: 655485 - DNA, 307 bp, Homo sapiens
tcactattatgaaatcctgtgactgaagttcccctcgagtgcactctgtggttgcacatgcgccgaccacacaaactctggcatggaaacatgaactaatgcaaaccagtgctacccagaagcaccaacacgtgtgttctccattccaccaatcacagaccagtatctactccaaacatccagtaacgaaaactatggcatcttcccaggaacagcaaggcaggcttcttactcacgatgaaccagcacgaataaacccagcaaaaagagaactgcatacttaaatttaggatagtcattcatgagg

SEQ ID NO: 655486 - DNA, 89 bp, Homo sapiens
aaaaggaacaagaaagaagattgcagcaggcagtgttaagcagacagatgccgtctgaaagcttggacccagcgttcagtcctcggatg

SEQ ID NO: 655487 - DNA, 242 bp, Homo sapiens
tggccaggctctctacgctgggccggtctccatggtcggcctggctttttgaactggcacacgtgggcgacaaagaaaaggggaaggagggaacttccaggtggaatatccgctgggcttccaggtatcccttttctatggggccacagcggtcagcatttacctaatgcaagctttaagctggcttaatctatggtgggcagctggatttggcaggcggctttctggacaaaaaagaaatg

SEQ ID NO: 655488 - DNA, 675 bp, Homo sapiens
tggagactccatctcagaaaaaaagaaaaaaagacggggtacagatgtgatatgggaagaaaaagatcaagctgatgaggttaggatacccaggcccttgggacttaaagatcactagtgtctaaattccatcgagtggcattctcagtctataggtaaacttccgtggaagctggattgggagacagttttatcatctgatatatggggcttctcgttataggtccttagggagcagcttacctgaaagtgcttttagctgttacaccagtcgtgtaaacttcaaccgtgtaatgaaagctgtacctaaagtgtcacatgtgagttgagtgtgactaagtgctgatataataagaaaatatatatcggatcttcctatctagtccctgtgttcagagctcctgaaaccctgtgtaattctccaacagtgatggagtacatctttggtcctagtattgggtcttggaccccagttccgtgacacaaagctcctaaattcctttaatattccccagctgataaggagaatttcgcgtcctaatgaggtcacctctttgatgggcccctggataacctcaggattggggggctcgtccacaaaggaccacttcttgatgtggcagttttcaaaactttccagttctccccaccttccagaagaaggggaaaacgggc

SEQ ID NO: 655489 - DNA, 162 bp, Homo sapiens
  misc_feature (88)..(88): n is a, c, g, or t
  misc_feature (139)..(139): n is a, c, g, or t
ggaggctcagagagtaacagagcagcctctagagaccagcctgtgcacctctcaccaactgcgctcctcatccccgtgccatccccanacttctattctcctggctcctccgaaagcccatggcttcccgttctctcgncctccgcagttttccatgtgatc

SEQ ID NO: 655490 - DNA, 420 bp, Homo sapiens
  misc_feature (53)..(53): n is a, c, g, or t
tgtttttgtttttataacatgtatgaaactgacatcttctcaaatcttgttcntccggctcttgatgtgtccatcgtccagcgctgctatggacaccacacgtatgccaggcccccccccgcagtccagtctgattctggggtatgcccatgctgtgggaaagaatagggaggcctcccaaatgtatgcgaattgtccccattccgtgggggcacctggcaatgacccgggtggagatggggcatggaggagtaggaagacccagccctatttgactggggagaggaggatctggagtccttcatgcccaggtctggaacccaggttctgaccccagggccccaccctgggctggacaatcagatcccaaaggaatgccaaaggggactcggttgtgagagccgcttaggggccagacct

SEQ ID NO: 655491 - DNA, 176 bp, Homo sapiens
tagaatttgtatctaacaggataaaataactacatctagcttcctctcagtgacattctctccaagatcagctacaggagctcactcctccccaccaagctgtctagcagccagacgtggagcttgctgtaacacacacgtactgattgtagagtgcagactgaaatgtcttcact

SEQ ID NO: 655492 - DNA, 863 bp, Homo sapiens
  misc_feature (104)..(104): n is a, c, g, or t
ggtctgatgttgcaggctgcttcgcgaacgatcgatgcttgcaacgtggctggatcggccgaggcgcgcaatggacggatcgcgagcacgacgcacccgtgcgntcgtgctcgctccgttgcccttcgcaggaagaaggagccgcgccgacgcggggagtccgcgggacgaccacgaacaagtcgtcaccatcgtgccgatcagttgcggcagatgggcctaggtgcagtcgcgaacccagagccgagggaaggtcagtggtaggaagccgcacgcagaggtgccacgacgagaggagcgccggcgttggcactcgtcgacgctggttccagtgccgccggttgctcgcgacggtagcaggagcgagtaacgccagggtctgcggccaggcccttttctatcgagagcacgctggcagtgcccattgtgtacatcccggagatgctagacacagagacatttggccagaaagccaccgcagtttttgactgggcttcggaggttgacactggaaccgagacagcaagcacgatgcgtggtcttgttcttgtattacccttgtggctaccctggcagcaccaagctgcagggtcttgcattgtgaccaagcaatcttcctgtgaactcacactggactcttgtgagtggccttgtgccctacgtgccggcttggaccattgtggacttgtagcaacgcttagagtcctatcgtagtagtgccatggaacccttggacctggcgacgaccttgcagtcccacagacaacctgtacagggcgtgcgtggaggtcccgcagcgctgtccttgtgtctggccttaccaccctcacgcagcccttccaacgtcgccagggctgtaacag

SEQ ID NO: 655493 - DNA, 290 bp, Homo sapiens
  misc_feature (21)..(21): n is a, c, g, or t
  misc_feature (30)..(30): n is a, c, g, or t
  misc_feature (38)..(38): n is a, c, g, or t
  misc_feature (44)..(44): n is a, c, g, or t
  misc_feature (54)..(54): n is a, c, g, or t
  misc_feature (59)..(59): n is a, c, g, or t
  misc_feature (63)..(63): n is a, c, g, or t
  misc_feature (79)..(79): n is a, c, g, or t
  misc_feature (95)..(95): n is a, c, g, or t
  misc_feature (127)..(127): n is a, c, g, or t
  misc_feature (139)..(139): n is a, c, g, or t
  misc_feature (146)..(147): n is a, c, g, or t
  misc_feature (149)..(156): n is a, c, g, or t
  misc_feature (158)..(159): n is a, c, g, or t
  misc_feature (175)..(176): n is a, c, g, or t
  misc_feature (186)..(186): n is a, c, g, or t
  misc_feature (192)..(192): n is a, c, g, or t
  misc_feature (255)..(255): n is a, c, g, or t
gggcgagggagtcagcgaccncaaggtgancgggttgngtaggncagggcaggnctgcncagnccactgggcagtgggncacgagtgggcgagcnccgggggtgtggcagggcgggagaaactggcncggacctgggtncacgagnntnnnnnnnntnnccaaggaacttgtgtnngggggctccnggagancggcatttatgtggggaggggagacgaaattatcgccccttccccaaccatttttagttgtgnccgccgcccagaagctgtgctggcggggggggatt

SEQ ID NO: 655494 - DNA, 787 bp, Homo sapiens
tctttataaagtgaacaaggcagctgatgtggtggctcatgtctgtaatcctagcactttgggaggaaggagttcaaggccagcctggtctacatggcgaaaccccacctctacaaaaaaaaaaaaaaacttagttcagtttttggtggaacttccctgtggccccagcttactcgggaaggctgaggtggagaggactcactttgaccccagggaaattggaggctgcagtagacgctattagatgggccccatcttgcacttccagccttgggcaaccgggaggcaagaacccttgtcttcaaaattaaaattaattaaatttgggctgcgccacaggtgggcttcacggccttgtaattcccaggcacttttggcggaggcgccaacggtgggcgcaggattcaccttgaggcgccaggagaatttcagagagacacagcccggggccaacattgggcagaaacccgggttctctactaagggaattacaaaaaattacgctagggtcgtgagtaggagcgccggcgccgtgtaaattcccagcttacttgggagacgcgcttaaggggcacagagggcactcaccttttgaaacccccagtagaacgcaagaaggtttggtaggaaagaaggcccaaagtatctccccaaccactgtgggattttcccaggccctggggggccaatctaggaagccaaaagaaactccttgttcttcattaacagtaactgtacactacaaattcggacgagcaggacaatataatttttgcacacagctaat

SEQ ID NO: 655495 - DNA, 187 bp, Homo sapiens
agggcatcagatgcttttgaactgcaggtatgggtagtgagcaagggcacccaccagcacatacaaacatacaaattaagtttgtatgttaaaagcttggggataaggtcatccagaaaggaaaaatcctggcccagcttctccacaatcagaagctgagtaacacgtcgacgcggccgcgaattta

SEQ ID NO: 655496 - DNA, 265 bp, Homo sapiens
ttttttttttcccccccaaaaagggggggtccccttggggggcgcccaaataaattagggcaaaggcttgtttgaaacccccccccccccttttgggtttggggcccccccggggggaaaaaaaaagggggggttccaaaaaaaaaaaagccccgccaaatttttttaaacaggggtttttttttttttttttggggggggcccccgtttttttttcccccccttaggggggtacccaaaaaagggtttttgttttggtttttta

SEQ ID NO: 655497 - DNA, 172 bp, Homo sapiens
ggtttttttttttaaaaaattccccccccccccctcctttccccaaaaggggggggttgttccaggccccccaggggggtaatgtggggccccttaggaggggggccccagcccctttttcttgtgaaggggggaaaaaccccccaaaaaaggccctttggggtttttttta

SEQ ID NO: 655498 - DNA, 116 bp, Homo sapiens
gcccagcgcctttcatcaatcgcccacatcactcgagacgtacattatggctgaatcatccgctaccttcacgcccatggcgcctcatcatctttatcttcctcttctttctcacc

SEQ ID NO: 655499 - DNA, 253 bp, Homo sapiens
  misc_feature (131)..(131): n is a, c, g, or t
ctcggatacacatatgatcaccgaacatatattgatgaagtagcacataagacacccataaaagtagagatacatctgccgttcacacagagaggacttaaagtatacactgacttgtcctgagtttctcngctctagaactgatgacagaaacatgtaccgaggtcattctgctagcttctgctttctaccggaattttgcccaagttaattttttccctctcaattacttacaaaagtcggtggttttcta

SEQ ID NO: 655500 - DNA, 244 bp, Homo sapiens
cattacctcatttactctgagagctccggatgtcttctttggacaagaaaaagcgaaacgtgaggtgccatcatcttgtgtggctcatcctaacattacaagactttgagggcgtgtcttaacctctagaccctccctcttctattcaggatacaatcagaagggaacctttcaccaagctctcccaggggtcagatcacagaatgtgacctgaaatgtcagccaattcccatctcccttaagc

SEQ ID NO: 655501 - DNA, 494 bp, Homo sapiens
agtgaacagcagcggagtcctgaagctctgcatgggctaacatgaattgtatagtgctgccgcaggacgcctgcacaccatcgaggtgcgagcagatgaagtgcccatgcccgggaggagaagcatcagaagcagcgtggcgcggcaacagctggaaacagagaagaaaaggagagaaatcgtggagagagagaaagagcagatgatgcgcgagaagtgaggagttgatgctgtggctgcaggactatgaggagaagacaaagaaggcagtgagagagctctcggagcagattcagagtggccctgcagatggaggaggagatggaagcgggcacaggaggagtggcgagctgcctagatgtgttgaccgtatggctgaactgcgggctaaggaggagctggagagacaggcggtggatcagataaagagccatgagcagttggctgtggaagcttgaagaatacactgccaagatttgcctcctggaagaggc

SEQ ID NO: 655502 - DNA, 179 bp, Homo sapiens
cagctgctcgtcggtgactctataggatcccgcttctcattacacgaacagattaacgtgcacacctggcaattgtgtttggtcccacgctcttccagtacagatgggcaggactacaaggctgtgccgtgtggtggatgacctcattaaccactatgtggtggtgtttagtgtggatt

SEQ ID NO: 655503 - DNA, 305 bp, Homo sapiens
aagcactataaagctgatgacagacttcaccttctgaattagttcccttcttcggctggatacggtttcttcatagttctacatagagcaacttttaatactttcttgtcaatcaagagatcttacaggataataagcagatctatattggcgttgtatgagaatgggcacataacttgccaatagtgatggtcgcagagaatcttggatcagattgaggagagtaccgaaagggaaggagccgatgtatactcggtagccagtccttcacagagactcttgccattccctgaggcatgacaaga

SEQ ID NO: 655504 - DNA, 280 bp, Homo sapiens
  misc_feature (65)..(65): n is a, c, g, or t
gaaaggctttgctttaatgtgtagtgccccgccgcggtgtttttgtgtgctagttgcttcttgcngctgcttcccgcctgtttggggctcccaaacctaacgtggtatatatatatatatataaaaggataaaaatatattttatttttttttaaatccctggagcttttgggtcccatcaggtcctgttgttaattgtaaaaccgttgtcccctccccccttcccggatccctcatgttttttttttttttaatatccatataaaggtaaaagaaggga

SEQ ID NO: 655505 - DNA, 229 bp, Homo sapiens
tgctaggggactgctggtctgcttgccctgctggaaaagatggtcgcactggacatctggtacagttggacctgctggcattcgaggccctcaggatcaccaaggccctgctggcccccctggtccccctggccctcctggcactccagtgtgtaacgcggtggtggttatgactttcggttacgactggagacttctacagggactgaccagacctcgcctcagccac

SEQ ID NO: 655506 - DNA, 153 bp, Homo sapiens
ttcttggttctttctccctcaaagtgaaatgagagactattgtagggtcttgagccaaggagtgatattactctgaattctgttttaaaaggttcattatccgctcttgtgtgaaggcagggtagctacttataagcctagccccagctgcgg

SEQ ID NO: 655507 - DNA, 1408 bp, Homo sapiens
ggttcccggtggacgtggtccctggactcccgggcccgtcgcagtcctccgccagcgcttccttaatggcggatgggtgagccccgggagacctcgcgtgcaggaccgcagtggttgtccgagtgcgaggcgcgcgagtgggcgatggccgaggcgtgtcgcaggagccgatgtctgactcaggactgtattggagagatctgatatccagtcgccatgaaggcatctgtgttgagtgacgattgagcttgagtaaagaggaggaggctgggaatgaattggatgcgtgcacaggtgatgtggagacgctggttaggggagctgagtacacgtggcccgagtgcgagaattcatggaggtccgcatctgcaatgacgggtgcagaacacggggattcgacgtgggtggacgcggccccgtgattgagggtgacactgacccgtgaccgggcaggggccccgggcggagaggacaccccctttgtgcctgccagggggacggaaccacggagataggacttcgagcaccttggtacattagcaataagacgatagttcgggggaaaataggatttagaacaaatacatgatcgccatattggattgtacatagagaagtcggtttgggaatgtccattgaaggaaggtgcggaaggttcacagcgcggcattgacgaccggggtttgttaccaacccctgggttaccaaccccttgggacgaaagggagagttaaatacacatgtattgcagcgaggggagcagtaagattagcttggagaaaatagtgggggacggagataaatgcaaacaggtaaggttcgaggggctcaaatagggagggaaaaggagaacacttaggtgtcagaggagaacatataggggagaattacacgaggggtacagtaggagttgagaggcagtggtcatatgggggacatgttataggcgagcttgaggaagtattgggaggcattcctcagatgggatttataatgggaaaaaactcgggagagtgacaggagatgtgccaattttgaccgatatatgtgggagagtacgaagagagaaaaaggccagctaggccttggagacagcgtcactttttcccccactgtctgccattgtcacgcgaatgttttcccaccgatgcggggacaaaatttgttaggtgaaccgactgaaacacctcgcaggtctatcatttgaacgtagagagcaaccttgaagatggcatgtgtcgtgaaaccccagcgagagatagaaagctgaaactactggggggggtgaacacacagcggtccagcgcccctatatgttgtaatcggacagcaaagggacacacagcgaacaaatgggagcgaagggtggaagtcactctctccaagcgagacatttcgctactgtgcc

SEQ ID NO: 655508 - DNA, 103 bp, Homo sapiens
tcggtaccccacatttgattatatactatgtatggatgaaagcactgagagatttgaatagaaaaggtaatcgagttaaaacctgcaaagctaaaattgaact

SEQ ID NO: 655509 - DNA, 470 bp, Homo sapiens
  misc_feature (174)..(174): n is a, c, g, or t
gtcatgattgtgccacagcactccagcctgggtgacagagcaagaccttgtctcaaaaaacaaaagaaaatcaaactgaggttcagagagaaatattaatttctccaattttgcacagccagcaaatggcaggcttagaattccatccactagctaactgagtagtataggacntagaccaagcttgtccaacccacggcccacagactgcatgtggtccaggacatctttgaatatggcctagaacaaatctgtaaactttcttaaacattatgagattgttttgcgattttttttaagctcatcagctatcattggtgttagtgtattttatgtgtggcccaagacaatttttcttccaatgtggcccagggaagccttgaacaccctgacttagactttatagctaatagcttgacaaattaggtgccttaggagaaatcatttaatatttgtatcagttgtctgcc

SEQ ID NO: 655510 - DNA, 559 bp, Homo sapiens
  misc_feature (100)..(100): n is a, c, g, or t
  misc_feature (197)..(197): n is a, c, g, or t
  misc_feature (205)..(205): n is a, c, g, or t
taagggaactggtcacacgctcgggggggccctgcttggtctaacggacacggggggactcaggctcagggcccttccggggtggccccggcgctggaanacggcttggcccttggccgcttttaaaggattctggcggcgcagggggtggattccggtttggccccaaccctgtgctcgggaagttccccaaaaanccggcaantttttccttgggcccgggagcaggaggaatttttggggcccccaaatggccccgtggaattggtccggggccttcccctggggctggttttgcacaagtttggggccgggggcaacccccctggggaacccctccccctgggggggggggcaaaaattttggtttacgtgggtcaaagggtggcccggggggccccctgggtccggggggcccgggggggccccgcgctcaaggggccccaaaaccgggccccgcaggggggggttgttctttccggccgggggccctttcccgccccctcgccctttgcaagggttgttttgccccccccccaataaaggtccttttccccga

SEQ ID NO: 655511 - DNA, 240 bp, Homo sapiens
agcttaacatggcagtctagggtgaacaatcccctaacacaagtttacttgtctttgattatgacagtaacaaattgacagctttctaactcacaggcatagagtgaccttttaatcagagcccagggaggacacatgattatgattggctcctcatactgaacatcagtggatcctctcagccaagtgatcttctgagagagctcacctgagcaactataatcatatctcatggcttgt

SEQ ID NO: 655512 - DNA, 343 bp, Homo sapiens
acatggactccaagctaccacagctgcgctccagtgtcacattatggtgagcaggttccctggaactgcaggaggagaacctgcaggacgcctgggtaggattgcacttttgctctaatgtgaatgggacgctatgtttcagctacgtttctatttatgatggtgacaaaaaaatactgctggattcccagcatggttctggatagagtgcacaagagttctcattgtgacagcccaactcactcagaaacagccatgagacacttttgggtgtcccttctgaagacagacaccgaaagcattgaagagaaaaacagccctcagtctgaataaaattgtatta

SEQ ID NO: 655513 - DNA, 336 bp, Homo sapiens
gcttggttacgacacagttgatccagaagtagcaaagtggtagttgataactggtgcctccatagggcagcttgaactgtctgttctgagtttgaaatgcttttttaggatgtacttcagcaggcttctcttccttccggctcctcgagtacacatacaagaggcacactccacaggcaagctcctgagcatatttaatcccaggccgtaattttacaggaggaaaaatccagcgagtttacatctggtgtgagtgtggcgagtgacatgaagccgataaggtaataccatactatatcgatgtccttcagcaactgctggcagtaactcgacatg

SEQ ID NO: 655514 - DNA, 272 bp, Homo sapiens
gggcctggctctcttaacacaaagaccatgcagccagtgctgacttggaatgagccgaactcaggaaaaggccaaccctacctaactccttaaggctggcaaagtctaggctctgcctttaacaacactggtaacactacctgctccattcctggtttatccttgtggtagagtggccttgtttctatgtgctcaggaaccagcctccacccagcctcagggatgtcctcccaagagtgtaagtcgacgcggccgcgaatttagtagtagta

SEQ ID NO: 655515 - DNA, 403 bp, Homo sapiens
actcagatatcaagtattactttacagcaacgcagaatgaactaacacccccttcaaaacagagaagtcaacacacacttgaccaatgccctatcttcagacacaattaattagaatacgaatacacatgctgatacctactcttctcatagttgctaaactgtcataataacttgccctgtgtctttcaactgtgtgcttcaataaaggcaaagcaatgcttcctcacagaaaacactaagacccttagcaaggggtaaatatcaactatctcaagattatcacagcatatttcaagttcattaatgtcatcaataatattatactttaatacaacatgctgtgaaatattttaggcccagataacaagaatggacgactatccaccagattactcttccta

SEQ ID NO: 655516 - DNA, 216 bp, Homo sapiens
ggctgctggtgaacaggtcacccaaaatggagatgggatcaaactagtggtcaaggactaactcctaaaaaaaaaaaaagaaattcttttaaaggtttaatttagtttttaaaaaaaataaaagttattgattcactcttctaaattggaaagtttacctgtggttttattgtaaggtaaaaaaataaatttttaaaatttgggggccccaagtta

SEQ ID NO: 655517 - DNA, 677 bp, Homo sapiens
  misc_feature (68)..(68): n is a, c, g, or t
  misc_feature (87)..(87): n is a, c, g, or t
  misc_feature (93)..(93): n is a, c, g, or t
  misc_feature (98)..(98): n is a, c, g, or t
  misc_feature (106)..(106): n is a, c, g, or t
  misc_feature (113)..(113): n is a, c, g, or t
  misc_feature (115)..(115): n is a, c, g, or t
  misc_feature (145)..(145): n is a, c, g, or t
  misc_feature (211)..(211): n is a, c, g, or t
  misc_feature (233)..(233): n is a, c, g, or t
  misc_feature (456)..(456): n is a, c, g, or t
  misc_feature (513)..(513): n is a, c, g, or t
  misc_feature (542)..(542): n is a, c, g, or t
ctggctacgcaaactcttaggcatcagtgtcagcaccaatcgggcattcgtgcagctgctgtgggagncaggcattccgtggtaaancctcancctgnatggcatngtgcgcntntgggacgccggaccggcggcctgcttaatnactaccggggccacacggttgagatcctggactttgccttcagcaaaaatgcctccctggtggtgnccacgtcaggagaccacaaagngaaagtattttgtgtccaaaggcctgaccgttaatggctgcagcccctgcctgtgtgtttggtgttgaggggaagaagggacccctgcccctgtttgccaacaaaggcagtagggcacaaaaggaaaaggagggtggggccctggatgactttccagcctcttcaaatgacttgctcccctttcctttttttttttttaaagacccagcccagggccctcccncccttgcccaaacctggtgggcccttcaaagggagggggggacctgtttttttttcnctttcatttgctggtgtgacccatggggngggtatttgtatgtggggagtaggggtttaaggttcccgttttttcccttcccaagtttttggggggggaaaggaggaaaaaatactagttaaagattttaaaaatgtaaataaaatatacttccccgagccaga

SEQ ID NO: 655518 - DNA, 82 bp, Homo sapiens
agaaattctagggtataaatacaatttggacaattgcatttgatacaggttcagtgtgattatgctaaaagagtttcataat

SEQ ID NO: 655519 - DNA, 339 bp, Homo sapiens
  misc_feature (56)..(56): n is a, c, g, or t
  misc_feature (84)..(84): n is a, c, g, or t
  misc_feature (113)..(113): n is a, c, g, or t
  misc_feature (138)..(138): n is a, c, g, or t
  misc_feature (169)..(169): n is a, c, g, or t
  misc_feature (241)..(241): n is a, c, g, or t
  misc_feature (335)..(335): n is a, c, g, or t
actactccaacgagaagccgttcacggggttcgaggccttctatgcagccgagganattgacgagtgccaggtggccccggganaggcgcccacctgcgaccaccactgccanaaccacctgggcggtttctactgcntctgccgcgaggctacgtcctgcaccgtaanaagcgcacctgctcagagcagagcctctagcctcccctggagctccgggctgcccagcaggtcagaagccangacgacctgttggcctcagctccgggttgggctgaagaatgttgtgccccaactcccattcacccaccatggacccaataataaacctggcccnaccc

SEQ ID NO: 655520 - DNA, 1498 bp, Homo sapiens
gcgcgatagagtaccacggccagaggtcccatggaaggtgtttccggagaccagagagatagtgaaaacgccgtcaggcttctatgttcgtcgatgctgctcgatcatggacaggcggctatgagtttgagtacctatgagatatcgtaacaatccagactcccagagagagagctctgacctgttagtgagtcatagtggcctgtagacaattattcacggtagacatgcgtccagagaagacgcagtcacattctatgtaaacggtgcatgtcagacgtgcacatcacttgctgtaattaacgctggccttctgacgcatcgtctcctcgtggacgccgtgcgccaagcaaaggccatcacatgcgaagcatggtctatctaagggcaatagagtctcctacttgaaagcgtcaccatgtcactccatgaaagaaacaattctttccaaaggagcatgtgaaaggacatatgcgccagcgagaaaacttagctttcgcgaacctcagaagcgcggccgcgagccaggagcccgatgggtccttggcatggcgtggacataggcggcgtaattctatctaccacatcgcacaaggatgcattgcggacacgaatgtgtaacgattcgagcaagtcaatcggatggtccaaagcaagcccagttgctatctccatcccgctatgtgtatagaggggagagaaagaaccacccaggaaaaagcgctctccacagtcttagggtttggcgcattgtcacatctggtcgaggctatagcccaggaaaacgggcctagagagatagtacgccccccatagtgcttttggtagcgcccttaggagcgtttctgggatgccgtattcctttgtggtccgccgttaaggccccgccaatggttttgggctgtccgggattaaaacaccagcagtggggccgttatcggatgcaacgccggttgtgggagttttaggcccatattatttgagtacccccaggggaagggccacaccaagttgtcggaaaacggaacgtttggaagctgtaagagctggtttgcggacaaaagggttcccaccggaccttaacggagggagaggaagaggaaaaacgtctctttgggggaactaccgccggagggcatataggtacaccgggcccccctttgtgtgtctatacattaccccaatgcgtggtttaggccaccaaaccctttcccggagggaggaggtcgtaaccttcggtgacaaagtcggcctgtggcccttcctttgtggaggcaggtaataattggcaccgttgtgggagcagttgggtgatgacacaaagcgccctcaaagttcaaccacgggaggttaagcggccaaaaagtttattgaacacgcgccacgtttgggagaccccagggaaaagtgaacctcgcaagattgggaagaggacaaactcccccccggttgccgcgagtaacgaaccattgtgcagtgtgggactatgaggcacaaa

SEQ ID NO: 655521 - DNA, 570 bp, Homo sapiens
tgacggctgaaggtcagacaaaacgacagagtacttatagatcgattgagatacccgacacttaaactagaaaatacagagttcgatgtatatggatatagcttccggtgaaaatgatcgtcgactcatataatcttcaacatcagaagatccgaatgtccctggtagaaccacagataccaggaataagcattcctactgatacttcaaatcatggaccttaatggaccaaaggaaaaagaagatgaagcttggaaaatagctatattcaacaaaaatcttcaaagactggtcgcctttctgtaaaagaaaaaacttgaaagaacacttctaagcctaagtgtgtgatacagtttgttacttttaagtacattttaataatttcagacatctgcatttttattgaacagttgtctgtatctgacccatcatactactatacttctgggttgaacagaattatttatgcagaataattcaattgaatatccatcacttaaatacagtgacaggacagcaacttcagggatctgtaaagatcatttaaatggagtgctcacctcattgagg

SEQ ID NO: 655522 - DNA, 926 bp, Homo sapiens
ggctaaagaggtgtgtttacgaggggtatatgcccgagtccccctgggcccccgggggatcagtgaaaatggttgttaattcggacacaaatgggggggggacaaactcacagaaggcttcccgctggaaccctcccatgtggcccccccccaaggtgccaactgtgtctgcccgaaggtagatgtccccctcgctgtggtttgacaccattagttccaaagggcttgcctccttctccgtcggcctgcagtggataccgcccctcgttgatactctgaccaggtgacatgccccccacgcgtggtgagccccccccagtgcgctcaggccagtgcggccgctggataaacacgccgtggtgtgtcgtgacgcctgcgcggcaaaggtacaagtcaccacgactcgtgcgttctaaacctggcgaaaaaattaattacacgccctgtgccgccctgtactcgaaaaccataactggaagtctgtctcccaacattgtgggacaactcctcttgggtgctagaagccctttctttagaatacagtggctttcttgtagacagccttccccaccggtttcttcattgtttgaaggatcgtggagtctataaacagtcgtgggtgtcagttaagtcaccgtccccaccaaatatgtcttcctaatagcgcccctctgatatcaacaagagtcgcgcttatcatttccccgacttcctcttactgttacttattgcactcaccatcctcttgtacaccagtagacactttctttccttccattctgtatctctgcctatcatggaaatcttgcgaagtcaaccccctctaaaacatttctttatacgccccccatcattctcccccgaaacccgtccaccaggccaaattcctcgcccccaaacaaaaaatcccatcttcccccaaaaca

SEQ ID NO: 655523 - DNA, 414 bp, Homo sapiens
caaaatccccctaaacccccaaacccagtgccaaaggctcaatggcagaatagaatcaaagatgggagaattgtctctagtttttgtttaatctgtagtttttctttcctaggattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctgaccatctcacatgccacagtaagtatgtttcttaatttaccctgcctcatgggccagaaagcaaacacgattatgtactcagcagtaaaaattggcgcaaatatatttatgcatttgggtcagatcattttagatattcctttaccaaa

SEQ ID NO: 655524 - DNA, 198 bp, Homo sapiens
tagatcccgcactggagcagggtcccaggaatgtgctgcatgttcctgcaggacaagctgagcatagaggattacaacagaatatggcggtgagtataggaaacaaacaggccagcgccttttctaacctaaagaatgcactggagctggccccctcctcactggtgcttcctgccgttcgcctggatatgcagtcag

SEQ ID NO: 655525 - DNA, 171 bp, Homo sapiens
gggcgggcaggcgggacgacttttcattgcgccgacggccgtctttcccacgctgcgctcacttgcccgacggattgctccggcaaaaaacccttatctggatagggtttagtcaagccggcgcaagtccaatgtgtgggaaaattccgcatgccgactcgacaaaacggg

SEQ ID NO: 655526 - DNA, 316 bp, Homo sapiens
tttttttgagacaggatcttgctctgttccccaggctgtggtgcagtagcataagcatggctcactgcacccttaatctccagggctccagtgatccttccacctcagcctataagaacacaccaccatgcctggctggttgttttaatttttatttttagtagacgaggtctcgctatattgcccaggctggtcttgaactcctgggctcaagcagcccgcccaccttggcctcccaaggtattgggattacaggcgtgagccactgagcctggccttgatatctatttcttattggcttataatgcaagtgtgc

SEQ ID NO: 655527 - DNA, 1151 bp, Homo sapiens
  misc_feature (970)..(970): n is a, c, g, or t
gaaaggcgcaactcttcataggcagatgcgtacactgcgacaggttaccggggcaatcctgccgcagtctgcctcctgtgagcgcatcattggaggaagacgcccatcagcaagatagcgaaggagagatgaacctctcagaaacggactatccactcatggaatagctgtcagccgacttgactagtcttcatcgacaatagctctgcgcttaggactgagataggttatacgccagtagagtggaagtaccccattagtgctgtgccacgccaaaactaggcactctgcggtgcctgtgctagtatgtcactaaaaatacgagagacaagtgagacagcaaccctggaccgttggtcacaattgatgcggagagagctagaaggccagtaagagcacgaagactgggatagatcctggactcttcctgatcatacccaatcctattccccaggtacttccatagaagttgaatgacttgcataaaggcagcacataggtgacaccctggtccaggaacatccggatactctacagataccagaaaactcctggtccggctcagcgattcttatgacaaggtcctttctagagagcctgaaggtgaacaacagagcctctgcctgcaacagagaagacagggaaggtaagaggcctcatcctcaacagtcaaaggagagcctggaagggctaagtggccccgtatagagtacctactccagataactacgagacagtggggaacggaaatgccgaaagacccggtgaacaggatcaggcaacaacaggactcaagaacgaacaggaaacacagaagaacaaagacagacaagacgatacagaagccataccagatggtaaccggaccagaggaacgtgaacaccgggaacagtacgcaagagaaccatagatgcgacgtgcacgtggtaccataacaacgacacagaagaatggaataagagcaatganatgacgacacatgacagaccaatgagatgcaccacgaaggccaataggagcaccaggagccaacaagagacataccaaaaaaccacaaaaaacagacagaaaaaactaacacaagagcagaaaagagagaaaaaagacgaacaccaatagacggaaaccaatagaacacgacaacaacaca

SEQ ID NO: 655528 - DNA, 582 bp, Homo sapiens
tggggtaaactcagagtgtgatgatgggatagtgagaatagaggggcaattatgagggataggtaaagtgtgacaagatatggtaacggagatgatgaagattggagtgctacgtgactggtgagaattgataatgtgcagaggtgagaatagaaatgactggaacatgagaggatgaagtggtgaatggtcgggaagaaatattagaactgtgctctgaagatatataatctgaggcatctgaggagccatgtcaattaggagatgccccttgctcacaatcagacaaggaatgccggagtcaggcagacattcaggattcaacatggaaattttggagtcaccgtcacataagaacaggtaaggacagttcaagcggtgggatcagtaaggtcaaagggatactacaggatgagaaaattaaaagcaaggcagatattggagaaatacattaagttagtagagtctagaaaagccttagagggagagacaactaaaggtgagaaagtaaagaaaacaagcaagggaaagtgttcagggctgtagagagagcgagcagattaaagatgcaggatttaccct

SEQ ID NO: 655529 - DNA, 1281 bp, Homo sapiens
gctcagactttcgagacagtccgaatcggacctggaccgtgagtactgccatactcgtttccgtggtcaatggactcgccccacccgtgccccccaccatgcgctcccaactctactggtgtagtcgcggtgtgccctgtggctgctgagatgctgggttggcggcctgtcgatgtgcccctgacgcgcaggtgacatgccgtggtgctccaggggctgcttgcttcggtggccgcgcgtgctgctcgatccatccccgcggtacctctgcccctttccatgtgcttactttgcttccggctggccccataagtctgtcttgctttgcagctgctgctgtctgggatgccgagactttcctgaccaatgcccttcctgctggggactttgcctgtccgagtaggctctgcataaccttcactcatcgtagtgcgccaaccctgacgcgtgcttgctgcgcggccctcccttctgccgtgacggttgacgggggactggccgacccattgcctcggcgagtgccgtttgcgactctgccccgattcacttggatatcgcggacttgtcgcccgtcacgcgcatctaaaccaacaattacagatggctaggctgagatcgacgaggcaggccctctcgagaaccgcgtgcattgaccgctaatacccttggtacgtgacagcttcgaagagcgatcagtgtcagcatagtactccagcttgtcggtcgggccctcgtttttgtgtcacttgcctgtgctcgcccgtttccccggaccgcgggggcagttgccgccactcacagcctttggctgtcacattcagtccttgcctatggcgtttcaaccagcccatgcgtactgccgttgagttggctgcctgtgaactgtgcactctctgtctgacgttgtcgttggggccccgtcgcgccatgggtacctgcgatggctgggccatgggacagccagtgcgctcggtcccggaggcgttatcaggcggcctttgtccgttgtggcggccgcttaagctgtgggtgtctcagcggcagtgccttgcaaggcccggtctaccttggcctggcccatgtcctggccccttgccacgtccttgagtacggccgagcccattgcgcactgccgcgtcttgggcaccgttttccgactttcaaaccagcacgccgttgtgaccaggcgctttggaacccccaggacacgtatggcttggaggtcggcgccttgtatcttcggtgtaatgggctggggccactcccacctgtgtgcgtact

SEQ ID NO: 655530 - DNA, 292 bp, Homo sapiens
ttttggtcacctcggggtacttgagctcctctgtcacctccagcctccatcttctccggaactgagcagagtaaccttctcaactgtggggttgcgtgcccgggaagctgccctcgccagggaaggtgcgcagctgggacttcgggaaagccaggtgacaagggaaatggcgatgcctcccccgaggtcaggaggagggtgcaccgttgccactataaacggctgcaggacagttaacaccaaagagctcttacttgaaagcacaccagcggacgcacacatggagtacatg

SEQ ID NO: 655531 - DNA, 360 bp, Homo sapiens
agccactagccctcctatcctggtgctacatagtgagaatccatctctattaggaagggattaaacaaggcattttcaagaggggcggatgccacgctcagtggctcacgcctgtaatcccagcactttgggaggccaaggtgggtggatcacttggtgtcagtagttcgagaccagcctgaccaacatggtaaaaccctgtgtctagggaaaaatacaaaaattagccaggcatggtggtatgcacctgtagtcccaactactggggaggccgaggcaggagaatcgcttgaacctaggaggcggacgtagcagtgagcggataccatgctgctgcatccagcctggacgatcctccca

SEQ ID NO: 655532 - DNA, 454 bp, Homo sapiens
cggcacgagggtaagaaggtgcattttctcaatttgctggccagcataatttcacaaagcccctgacactgtggcaagtgtagctctccggagggatgctttgaagacatggcagggtagagcacacggctcccacatctcttgcctgggtcgctgtattccagaaaaggtaagtgaccctggtctttgccctttcctagacataagacaacatctggtgtggttaatgattatgcctctgtgacctataatcagatgtactcttacatcctaaccttgatgtatttctgctttactgtaacttctgaacaagtttgatgtgattttgcataaactatgaactaaaacactgctttggaggagtctgacctctctgaaagactcctcccaggctgtagttctcagtccgtagtcctgagtcagacttctgaataaaactaactttaattcttta

SEQ ID NO: 655533 - DNA, 337 bp, Homo sapiens
  misc_feature (3)..(3): n is a, c, g, or t
aantcgacggttctcagatgtcatatatgtaatcacacactcaaactctgaacagtataccttcctatgtacaattaactatattgtactctcgggatcggcaggcaaatgaataaaagaacatctttatttacccgtatctgcgacattcctcatagtatgtccgaaagcccaaatgatggaatccaaaacaagcttaaactgtgtaggtggaatagcaaggaacgctgggaaacaactgagaatcgacagcctgaagtagtaagaaaaagttcgctctatgtccaggatattcttcaaagtcctacccataagtggcggaaccaccaatactgtt

SEQ ID NO: 655534 - DNA, 131 bp, Homo sapiens
aagaggaagatggtgagacgacggggaggtgaggcaaggttcataatggagagagtcgagagggatgaaaatagagaccccagtgcagggacaagtgggtgctagagtagaacccaggagagggtccagtg

SEQ ID NO: 655535 - DNA, 139 bp, Homo sapiens
atctgacttgcccgatgtgactccacccctagtgcctgtgatcttgactctgccctgactgtgacctccacccctagtgcctgtgatcttgactgccctgacatgacctccaccccatagtgcctgcgatcttgactct

SEQ ID NO: 655536 - DNA, 117 bp, Homo sapiens
ctagaggatcccggctgcctagcacttcaggagaagaggaggataggctgctgtcgatggcacagctttatctgaacggtgagctagtggggaggtcctgcaggcggacagagtcgg

SEQ ID NO: 655537 - DNA, 374 bp, Homo sapiens
gttgtgcgtttttaagagctttttatgtggccacagtgcagagccaagggaagagggcacggcccattgccattctgtcacagcccgccggggtcagatgcaaaatccaaaaagagacccccaagtacagcatggggtagggggtgtcgggaatccattgaattgtggttgccagaaccaagccctgctcacattctcacactggcacccagaattgtcaaagatccagatgtgtaaaaatctacgatccctcagtctcactcacaaaaaataaatatctcatgtccccagcgaacacagagtcaggccacagctggagcaggcacaggcacagtcagaaaggacacgagtgaacgcggtcatatgcacacacg

SEQ ID NO: 655538 - DNA, 293 bp, Homo sapiens
  misc_feature (32)..(32): n is a, c, g, or t
  misc_feature (70)..(70): n is a, c, g, or t
acctgcataacaacttttcagtcaacaacagntcaaatatatgatggtgatcccccggacctgaaaatanccctattgccccggtgacattatagcccatcagcatgtggtagagcaacacattactcacttgtttgccagttgtaaaaaagaatagcacatacaattacatacagtacgtaatacttgataataataaatgacgatgttagtggtttgtatatttactgtactatatttttcacagttattttagggtgtactcctatttattaaaaaaaatgttaactata

SEQ ID NO: 655539 - DNA, 508 bp, Homo sapiens
  misc_feature (91)..(91): n is a, c, g, or t
  misc_feature (344)..(344): n is a, c, g, or t
  misc_feature (358)..(358): n is a, c, g, or t
  misc_feature (393)..(393): n is a, c, g, or t
  misc_feature (402)..(402): n is a, c, g, or t
  misc_feature (431)..(431): n is a, c, g, or t
  misc_feature (476)..(476): n is a, c, g, or t
  misc_feature (490)..(490): n is a, c, g, or t
  misc_feature (503)..(503): n is a, c, g, or t
gattcggaacgagggtctcacacacacacacacacacacacacacacacacacacacacacacacacacatatttttgagacggagtttcnctctgtcgcccaggctagagtgcagtggcatgatctcggctcactgcaagctccgcctcccggattcacaccattctcctgcctcagccccctgagtagctgggactacaggcacccgccaccatgcccggctaatttttttgtatttttagtagagatgtggtttcgccgtgttaggcaggatggtcttgaactcctgaccttgtgatccgcccgcctcagcctcccaaagtgctgggattacaggcgtganacacggcgcccagncatttgttcacatattttgatagtaatatgaggcntcatttaanaattggtttattttttatggataaatttntgggccattgttgtaactggtcttaattgatagttatataaatantggtagtatatttnctttttttaaagnacaaa

SEQ ID NO: 655540 - DNA, 371 bp, Homo sapiens
tccccaaacactgtggctccagctgaatttcagaaaaatccttttctctctcacatgaggagcctagttttcacgattttatgtccaaaacgtatatttgaaccctgcacctgggcatctggctcttggccgagtctccctctttctcccaaggtggtagatgtgactgtcaggagtctggggagctgacgacaaggctgagcaggtcagattgtgacttgtccctggactgtcatcctgttgaggaggaacagctagtaccctagagaactaagaacacctgccaccgggttatttagacccgcgggtgaggatctggtgccataggatggtctccagggagcactgcagtgatggagggtgttgagtag

SEQ ID NO: 655541 - DNA, 179 bp, Homo sapiens
gcgctgcgggctgatgcggtaggcggccacgtcgaacgttcgtcggcgggctcggcgatctggctgcggcgcagcagcgccgcgacgcgcgccagcagttccagcggccgcagcggcttgacgatgtagtcgtcggcgccggcgcgcaggccttcgaccaggtcgtcctcgctggaacg

SEQ ID NO: 655542 - DNA, 180 bp, Homo sapiens
ggggacggacgttgcagtgagctgagatcgtgccaacacgggcctggccgacagagccagactctgtctcaaaaaacaaaaccaaaatcacaaaagtaccatatgaggctggtccatgactggcactttatgacagctgaggtggatcagatggcttgaaagcctaggtaattcgaggac

SEQ ID NO: 655543 - DNA, 568 bp, Homo sapiens
aaggggagggaagataatttttgtatgttttttttattaagaaagagagagagggtttatcgatgatttgtatggtggttctatctatgaggggtggggtgtgtttgtttgtttttgatagatgtaagaggggggcgcttttcttcctctgtttggttgtcgcgactggtggtgtgtgtgtttcttttgtgttactctctctctctctcgtcgcggtgtgtctcccccctctccgctggggcgcgccgcgctgctttgtttggggccgccgccccgcgcgcgtcttgtctctctctctcgcggcgagaggagtgttttttctctctctcgcccccgagagatatatttttttttttcgtggtgttgtgttgctctctcgtgttttttttttttttcagcacgattatgtgagtttgtttattttttttttttgtggtggtgatatgagagttgttttttgtgagtagaggagcacattgtttttttttgtttctgtttgtaatataaagagagaaagagaaaaaaaaagagagaaggaaaaaaaaaaggcgcgcgccccccccctgga

SEQ ID NO: 655544 - DNA, 708 bp, Homo sapiens
taaaaacgggggggagtggcgtcataaggggaacccccccccgtgggggcgcccacagagagggggggggagaaaagaggaggggggtggggagagagagaggggcgccgagggggggggggggcccagaagaaggagggccctctggggggaaaaaacacccccggagggccacacgcgcggggagggctcttctctctccgagaagagagagaggcgcacacaaacaagaaagagcaccggagaggacccctcctccaccaccggagggagaggagaagagcgcgagtggtgtgtggggcgcacccgacggggtcggaggcgccctctagaagagggaagggacgaaaagacacagagagagagacaccgccgcgagggagagacacaacacgagagtctccgcgagagaggagtgtgagagagaggagggagtgagtacacaaaaataactcgcgtgtgtgtgagacgacacgaaggagatcacccccccccgcaacgcagtggtgtgggggtgggcgcaccaccaacacagtgagaaaagagagtggtagagagggcgcgagggagagaaagaataacacacacccccccgctgtggggaggtctcacacccaggctgcagtggagggagggagggaacaaaaaagaagcagggtgagaacatacgagtgggtgtgagagagacaccaccacaaacagtgtgac

SEQ ID NO: 655545 - DNA, 160 bp, Homo sapiens
tctagaggatctcgagaagagacagaagggcaaatcttgatctgatgggctgctccagaggatgactggctcgagatgtatccctgcccgtggagctttcccccagaggggcccggccaagtgcagtcggtggtcctgagatggaggagtcgggagcaca

SEQ ID NO: 655546 - DNA, 506 bp, Homo sapiens
ctggctcagctcccgaggtagctgggattacaggcgcccgccacacacctggataatttttgtgttttcagtagagacgggggtttggccatgttggccaggctggtctcaaactcctgatgtcagatccgcccttcttggcctcccaaagtgcttagattacaggcgtgagccaccatgcctggcctatatgtcttgatttttcattcctttcgtgccttttttttttttttttgggcagaatgtggacaagcatattttaaaattaatagggaagggcaagagaattaaaaaatcaaaactatctggaaaaagaagaccaaggtgggggtacttagtgcttccaatttcaaaatttaatacaaggttacaatattcaagactagctagtacggggttaaagatatctagatagatagcgggcggggcaggggggctcactcaaatattcccagcaattaaggagggggaggcggggggatcccgggggcccaggagttcgagac

SEQ ID NO: 655547 - DNA, 136 bp, Homo sapiens
agcctggagctggtggcggatgttcagtttgccttggggcttcccttctacccagcctatgatagtggcatgtttgctctggaggagaagagcctgtcgctgaaagtcatgcacgtacttttcccacttcatcaga

SEQ ID NO: 655548 - DNA, 179 bp, Homo sapiens
tagaggatccttatagacagagtgtgcaacagcacacgaagtaatacttggtgtggctagtcacactgaaaagagccatttagtaaatattctaaattaaaaactggctgggctcatccagaatctcatcaggactgggcagctcccgcgtggactatacgtggatatgtgggcacgga

SEQ ID NO: 655549 - DNA, 205 bp, Homo sapiens
tcgggcattctggactgtgctgagtgtctcaggctggccttctgggcggtgtctgtggtgatcgcagtcatgcagctggggccattgtccatgcagaagcacccgggcaaacttgctggctatatatccggcctgttcaccctggccagtctttgctacatgcttttgctgctgttgtcctctgcgtgaatagcttcatctggca

SEQ ID NO: 655550 - DNA, 771 bp, Homo sapiens
caaagccctgcgtccttcggcccccagagtcggatgaagcgcgcaaggcacctggtggcagcggctgacgtgcagctgcgacagcaacccctgctgggccgaaactgggcagagcggagcagacgtctgaagcagcgcgagtgacggcgctgatggtgtagcgccctgctgcccgggaagacccctcggtcgcgaaccggcagcccacgccccggtgtcccggttcccaaggccccgcctctagcggtcctgggtggactatgtctggattgagcatgctgcgccggcccgggccgcgaactcgccatattgcggagggcggtgtgccacctgcccaatccggatgcatgacagtgtgcgatggtcctggtaaggctggacggccaatctggcgtgcgtgttgcgacctgctgggtggcaggtctcgtgccaataaggtaggctcgagtgacatcttcgcgcaccaatcgggagtgcagggagcattcgtgcccgctcgcccttccggccagaccgcttatttaccatggggcgtgcaggcccgcttgccaatcagagcgcggctgagcggccccgcagtcaacccccgaggagcggcggctggcgtcgcgcgcccaggagttggggatgtctacaagcccatcgcccctgctcgcagcagccccctggctcagacccctgggccggctcgcggtcctaccgtgacggtcagtcaccctggtgctgcgggggcacgttcgaaaagacgctatttgaccggctgcgctacag

SEQ ID NO: 655551 - DNA, 912 bp, Homo sapiens
tttgcgtgccatggctggccttccttggggcgctcatgcggagcacttcggacctcagctgcggactgcccactggaagtggtctgtatccctccttctgtattcgtggtggccattcggcaccattgtgcagttgctggtgttgggcctttcccctttctctgtcgtccttgttcctgtctgctcgtactgcgcgttttggagtgtcgttgtcacggtcgttctgatttcccttcggggcgctctaggtttgtgtgctttggatgctgataccatgtcggccgcttccgacggacaacagttgctggttcgccgcgtcggtgcttctcaccggagcctggttgccccgcttcagtcctccctgctctgctggtcgtgatgcattctttgatttattttctggtgtcttatctgtgccttttgttcctatgttacacccagtggaacgcgtctggcgacgttcttgtcgtggggtgggccttgcctttttttctctgatctgtcattagctgcctcttctgctctgtttttgcgcaacgttgtggttgttcacctctacgcgtcgacataggatgctggtcgttttcggtgccctttgttttttcgagtcaatgacttatctgtactatttttgccacgattgttctgcgtctcctttttcgggtgttactctcgatatcaggtggccgtcgctctccccatggacggtgcagcagaaacatcacacgaaaatgaacaggataaaaataaaatagaacgattagcaagagaaattacagatcacgattacaaacatatagataatgatacaatactttattgtcatattaaatcaaaataaataagacaataaaaataattgaatatatactcatatggaaaataatataaataataaaaagaaaaaaataa

SEQ ID NO: 655552 - DNA, 199 bp, Homo sapiens
accaaagtaacagaacttatcccaggtaaaggtgactactcaaacccaggctgctcatataccaggcttattcttttaatagttcaccatatagatggttcaaagtgctgcttattggcaatgcaacttgaatatagatcttcaggaaacactcctaccctctattattccccaggttataaaacaacatcccgtttag

SEQ ID NO: 655553 - DNA, 236 bp, Homo sapiens
gataacatcgttgtgcgtggtcactcccgtgactgtgttgtaggtgaatgtgttatttcgtgtgtgtgtcgtggtttcagtgtcagaagggaaataaaagtgtaatggaggacagtgtaaaccctttgggtggagtttcgtaataacccagactattttcaagcaatctggtccacccaggattagtgaccaggtttccaggaaaggatttgcttctctctagaagatgtcttcag

SEQ ID NO: 655554 - DNA, 732 bp, Homo sapiens
  misc_feature (180)..(180): n is a, c, g, or t
gctgttggcttcttccgcgctggagtatccagataggcgacacgccggcggtgggctgaggcgggaatggtgcctgtactgcagcgcgtcgagggggtgtccaatcgagtcgtgcgtgtgttgggctgtaaccctgggtcccatgacctcttccaaggcgaccgaagcaactacatagtngggaccggacccaggagtaatccgtcattgacactggaggaacctagcaattccagaatacatcagcgtgtttaaagcaggctccttaactgaatttaacacagcaatccaggaaattggtagtgactcaactggaaccgagatccattctggaggcatacggagatatttgtgtaaaagcatcaataagtgacaatagctattgcattaagaaaaatcccaggggaattccttcagaagagaacgaacattatacgggaaatggaggaggcaaccaaatagtggtcactctggaaaagaattgggacgactgtgacttaaggacttgaagggaagacactactaagagtttatattatatccctgggcaaaaattgatgatcagcgtggggtctaactctgtaagaaagagggaaaaatgctatcatttttcgtgggagattggcagtcctatggggaagggaacaaacgggtagtttgaaagacctctatgattatatgaaggtgcttaaaaaggaggttattgaaaatccaaggtggcttattatatat

SEQ ID NO: 655555 - DNA, 178 bp, Homo sapiens
atagatcgagctcggcccgattcctaatacggtatagttttctaaggtactccataatgttttctgtagtgttgtaccagtttatatccccatgaacagtgcaggagggttcccttctctccacaccctctccagcatttcctatttgtgtctttactaatgatggccattctaactg

SEQ ID NO: 655556 - DNA, 289 bp, Homo sapiens
ccaaaaaaaaggaaaaaaaatagaaaaaaaaggagtaaaaggggcgggtttgtttttttaaaaactgtcttggaaacccatttaaaagggtggtctgttttgttttttaacgatttttaaaaaacgtctgggccccccctggtttagggtggaacctccaggcaggaaccggcttgcccccctttggccggtaagggctgcccaaaaaaacattacccgccctcggggggttgggcttagggggtcccggcccctggggtgagtttcatgtattaaaacataaaattta

SEQ ID NO: 655557 - DNA, 106 bp, Homo sapiens
cctttatcagctgagtaattacttgagagggataaagcgggaggaatgggtggccccgatgcctgggccggccatgctttacgggcttgtaggtgatggagaactc

SEQ ID NO: 655558 - DNA, 242 bp, Homo sapiens
agggaaagtactatgacccagcgatgggggcttcgacatgggctatgaggagctcatacgtggagtccgtaaagaggtatctttactataaaagctattgtgtaagctaatcatattaagttgctggctcaggacgtagatagtgcttgggcagtgagagtgagtcgtagaatgtttggtgagcctagggtgttgtgagtgtcaattagtgcgatgagtaggggaagggagcctactaagct

SEQ ID NO: 655559 - DNA, 188 bp, Homo sapiens
gtgttgcaagtgtaagcgacaaaaacctgtccccaatacataatttaaaaaatctaaatttcaaatcagcagagctagcctacttccatgttggctatatccacaatataagtgtgagctcttgaaatgcatacgtaatgtaggtagtctcccactgtggcaaaatgcgcaggactcccaattccctg

SEQ ID NO: 655560 - DNA, 496 bp, Homo sapiens
tgattcatccaaagagacgattcatgtgagagccagctttcaggccaagtattgatgggagacatctggctgattggccaacagcaggtagagaaggcaagcccagtgaaaacagcatgaggagagcatccaccttttgacattgcacacaagcaaggatgacaccatgaccatctttgaaagggcagagctggacttttgcataacattattcaggttaatgacaccttggtacacatcagtcaattaaataataaataaaatgtattgactcttagtcttcaataacacctctgagacttgttaataatacttgtggattgaagatatataaacaaaatcaatatttattgaaaaaatgttcaacgtttgagaacttagattaaccttgttaattgatcctataaagtgtcaaatttttgactgatttgtttacttacatgcttgtgaaattctttgggatggatattgcttcctaatacaatgtttgtagcac

SEQ ID NO: 655561 - DNA, 145 bp, Homo sapiens
acagcaaaaggtctgcatcgaacaactcacagcaactccatgctgtacatgtgctacttcattgttgtcttataagatgtagaagattttcagatcttggcaataaagtactgaagaggccaccctgttatccagtgtagaaatt

SEQ ID NO: 655562 - DNA, 188 bp, Homo sapiens
  misc_feature (7)..(7): n is a, c, g, or t
cgacaancatagaatggtggtgttgagctgattattaacaggtactggaatccaatatttatttggtaccttattccctttggtatttaggtttccttttacattctttttatatgcattctgacattattccatttgtattttaggtttccttttaacattctttttatatggcattctatgggggg

SEQ ID NO: 655563 - DNA, 949 bp, Homo sapiens
tgattcatccaaagagacgattcatgtgagagccagctttcaggccaagtattgatgggagacatctggctgattggccaacagcaggtagagaaggcaagcccagtgaaaacagcatgaggagagcatccaccttttgacattgcacacaagcaaggatgacaccatgaccatctttgaaagggcagagctggacttttgcataacattattcaggttaatgacaccttggtacacatcagtcaattaaataataaataaaatgtattgactcttagtcttcaataacacctctgagacttgttaataatacttgtggattgaagatatataaacaaaatcaatatttattgaaaaaatgttcaacgtttgagaacttagattaaccttgttaattgatcctataaagtgtcaaatttttgactgatttgtttacttacatgcttgtgaaattctttgggatggatattgcttcctaatacaatgtttgtagcaccaaaaacccaaaaaaaaaccaaacaaacaacacacccaacaccaaacccacacacaaccgcgccctcgggcctcaccggagggccgacgccgccccttccttaagagagggccgcacatgaaccccgctccccaacacccatttctcgccccagcggtgtgtggcccgcccctattcccccgacggcgaggaagcgccccaccccaccccgccacgacccaagaagaaatcaaactaacacgcacccccaaggcccccacccacgaatacgtgaactcgcgccttccacacatcgcccacacctaaacaatctgacaagatattactacaaacacgcggcaaacccccccgcctacataaatcatagagtcccccctacgacgacagccagtcgtaagtatcagagacctcagcaaacaagcgccccgtcgaacgcacctacacgaacgccaa

SEQ ID NO: 655564 - DNA, 140 bp, Homo sapiens
atgacaaggaagaaactaattctagaaaagaagatagtaagtatataaggtttaagtttacgtgtctatataatataatagaaaccagctatttttttctaccatataaaacatgcataacgtttgaaagcacatatgga

SEQ ID NO: 655565 - DNA, 452 bp, Homo sapiens
  misc_feature (39)..(40): n is a, c, g, or t
gggcggggccgttttggtcagccgggtttcgttttttanngcccctcgggtaagcaacccagtgaaaacagcatgaggagagcatccaccttttgacattgcacacaagcaaggatgacaccatgaccatctttgaaagggcagagctggacttttgcataacattattcaggttaatgacaccttggtacacatcagtcaattaaataataaataaaatgtattgactcttagtcttcaataacacctctgagacttgttaataatacttgtggattgaagatatataaacaaaatcaatatttattgaaaaaatgttcaacgtttgagaacttagattaaccttgttaattgatcctataaagtgtcaaatttttgactgatttgtttacttacatgcttgtgaaattctttgggatggatattgcttcctaatacaatgtttgtagcac

SEQ ID NO: 655566 - DNA, 1143 bp, Homo sapiens
  misc_feature (1143)..(1143): n is a, c, g, or t
ggactcttaagaagggacggggccccacgctgcgcacccgcgggtttgctatggcgatgagcatgcggacggcagatggtggcggcagtcccggagcaggaggattccgtgctgttccggcagcggatacaggccagaagctgatgattctgacattatagggcatgcatacaagcactgcatcaaaagccatcatgataaagctgtggcttccatttaagacatgctctaaagaatggtgacagtttgtgaaacttcgggtaaaccaaaaaccacacctaaaagacaacctgctacagaagaataaaaagccaacaagacgcactactgcagcttccttacaacagtggacacacgttggggaccaaatgtactgccatttgcgtcagaagacaggttgcatttacccagactaccattgcttcaattgatattaacgagagaaaccctgctgcttgctggctaacactgggactatggaccactacgaggacggacgccaaatctgatccgctctactttccccactctgtgacgataccctaatactatagacacagactgctcacagagacatgacgcatgaaaagccaagttttcaacaagcatgacacgtgagaactccaggaacatcctggaaataactcagactaacatcaagcacaaatccagatccatgcaacaccatacgtcctgccacgacacccacatgcaaggacacgacactggaaaccgagaaaagcccaggacatgaaacacaaagggaccacacccgcgcagccagcaaaccgaacgacaacccaataaaaacacgacacaagaagacacaaaaaaacaagaggaagcagagaagaaaacagagcacacaagataaaacactactcactacaacaacatacaaacatgaaagctacaataacaatcacgcatataagcagcacaacaaccacaatacaaacctcataccaaaggctcacaccccaaccagtaaatcccccatatcttagagaaaagtaatacatcaaacaaacaaaacatcagacacaacgaaacaattcctcatcaactaataactataacaacaaatcacactaacaaaacacaaatagtactacacactattactcttagaagtaactgagn

SEQ ID NO: 655567 - DNA, 125 bp, Homo sapiens
ccagtgctctatctcatgaggctgagcattatacgaaaatgacctctgctccttttcattgcagaaaattgccagtggcttatttcagcaacaacttccacttactttccactggcgctcgtagg

SEQ ID NO: 655568 - DNA, 1710 bp, Homo sapiens
  misc_feature (94)..(94): n is a, c, g, or t
  misc_feature (238)..(238): n is a, c, g, or t
  misc_feature (253)..(253): n is a, c, g, or t
gtgtgctaagatgagatgtgtgcagtccgccgtgctcgtgagcatgacagcgcctaagagattctcggccttgagtacgaggatcatccgagcnccaaaatcgcaggaccttgctcgcacgcttctggtgcgtataatcgtgcgcccagttctatatcgaagcgttggcgatctgcgcagaaagatgcacacatccgtcataatgtggcacgtgtctgtagtatgtggtcttcacgtngtcgatatttaatcngggattccatcgctagagcgctcgtggtcctcgcacggaagcgagtcgtatctacagacttgtctttaaggcttgtgcctcgacaacagtgctggatcctacgcagtaccatcatgcgaaatcacgagaggaagccagagcactgtatggacccgtgggccgtagacagaccggctgcttggcaagccgtgggtaccgtctctcacagcagaaagaggtagccacgctgctcccttctgaagcagtggagttaagcatccaggtcaacccacctttgccatgggagaaatgcaagtaaagagctcacgtcctggtgggtgaatttcggcacatcggaatgttggcgaatcctcctaattctgaaagacgttggggttagatcatttcctttggtcgcgtgggccccattgctcgattctgatcaatacactcgagagcgtgtacccccttttgactcgccaagtttattcacaagcgtggagaaattgtgtccataggaacctggtggaatccgttcctcacgatctcgaaccagggacaaaggaccccttaggccacctctatctttagatcaggcttcatcttctaaccaatcgaagggtgcgaccctcttctggggagatgtaagcgtaacaaagaggccggcctcttttgagggcgttaaaggcgccttcggcttagggaatacgcttaattcgaggggaacccagacttttgaccaaattggtccccggattacccgaattcgaagattccctggctccggtcagcttgggagggttggggccaaggctgtgtcccttggggtccccttaagggatcctaggggcgcctccgataatacagccccaaagctcccgaaacacgggcaaagaggcctaaacatgacaccttttgcccacctaaaaccctgggcgttttaacattgtggcacacctgcgtgggacgctttttccttgtgcacccttatcacaaattactctgtgctatgatagtcaccacacaatttttcgtttccactacacaatgatttcacagcatactattccaacaagaaacactaccccggcggcgacttattttcccgcggggcgcacagcagcctgatggccacacaacctaagcgcccgcgcactaaaacgacctcactctccccatcggctttgtgcacaacgatggacaaacactaacgcggctctcccacaaaaagcagcaggaggaaccacccaaacgacgggcgccacactatccaacacacaactccgcaccactcagcaacgatccattctgtacatgaccacaactcacacctactccaccacgactatattaccaagcacagactaacacaaacacgacacaaccacccaccatgttctttcctttacgcgcgcactgtatcgtcttaccatccgccccacagactacgcacctacctgacaccccacataacatgg

SEQ ID NO: 655569 - DNA, 106 bp, Homo sapiens
ctttaaatcatgagctgggtgtgggtggtgtctgtcatcattcatgttgtcctgtatcattaccagccatctgtgcttgttgcctcattagccaggttgtgagatg

SEQ ID NO: 655570 - DNA, 819 bp, Homo sapiens
gttctgggctacgcgggtggtggggggagcctagccaatacgcttccgcatgtagagcatgagcactacagtcaccgaggtggatagtccactgaggctaatgcatttacatggccccacagttgcactcgttataatgatagcagcaaccccttagattgatccattaacgacacatgatcgacggtgtgtgggagccctacattcaggaggcttggcatgacccatcactattgctgcttcgatgagcgcagtgccatagttcccggcccatagagacctcgtcaacctacactgagcaccactctatcagggttcaagatacatacaatgggctaccagattggacattcaagaacactgcaactgcgagagtccagatatgacgataacatgattaccttccccaactggcctgaagcctttgacttgtcctttcttgtgtgccaccctttcaggaacacatgttggctgttagaacaaatttaactatgactgatggtggaaggatcatgaaagctggttcttaagtaggccttttttttaatgagatcccttcatttgaatattaatggctttttacattaaagacttgtcggtcctggcgaccccgatgaatgtatgatgctagtatccatatcatacattcagagtgatggttaacttggcatatatctcctaaagtgatacacatatgattttcctggccgagtttttcataagcagaaacaggacatctttgctgtacacagtgcacctatgccaccacacagagatttacatgtgaccgatctcatgagactgatttctgccattttt

SEQ ID NO: 655571 - DNA, 130 bp, Homo sapiens
gtcattcattaacccctcccctccccacagtggaattcttgaacttcccccctcccctgggggagcacagtatagggtctgcggcggggggagaagaatacagagagacaacagggaccggcggcggccg

SEQ ID NO: 655572 - DNA, 399 bp, Homo sapiens
gactcgatcagacattatgacgcagagcttctgagagggtgtgcattggggcaatggtactgaatgtctacacagcagctggcaaatgaatagaccatatcctgtttaatctcactggttctggccttgcttgataattgatcagtagatcaagtgcccctgaaatgtcagcagagatgatcaggtccccctccctctgaattgcagcctgttcagtgcccagacgtacgcatgggatactgctctgtgctacaactgaaatatcaaacaattgctacattgttaatggaacattaagtgcattttcccagaccacttatttaaagtgcatttcccttctgtgggttcataatgaggctgtgtttgaggtctgtgttgaggcagacatgaggggaggtg

SEQ ID NO: 655573 - DNA, 273 bp, Homo sapiens
gacccaacggcagttaccggcgtacgaatggcgtttcgacgacgccaacccgccggtgcatgcctgggccagctggcgggtgtaccagcaggacaaggcgctgaacggcgtgggcgacatggattttctcgagcggatcttccacaagctgctgctgaatttttcctggtgggttaaccgtaaggacgccgagggccgcaacctgttccagggcgggttcctcgggttggacaacattgcgctgttcgatcgctcggctgatttgcgtcgacg

SEQ ID NO: 655574 - DNA, 536 bp, Homo sapiens
  misc_feature (390)..(390): n is a, c, g, or t
tacagcttcctagtgcggggattacaggtgtgagccacggcgcctagcttatttttaagagataagatctcactcggtggctcgggctgcagtgcaggggcgtggtcagctcactgcaatttcaaactccggtgctcaagcgattctgtcacctcagcctcttaaacagctggaactacaggcatgtgccaccaggtccggctaatttttaaattattctgcagagatgggggtctcgctacgtggttcaggcgggtcttgaactccgggcttcaagtgatcctcctacctgggcctcccaaagtgttgggattacgggcatgagccactaaaaagtattatcactttaataataaaactatcactgttttggagaactgtctggaaatngtggcatttacaatatctgtcaggtgggttttagacacgtgcaagtggtttttaagaaaagatttacatttatgtatggtttggtgactgtgaactctccttaaggctctggaagggccaggacaaggtgttataagctgacacat

SEQ ID NO: 655575 - DNA, 146 bp, Homo sapiens
gaataaaagattgaaataaaataaagacattctcaaatgaaggcaagctgaggaaattcataaccaaagaatctgctttaaaaaaatgttaacccagttcttcagcagagagttactggggcaattcaaactttgggattcagagg

SEQ ID NO: 655576 - DNA, 271 bp, Homo sapiens
  misc_feature (181)..(181): n is a, c, g, or t
ggagggtcctgtgtcaccgcgtgatgctaaaccctcagcatgtgcagctccattttggcaatgaagttcgccctgatcacatggcaatgaagcagatatggctcgcccgctggttcggcgagccggcccctttgcatgaacgaggcagtgtgaaagagaagaggaggtaggggccgagccnccaccccatcccactccccttccctccccagatatttatgtgaaatgaactgcagctttattttttgaaataaaaacttttaaaaagcaa

SEQ ID NO: 655577 - DNA, 889 bp, Homo sapiens
gaaagtgcaactgtcagaacacgattaagagtcatgcatgagtagtacccaaatgcctgtctgaaactgataggatgattggaattagtataaaatttacactataaggtatcaaatgtcaagttattagaccgagcatatgggaagaattgaactaaaattaactagcgtacagttttctctaatgaggtgactgtacatagatgggtatattgggaatttagaacgagaataatgctgtagtaatcgtggcccttatgttgaacaccatgaattcagcatgggcgtatttgctttgtgccaattacaaggaatgccaaaaggaggagcaggaacaaattgccgtccattttatgactgtaggttcgcgcgtttaccaccgtaatttgtgctacagaaacttttttggacccgttctaacgtgctagcgtcatgacatctgaagactgacaagtcagtgatgctttgattaatgatcggtgaatttacatgcacacagtgcggtaacatctaccatacagtagcaaagctgttgttattagatttaataaactctcactagcccattatgttcctaactggtaatttcgggggacttgaacagcaagcaaatactggtcaactgtccagcttgtgcggcacacacctccatgtgccattgttcaacacaagtctctacctcaaaattggggggtatattcacaacatccatatccatccccacgacgtctccgcccctccgccacgcgcctacttccatcattaacccccacactgcttaatccaatcagcacaacacctcccaacctcgaatatgcttcatccgactcgtcccaccactcccccaccacacacgctccgcatatctcacgcacagccccacacaact

SEQ ID NO: 655578 - DNA, 425 bp, Homo sapiens
gtcgactttatattttcacgtattttataacccttctattagatcgtaggccctgcggctgcctctcctcctctcccaggaaccaagcactgccagcccgcagttctctcaagcaggagtgtgccctctctgtgtgcctctctccttaaacttgtcattacacatttctctctgccctctgtccattcatatgaatatgaaacaatataaatattctcaatgtcctcctgccaaatctaaatagctaaatctctaatccgaggataaatgtcgatgatgctcactctgctgaactgtgtgcctgaaggccttttgtctccaatgttgaacttacaggtgtctagatatagtgtagtgtatccccagagttccctgaatgcacagtttctgctggagcatttgtttaatttttcgtcgacgcggcc

SEQ ID NO: 655579 - DNA, 316 bp, Homo sapiens
ggaagcccccgacctccttttggccgaaattgacctccccaaactggatggagccctggggctgtcgctggagatcggggaaaaccgcctggtgatggggggcccccagcagctgtatcatttaaacgcttatatcccgctgcagatcaactttcatgagagcaaggcagccttcccccggaagagaaagcaattaatggtggccatgccgcttctgccggtgcctttttgatcagggggtctccttgtgcttttgaaatgtggaaaaaaggctgctggctcccctaaaagttgaaataaaaaatttttgccttta

SEQ ID NO: 655580 - DNA, 413 bp, Homo sapiens
  misc_feature (15)..(15): n is a, c, g, or t
  misc_feature (53)..(53): n is a, c, g, or t
  misc_feature (100)..(100): n is a, c, g, or t
  misc_feature (230)..(230): n is a, c, g, or t
  misc_feature (296)..(296): n is a, c, g, or t
  misc_feature (371)..(371): n is a, c, g, or t
ttaaaagttccccanctttttaaaatatgccatatacatattattattgttgntttttatttttaggaactgaaaagaaaatggtgaattgctgccctanactgagaggagaaaattaataaatcttaaacttggtgccccaactattacggggtctggctctgtcacccaggctggaagtgcagtggcacgattatggctcattgcagcctcgacttctcggggccaancgatcctcctgcctcagccttctgagtagctgggaccacaggcgtgcaccaccatgcccacctaantttttatttcttgtagagatgaggtctcctgcctcagcctcccaaagtgctggaatttacaggtaggaccaccanacttggtccacttacttataataaacattgatttggtcgttc

SEQ ID NO: 655581 - DNA, 1625 bp, Homo sapiens
  misc_feature (1436)..(1436): n is a, c, g, or t
tccccacgggacccccacggccggggcctttacgggggggcccgggggggggtgcttcccgtcccacgggccccccattgtgtgactcttggacacgttccccggtacacgggtgccacgtgtgtcgtggacgtggccctccgcggtgtgtgagcggggggtggggacacacactggacacttgcgtacttccactgcgtggacacgcttggacgggaccgcggtgtgtggccgtggtctcacacagcgggtgactgtgcacccacccttgtgtgacacacacactcttctccagcgggtgtgagacgcgtggacacacacaccagctgcctctctcgcggctgtggtgctgcgggctcaccccacgtcggccgcgcgtcgcgtctctcttggtgcgtgtgtgtgtcacacacgcgcacgtgtgtggtgtgtgtgcgcgcgtactgcgccgcgtgtgttggcgcgtgtgtgcacacgcgcgcaccgggtgtgcgcacacgtgtgagcgcgggccaccgcggtgtgtgtgtgtggcgtgtgctttgtgtgcgccccgcgggtgttatcacggccacacacacacgccttctctctactcagcgggtgctcgcagggactcgcacaccctctgctctggctctcttcgcacacactctcagcacagcgggggcgaccttctctctcgcagcggggtgttgtgtgacacactactctcacgggggtgtgtgtgtgtggtgtggacgacacccaccgcaccacacacaccacagcgcacacaactgggaagctgtgtggagcgaactcaccaacgggagccgagaagcgtgatccccgccgcgagggcaacgccgggagcagaccaccccacaacagagttgtgggagtacaacacacacagcaacgggggggaggaacaacaacattaaccacacgcccgcaccaaccacaacactctgtggggagaccacagcaacgtacgcaaccacgacggggagtgccgcaaccaccaccggggggtgatgtggagtgaactaccgaggagcaccgacatcgttggtgaaaccaccaacaaccaacgaggtcgggacatacaaccaaacctactcggttgggagccagggcgaacacattgacacccacaacaagcacggggggagataattcaaaatcaacaaccataatcaagcagggggggggggggggggaggcacaaacaacaaacacaaacacacccactatccaccacaggatggagcgaagaacaccgacaatacacacaaccaacacccacaacacctcacacggaaaaacaaacagaagcgagccggggggggggagcgggtaccaaccacccaccagcaacacacacaacaaactacgtgcggagtagagacccacataggggcgaaaccacacattatagaggcgccactacngccacaacgaggagagcggcatcacacacattgggtgggcagcacacacgaaggaccccacaacacaagactcaacagcaataggtgaccaagagcagccacaaccatacggtggggggagaccaagaaggagacaacctcacaaacaccaaggaggggaggggcccccaacagagcaacatcccaaga

SEQ ID NO: 655582 - DNA, 140 bp, Homo sapiens
  misc_feature (123)..(123): n is a, c, g, or t
gtgagcgtctagtggtcacttacgggtaaggtatacggcctttctctcacatgaccttccggtgcgtccttcttcgggacacttctgggcctctgagccagcactctcatgcttctcttcccnttgggcaccttaaatcc

SEQ ID NO: 655583 - DNA, 874 bp, Homo sapiens
  misc_feature (52)..(52): n is a, c, g, or t
  misc_feature (62)..(62): n is a, c, g, or t
  misc_feature (65)..(65): n is a, c, g, or t
  misc_feature (78)..(78): n is a, c, g, or t
  misc_feature (83)..(83): n is a, c, g, or t
  misc_feature (87)..(88): n is a, c, g, or t
  misc_feature (96)..(96): n is a, c, g, or t
  misc_feature (102)..(102): n is a, c, g, or t
  misc_feature (149)..(149): n is a, c, g, or t
  misc_feature (202)..(202): n is a, c, g, or t
  misc_feature (204)..(204): n is a, c, g, or t
  misc_feature (208)..(208): n is a, c, g, or t
  misc_feature (214)..(215): n is a, c, g, or t
  misc_feature (220)..(220): n is a, c, g, or t
  misc_feature (224)..(228): n is a, c, g, or t
  misc_feature (231)..(231): n is a, c, g, or t
  misc_feature (240)..(241): n is a, c, g, or t
  misc_feature (272)..(273): n is a, c, g, or t
  misc_feature (289)..(289): n is a, c, g, or t
  misc_feature (291)..(291): n is a, c, g, or t
  misc_feature (294)..(294): n is a, c, g, or t
  misc_feature (298)..(298): n is a, c, g, or t
  misc_feature (304)..(304): n is a, c, g, or t
  misc_feature (311)..(311): n is a, c, g, or t
  misc_feature (324)..(324): n is a, c, g, or t
  misc_feature (328)..(328): n is a, c, g, or t
  misc_feature (342)..(342): n is a, c, g, or t
  misc_feature (346)..(346): n is a, c, g, or t
  misc_feature (361)..(361): n is a, c, g, or t
  misc_feature (369)..(369): n is a, c, g, or t
  misc_feature (379)..(379): n is a, c, g, or t
  misc_feature (384)..(384): n is a, c, g, or t
  misc_feature (387)..(387): n is a, c, g, or t
  misc_feature (401)..(401): n is a, c, g, or t
  misc_feature (403)..(403): n is a, c, g, or t
  misc_feature (409)..(409): n is a, c, g, or t
  misc_feature (411)..(411): n is a, c, g, or t
  misc_feature (418)..(418): n is a, c, g, or t
  misc_feature (423)..(423): n is a, c, g, or t
  misc_feature (433)..(433): n is a, c, g, or t
  misc_feature (439)..(439): n is a, c, g, or t
  misc_feature (443)..(443): n is a, c, g, or t
  misc_feature (447)..(447): n is a, c, g, or t
  misc_feature (450)..(450): n is a, c, g, or t
  misc_feature (466)..(466): n is a, c, g, or t
  misc_feature (481)..(481): n is a, c, g, or t
  misc_feature (529)..(529): n is a, c, g, or t
  misc_feature (545)..(545): n is a, c, g, or t
  misc_feature (562)..(562): n is a, c, g, or t
  misc_feature (564)..(564): n is a, c, g, or t
  misc_feature (566)..(567): n is a, c, g, or t
  misc_feature (577)..(577): n is a, c, g, or t
  misc_feature (590)..(590): n is a, c, g, or t
  misc_feature (617)..(617): n is a, c, g, or t
  misc_feature (625)..(626): n is a, c, g, or t
  misc_feature (631)..(632): n is a, c, g, or t
  misc_feature (651)..(651): n is a, c, g, or t
  misc_feature (653)..(653): n is a, c, g, or t
  misc_feature (659)..(659): n is a, c, g, or t
  misc_feature (663)..(663): n is a, c, g, or t
  misc_feature (671)..(671): n is a, c, g, or t
  misc_feature (675)..(675): n is a, c, g, or t
  misc_feature (681)..(681): n is a, c, g, or t
  misc_feature (688)..(688): n is a, c, g, or t
  misc_feature (703)..(703): n is a, c, g, or t
  misc_feature (707)..(707): n is a, c, g, or t
  misc_feature (710)..(711): n is a, c, g, or t
  misc_feature (714)..(714): n is a, c, g, or t
  misc_feature (716)..(716): n is a, c, g, or t
  misc_feature (735)..(735): n is a, c, g, or t
  misc_feature (740)..(741): n is a, c, g, or t
  misc_feature (744)..(744): n is a, c, g, or t
  misc_feature (763)..(763): n is a, c, g, or t
  misc_feature (769)..(769): n is a, c, g, or t
  misc_feature (772)..(772): n is a, c, g, or t
  misc_feature (789)..(789): n is a, c, g, or t
  misc_feature (861)..(861): n is a, c, g, or t
tattcatccaaaacaaatctttaaaggactcaaattagatataaattatgtncacctctganctngttataaatcatntttancatnnaaacactnaaactnaagctttcttctccttataggttgccatcattttcttgatctctgcnatagctttccctggattcagacccttaggacaggtccttgtgcagtgcatgangnggtngcagcnntatanacannnnnccncctgcagcnnggccaggcgctcctctgtgaagtcatctctnnagtcaatcatccagcnanacncctncataanaactgcnggccccagatatntgtntccgttccaccagnagcnggggcagctggtgtnacagcagncatagagaangcacnagnagagcccgtacagntncgcacncncttctanggacngtagagacgnctgctngccntccnganaggcagccttcggcgncaaagaaggcgcatnggagttgtacgggtcagagtagggccgcaaagcgttattaagatccgntatcacagacaggtgngggagaggggagagggngnanntcgtaggcangggggggggaagncggcgggggcaatcgagatgggggccnccatttanngtcannccacaacacccacacaggncngcgcgncagnagcggcgnaagngcaaangagatgnaacggcaggcggaancggnagnnaancngccaagaccatctccccanagggnnganctcgcaacggcagaactcnccagantancgggcgcgccacccggngcgctctgccagccagacagcccaaatggcggcatacccccaccgcgcccgtcaccgcgcgccccgccgccncaccccgccaccc

SEQ ID NO: 655584 - DNA, 716 bp, Homo sapiens
ggcatccagaataaaaatcctgacagataaagaagaagcagagagaaaatacaacgccagtatgcggaggcatatagaagtgctgtcggatgctaagtaaacgggcacatctgatgtacatatagtattgagctagacgaaaggattcaaatcggtgtgcaaggatgggatgcgtggaagtccatttagacaagtccatcttgatttaggctggcacagttcgcttaacccatgatgatgtcattcagaggagatcaaggcggtaggaagggactccaatgtgtcatttgactttctttgaaggaccctttgtagaggacattcatctgggaatcgaaggggtccccgtaggtaagccgtaagcccgtagggacggggtcgctttcttctactgcgcttcagtggattctccgtcttttgtggaacgtggaattttcttctatttgatacaggatgtgtacttcatttgggtcactaggtcacgggggcctcatcttcattgcctcttcacacgtgcattaggtggatagtggccatgggccaacttgcgaagatcgatatcaagcttcaacttaacaatgggttaatggccagaaaaaatcactactaagagagaattgtcgaggaacgggtcaagaaagagtagaaagttgaagaagatgggcagattgaagtccttaacaataaatggcaaggagcaggtgctgcggcttgga

SEQ ID NO: 655585 - DNA, 476 bp, Homo sapiens
ctcacacctataatcccaacactttggcagaccaaggcagtaggatcacttgaggccaggagtttaagaccagcctggacaacacagcaaaacctagtctttacaaaagaataaaaaagttagctgggtggggtggcatgtgcctgtagtcccagctacttgagaggctaaggtgggaggatgccttgagcacaggaggtcaaggctgcagtgagccatgatcgcaccactgcactccagcctggccagcagagtgagaccctgtctcaaaaacaagcaaaaactggctgggcgcggtggctcacacctgttatcccagcactttgggaggccgaggcggacggatcatgaggtcaggagatcgagactatcctggctaacacagtaaccccgtctctactatccactatatgcctggcgtggcgacaggagcctgtagtcccagcttctccggtggctcaggcaggtgattgtcg

SEQ ID NO: 655586 - DNA, 175 bp, Homo sapiens
cccgttccgatgcccatggacatgtgtgtgtgtggtggccttgagtatgtgctttctctgtgtaacagtcgcgccatcattgttatatggttagtgtgttggtctagtaagcctagtatgaggagcgttatggagtggaatttaaatcacatgccatggagccatcgggacgggg

SEQ ID NO: 655587 - DNA, 110 bp, Homo sapiens
caagttattaccatgtattttgtgaggcaggtttacaacactacaaggtctttgagttaagaaaggacaagagggaaacaggaaaaaacaaccattacccaggttttaaa

SEQ ID NO: 655588 - DNA, 109 bp, Homo sapiens
tagacatgtcatcagcataagataagtatgctggcgggtaggcccggaacccggagcgcggtcgggggaactgggcactgaatcatcggacaacctcgacagagcccgc

SEQ ID NO: 655589 - DNA, 169 bp, Homo sapiens
ccgcggagtcaacgtgagcctcacgctctccaacacgggcgcggtgcccggcacgatcaacgcgatcgaggcgacgttcaacacctacgacaacggctggacgccggaagaggtcgcgcaggcgttccagaagctcgccgcgaagcacccggagtcgcacccgcaccat

SEQ ID NO: 655590 - DNA, 136 bp, Homo sapiens
tctagaggatccctctaaacgtatcagaacttataggtctagaggtaaatgggattcatgaggggcagaggtcaaaggtgaagcagaagtcagtggtgaaggaaggtctgcaaagttaaaggtgcggtttccagag

SEQ ID NO: 655591 - DNA, 179 bp, Homo sapiens
ttgtctatgcagcatacatacagagactgggctcttaccacttccgtatcacaaaagaccatcacacgattctaccaatgcctgtcgcatctgtaattcacgaacctggtcaaccaacacatcatgttcacttcgaacccccatttcatttcaaattcaacagaaaaacacaccttttc

SEQ ID NO: 655592 - DNA, 412 bp, Homo sapiens
ctacagcagctatccaatggcctgtataccatggacgttgctatctatgtctctaacctcacctcctgagtagctggtattacatggcacgcaccaccacatctggctaatttttgtatttttagtagagacagggtttcgccatgttggtctcgaactcctgacctcaggtgatccacccaccttggcctcccaaagtgctgggattacaggcgtgagcaattgcgcccagcctcatctcgttgtattcttaagaggtaatcttatatttgaggtttgcatttactagaattttatatatgtggaagcattgagtaggtactcttttttttcctggattgtactcagcattatgttgggatttacttgtgtgtcagctgttcatacttttttcttacgtgagtagtaatgg

SEQ ID NO: 655593 - DNA, 280 bp, Homo sapiens
gtctctctgatccacttctgccatatccactgtgtcgctcatgcctctttccctgtttttaccatgtctttgctgttgtgaatagtgctgtaatgaacattcacatgcatgtgtcttatggtagaatgatttatctccctctgggtatatacccagtaataggattgttgaagtgatggtagttctgcttttagctctttgaggaattgccatactgctttccgcaatggttgaactaatttatactcccaccagcagtgtataaatgttccttttctcc

SEQ ID NO: 655594 - DNA, 135 bp, Homo sapiens
gtatgacgtggaagagagacacttacctttccaccgataacttttgaatttcatttttattaaagtattaacatagtttatggtgtcaaatctaacaaattggcaagctgtttctgtagatgggtaagtaatcaa

SEQ ID NO: 655595 - DNA, 1047 bp, Homo sapiens
gccggccttcctcggctccggcgctccggtcgcggggccctgggttcctcggcacacctccggtccatgccgtcccctagagcctgtccccagtcctcttctggaagtccccgggcgccacgcccgtgtgccctcgagctggtgagcgtatgaccggtatgctgcagctcgtgcactgcatacctgcagaagactagctgggagaactcgaactaaaagatccagctggaaacggcttaatctcgcgaggttcttaatagcatgactaattgatctactacacgatgaggaaagtccggttcattactcttgggcgcactcctagcatagcacctatgtagtgcaagcggtggggatagttcctttcacacggccatccaatcgtgtacggtatatccctcagagaacggcatttgatttccgctcttcccggaccctttctctataacacctgaaataagtttcaagttaacaagtacatagatcttgggtcacacctaagaactgcgctgggactaaacataagaatggaggttgcaatatggttggttgacaacttttctaccctaactttcccgtttccactttgcaagagcccgtgagggcgtggccacagtcaatttacaggcgtaacttggggttataatattggccacacaacaggctccaaagcgaaagtgagcaaaactggactgtgaggagataccccaacgttataattcgcccaaaccgacctgggcctgtgagtttaacaacgaccccacaatttcgcagagttttggaaatttatatacacgcttagggctttcccacaatttcctaattacacggtttgacattatgtgccccttgggggaggcgccccagaggagaaaaaacgccgcccatattaaacagggtcgcgcgtcggcgacaggggaagaccctttcccagaagcgagcccgttggggcccttaaaaatagaggttgagcattatcgagggaaattgtgtgggtaccagtaggtgtcgccggacaaacagagaaggcgagaaaaacactctgga

SEQ ID NO: 655596 - DNA, 370 bp, Homo sapiens
cttgcattcactcatgctagtgttcgataaaccagaaacggaactgtggggtcaaagagacttctggagaaaaatttgtcagtggctgccgtcctgcctctccccccagcaccatgtgagggccatctatgcccaaactcatggcaatcaggactctgaatcttggggatatttgccaaggggggtggatgaaagatattctctctgtgatttccttttgtactttttttttttaagggacattttaataatacatttaagagcctctttctgtgtcccttcttgctggtagcctctggccaatgccctggtggtcactagccagttctgatcatttgcaagagctccagatagtccagggaaatgaggc

SEQ ID NO: 655597 - DNA, 1143 bp, Homo sapiens
  misc_feature (376)..(376): n is a, c, g, or t
  misc_feature (532)..(532): n is a, c, g, or t
  misc_feature (882)..(882): n is a, c, g, or t
  misc_feature (1024)..(1024): n is a, c, g, or t
  misc_feature (1143)..(1143): n is a, c, g, or t
tgggttagagcacagggtacttatattggatgggtcctatgacaaggtgcgggttccctaggcccctcccctcttacaaggggtctacttggcaatctgtaaggaggggaaatccagtgttgggtggggggactgatgtgtgtgggcagggactccccagcagtgaggtgtctctctcttcctctggtgctctggctgggggctggttgttgggtccagggggtctaaactctcttggaggccatggtggcgccatgatgtgtccaccaccctgttggctggtacgccaacattgcggttggtccattaccccagggagaaatgagccgtcttagaccacaaattgtggtgtcctgttgagacggcgcaattggcncatggcccccagggctgtcaaaagtgtgtggagaagagactgtgggtgttgtaccgctgtgtgtgagaaaggtccaagatgagaagaccccaccgtgggttgctctcccagtgtttgttagcccccagagatattgccctctttgagaggtgtgtngcccctctccgcgaagacgctctctagatcttttacacgacacctctttctctgtgagattggtaactatacaatatattgggggcacgaggtgtttttttctctaagacagcgtgccaagggtacaagtgtccacacacccattgtgaaccatgctgttgggcgacaactgtgggggggagaaccaccggggagacagtgggccccatttcgcccaaaggtgagaacgtctactcccccgtgggtacaaccaaggtcatacaaggggggatttagcaacccttttttgggcgcccaacaccagggcccttttgggtcgacactcgcgcgctccatatgattaatacacntgccgcacgggggagaattcagaattgttgtcgcctgggagaaaaaaatgccccctcgagcatggggccacattaccaacggcgccacaaccaaatgtttttccccccgggagaagggggcggcgcatattcccaacaaggngttcatcatcacttaggggtgtttgggggcaatcagttagaattttggagcacatttggagcactggtgtgggcgcaccaaagagaatggtccctttcccccaagaggaatataaccan

SEQ ID NO: 655598 - DNA, 132 bp, Homo sapiens
agctctttttctgttttccctggcccatttcgttttgggaaaaaaatttgtccggtattgggatggtaaagacctttttgccctccgaccgtttacagaaattaatgttttttttgtttttcagaaaaaaaa

SEQ ID NO: 655599 - DNA, 141 bp, Homo sapiens
gtaccgcctccccggtttcatcccgagtcgtcggccgactatcgagcgaacccggaggacgtcgtcaactggtcaagctgcttaacgacgtcaggaaagtcgccatctttgccggcgcgggtgtcgagggcgctcacgatg

SEQ ID NO: 655600 - DNA, 151 bp, Homo sapiens
gactcatagacgatccccgataaaaagacatccggatacatggttgtcgagctatatatcattgagtttcctaggttatcgtgatgagcacaccaattttacagtatgaagcccatatatatcacagccatttaggtaacagccatttagg

SEQ ID NO: 655601 - DNA, 228 bp, Homo sapiens
ttactctctatctatgagataaccatgtgatagacagatatagacctcttactctttgcacaatgacatagattgaagagaatatatggatataatagatgacccttttcggtacaatggtactgtaactagagattgcattgaggtgtttctagtgggtaatgtaacatgtaattacagttaagtgtgaaaccttggaagacatttaggtttaatgtggttcataaa

SEQ ID NO: 655602 - DNA, 251 bp, Homo sapiens
tcaaaaacacacaggattggtctcctattgatcattctgctgccagtgatacttgtcctatactggagatttcacttacatactgctgacattctacaaatgttaacttgaacacaaatcagctacatatcattagattttaaatctcactgcaagctgtactacttatgcatctccatcagcataatctgaggcagtccaaactaaagcattatttgaaacatatcagggcttaaattccattgtaatag

SEQ ID NO: 655603 - DNA, 949 bp, Homo sapiens
  misc_feature (934)..(934): n is a, c, g, or t
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacagcagggaactgaggccagaccacccaggaagagccccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggangtcagtgtgcactgg

SEQ ID NO: 655604 - DNA, 354 bp, Homo sapiens
tgctcgtcacctctgtttccaccgccgacacactgcacacctacatcccttggacccaaaacccactgctgctgctggtgtggacttctagcgtatgggcaatgccagagaacactccttagagtggcttgaattcccctgcctgttcctcataaaatcagcaacaactggagccaaggaccaccttccctcaagaaacaaaaacaaaggcaacaataaaaactgcgctctaggtaaaacaggcagttaccactcccaagggatttgtgggctgtctataaagcagaagaaagtgtcacttcctccaccttcaggaggaacactgtccaagtaggaccagccatgcaggtcagg

SEQ ID NO: 655605 - DNA, 232 bp, Homo sapiens
taagagaagatcttgctctctttcttactcaggctggagtgcagtggtatgatcacaactcactgcagcttcaacctcctgggctagagtgaccctcctgctcaccactacacctggctaattttttttttggtagagacagggtttccctatgttgcccaggttggtcttcctactcctaggctcaagtgctccttctgtctagcctcccaaagtgctgggattacaggtg

SEQ ID NO: 655606 - DNA, 940 bp, Homo sapiens
  misc_feature (925)..(925): n is a, c, g, or t
agcgggcggacgccgagcggccagatcaggtacgcggggcgggccctgcgtccgcccctcccgccgaggctgagcctgagacccggggcggatcgactgacgccggggccgggatggcgacgcctcggccctgcgcggacgggccctgctgctcgcatcccagcgcggtgctcggcgtacagcagacgctggaggagatggacttcgagaggggaatctggtcggcagccctgaatggagacctgggccgagtgaagcatttaatccagaaggccgaggacccaagtcagcccgactcggccggctacactgcgctgcactatgccagccgcaatgggcactacgctgtgtgccagttcctgctggaaagcggagctaagtgtgatgcccagacccacgggggtgccactgctctgcaccgagccagctactgcgggcacactgaaatcgcgcggctcctgctatcacatgggtccaaccccagggtggtggatgacgacggcatgaccagtctgcataaggctgctgagaggggtcacggggacatctgctccctcctcctgcaacacagcccagtctggtcactgtggaagcgagggagtagatttggtgtggctaaaagtgtttaagactggacagatgatcatattctaaattagttcatatgagacatctatttatttggaaaaaaataaagttatatccttacctcatcccacacccaaagataaattgcaagattaaagatctaaatataaaaacacaaaactatgtaagtattagaagaaagtagggactatgtgagaagctgctttctagctgaatgcccttggtaaaagtcactttagctgtctgcccctccatttcctcttctgtaatgagagtggttatcatagggcccgcctcagagtcattgtgggaggangtcagtgtgcactgg

SEQ ID NO: 655607 - DNA, 186 bp, Homo sapiens
  misc_feature (59)..(59): n is a, c, g, or t
tttattacgagcatattctttaagaaaaaaaaaggctggataatatcctctgtactatnccagtcctttacaagccaaatacttgtgtcactgtttctagtatttccaagaagcattatgtaacgttgtcccctgtgccctacatagtataataattggttaagatagctaaatgataaggccaac

SEQ ID NO: 655608 - DNA, 306 bp, Homo sapiens
tgaatatggttgaacacggtggcatcatactgctcagccatctctggggttaactgcagatgagataattcctgtataactcctggatcctctagggcattctgccactgtatccacacttcatggtacaagggcgaatggacagatctccagcttccaagtgaaacgtgaaggcgactcgacaaggatttctgttaggacaatagttttgcttcatgaagaccaggaaggcttgaactcaggacaatgggtatcttgaatttactcagttcccatctcttaagttattaaacattatttcccaaa

SEQ ID NO: 655609 - DNA, 248 bp, Homo sapiens
cctgtcatctttcatcattcttcagtcttgtgtcaatcagttgcaacatggggttctcttccaattcctgcctgcaggtggtcatttcagccatgtcagggggctcatattttatcctattcattatccaacagttcagttgtggcatcagcacatccaggcatcatacccattggcacagcagggtcaacgcagccataccaccattgtggcaagacccagccatgtgcacatccagcagcagcagg

SEQ ID NO: 655610 - DNA, 194 bp, Homo sapiens
tggggagggagatacccccaatgtgtagcaagatctgtgagcctggtacagcccgacctacaaacaggacaagcactacggatacaattccatacagcgtctccatatagcgatgaaggactatcatggccagagatctacacaaaacggccccgtgcaagggagctttctcgtgtgtattcgagacttcctgc

SEQ ID NO: 655611 - DNA, 201 bp, Homo sapiens
  misc_feature (47)..(47): n is a, c, g, or t
  misc_feature (50)..(50): n is a, c, g, or t
gcagaatatcgaaatcattggtcagatgttatagcaggctctctggntgngcatatctatagcagtattctctggttgtgtgcgtcgtgaataatttcacagagagacacgcagaaaatgagcatatacacatagataatctcgcacagatgacactgcatcagcattcctcgtagtagtagagttcctctgtaaaagtaa

SEQ ID NO: 655612 - DNA, 137 bp, Homo sapiens
aagcaatatgaaatgatctgctgcagtgctctgagccctaggattcatctttcttttgtgtgatggtaatgagataatttctgcattacagattttcaggagactctttgtttaaatgaaactgggtaccgagctcg

SEQ ID NO: 655613 - DNA, 158 bp, Homo sapiens
caatatcaggtaatctgagtacctgttagagattattgaggctatggggggcaagaggcatgggatcagtctcatggtttattatgattcaaataatagctgtttctgaatgcagttgccaaatgcctaaaattttctgactggactgattctcactc

SEQ ID NO: 655614 - DNA, 132 bp, Homo sapiens
taccttcctctcctcccacctcagggaagaagagaataagaggagacaggacataagaaggtttagggagcctgcataacagctggctggaagaaagggtgggcttgaaatgtggaggtgggaggagaggaa

SEQ ID NO: 655615 - DNA, 162 bp, Homo sapiens
tgtctgttggcaacagaggacgatacatttgttgtggaatctctgtagctcccatcacaaattggttgtactatggtgagaaaaccattttaaatattttagcctgtagaaatagtagttttgtgatgtattgaacattttgtgatgcattgagtatgtgat

SEQ ID NO: 655616 - DNA, 502 bp, Homo sapiens
  misc_feature (47)..(47): n is a, c, g, or t
caagccaggtgggcaacatggcaaaatcctatctctactcaagaatncaaaaattacccaggcatggtacttgcacaactgtagtcccagctacttgagaagctgaggaaggagaatctcttgaacctggcaggtggaggttgcagtgagctgagatcatgccactacactccagcctgggtgacagagtgaaattctatctcaaaaaaaaaaaaaaaaaagaggccaggtatggtggctcatgcctgtaatcccagcattttgggaggccaaagcaggtggatcacttgaggtcaggagctcgagaccagcctggccaacatggtgaaaccctgtctctactaaaagtacaaaaatcagccaagcgtggtggtgcatgcctgcagtcccagctactcgggaggctgaggcaggagaatggcatgaacacaggaggtaaaggttgcagtgagccgagatcacaccactgcactccagcctgggcgacagtgcgagactctgt

SEQ ID NO: 655617 - DNA, 319 bp, Homo sapiens
tctctattatcgacgggaggtacaattaaaaccacagtgagggctgggcacagtggcgtgtgcctgtaatcccagcactttgggtggccgaggcgggcagatcacaagatcaggagttcgataccagcctggccaatatggtgaaactctatctctactaaaaatacaaaaattagacaggcttggtggtcccagcctgtagtcccagctactcgggaggctgaggcaggagaatggcacgaacccagaagccagagcttgcagtgagccgagatcgcgccactgcactccagcctgggcgacagagtgagactccggc

SEQ ID NO: 655618 - DNA, 312 bp, Homo sapiens
agtagaatattcttcagtttagccttcctacctctatcagtctgataacagaccagcctttattagtcaaatcagccaagcagtttttcaagctcttagtattcagtgaaacctttatatcctttacggtcctccgtcttcaagaaaagtagaacggactaaaggtcttttaaaaacacacctcaccaagctcagccaccaacttaaaaaggactggacaatacttttatcactttcgcttcccagaattcaggcctgtcctcagaatgctacaaggtacagcccatttaagctcctgtatagacagacgct

SEQ ID NO: 655619 - DNA, 120 bp, Homo sapiens
tcactcgccagtaggacgaacaggtcaagaagcttggcagcaaagttggccaggtacatagcggacgggggtcccgtaggtggaagacctattgccctccaagaagcacaccgtggagta

SEQ ID NO: 655620 - DNA, 361 bp, Homo sapiens
  misc_feature (106)..(106): n is a, c, g, or t
  misc_feature (116)..(116): n is a, c, g, or t
  misc_feature (134)..(134): n is a, c, g, or t
  misc_feature (137)..(137): n is a, c, g, or t
  misc_feature (140)..(140): n is a, c, g, or t
  misc_feature (155)..(155): n is a, c, g, or t
  misc_feature (161)..(161): n is a, c, g, or t
  misc_feature (182)..(182): n is a, c, g, or t
  misc_feature (243)..(243): n is a, c, g, or t
  misc_feature (262)..(262): n is a, c, g, or t
  misc_feature (274)..(274): n is a, c, g, or t
  misc_feature (281)..(281): n is a, c, g, or t
  misc_feature (291)..(291): n is a, c, g, or t
  misc_feature (293)..(293): n is a, c, g, or t
  misc_feature (301)..(301): n is a, c, g, or t
cccgcgtggacggatgacagtgtccaatgtctccgtgccaggcctctgtctccagaatgcacgcggccttcgggggaacctttcagaaggtgtatgattttctctncacgttgatnacctcagggatgcgcttnctnctnaaccagcagatctgncctgtnctctaccacgcagggacgggnctgctcaactccctcctggacaccgtgcctgtgcgcagttctgtggacgagcttgttggcnttgactattccctcatganggatcctgtggntttcacnagcaactggncntggacttncggggggccttcttttccctgactgagagggactggagccttcccaaccgggcagtggag

SEQ ID NO: 655621 - DNA, 292 bp, Homo sapiens
  misc_feature (56)..(56): n is a, c, g, or t
tttattgagagataattattgtccatctttaatttcctttcatgtgaaattcagangtaacatgtgtccactttaggtaacatttatatataagcggtctattagagatataaggtcgtctgacttttacactatttccaccttaggattcttttagataaagcagatgtgccttacggttcaaacacaatctgatgtacaagatcttatttagttcttagcaaataaatacagacacaaatgatgaaatgatggactattaatacctaagccaccgtaaagtttcaaaacc

SEQ ID NO: 655622 - DNA, 567 bp, Homo sapiens
ccagaaggtaactcacacaaatgacgggcggatcggatgataaggatgggggctgtggtgaacaatgtatcagttccacaaaggctctgtctgactgtggagaccatgtgaacggtacttgggagagatgagtgcagagaggagggctgcagggtgatgtaaccccaaaatgaaaggcggtagaagttagcaaaacccaggaaacgtttcaactggacgtaggttgaggccaatccaccgctgctttcaccaggatccatctggacatttccctcagcgatgatatatcccagaaaggagattgtagagcggtggaacttacacttctcggctttcacgaaagttggttctcgaggaggtgctgaaggacctgtctgacatgaagaacgtgttcttgggcagaccgggaaaaaaatcaggatgtcgtcaaggtagattaacacaaaacggttgagcatgtcccggagcacatcgtttacctggaagacggtatccgaaccaggtggtaggtctagcttggaaaaaatggtgaccctctggagaggttcacaagctgaggagagagtg

SEQ ID NO: 655623 - DNA, 390 bp, Homo sapiens
tgctttatttttctcgtttaggtcacagaatttttcaaagagtatgcccacagttttgtgtccttccccaccccactcccagaatcctagattaaaatctgtacaaatggccgggcgcggtggctcatgcctataatcccagcactttgggaggccgaggcgggcagatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggtgtgaacccgggaggcgtagcttgcagtgagccaagattgcgccactgcactccagcctgggtgacagagtgagactccgtctca

SEQ ID NO: 655624 - DNA, 593 bp, Homo sapiens
  misc_feature (418)..(418): n is a, c, g, or t
  misc_feature (458)..(458): n is a, c, g, or t
ggatggcacatgcatcgcaagtgggtgtgcggggcgctacttcccctatcatagaagagcttatcacctttcatgatcacgccctgataatcatgtgccttatctacttcctagtcctgtatgcccttttcctaacactcacaacaactatcctgcccgggagcatcctagagcttatcgcccttccatccctactcatcctttacataacagaccaggtcaacagtccctaccttaccatgaaatgaattggccaccaatgacactgaacctacgagtacaccgactacgggggactaatcttcaacctctacatacttcccccattattcctagaaccaggcgacctgcaactcctggacgtttacactcgagtagtacttccaattgaagcccccattcgaataataattacatnacaagccgccctgcacttatgagcaatccccacattaggnttaaacccaatgcttttcccgtccgcctaaccaaatctttttaaccttaaacgcacggcgctaccatcggtccctgcccttaattttttggcaatccaaatttatgcaatattttttattaactcccctaaattt

SEQ ID NO: 655625 - DNA, 551 bp, Homo sapiens
  misc_feature (292)..(292): n is a, c, g, or t
gcgccgccgggagaggcgagcgcgaggcagagagcgcgattcggctccaaactccggcgctgcagccgatcggactctgggccgcggtgggcaccgcgcgcagctagggagccgagaaccgcggcgagccccgaggacgcccagagcgcgagggtcgctgcgcctcgcagagccggagccgagtctgagcctgggcgccctgtggctgcctggcctgcggcggcatggtgggctgcccccgctggctctccgcgctgcccgccacctgcctcggccagtggcctggaggcanggagcgcgtctgagcccatggcgaggggaccctgcctgtcacgcctccaccccagaagagcaaccagcacgaaagccggacaggcatggtagtcccaggagcagacaatgagggataccagagcacaagagcacttcacggcgatatgagagtattgccatcgcaagcatcgacaagaggataccatggaaacttaggacgcagagcatacctttgacagagcaaaaaattgaggcattatcagcgcaatgtaggttgg

SEQ ID NO: 655626 - DNA, 440 bp, Homo sapiens
  misc_feature (163)..(163): n is a, c, g, or t
  misc_feature (172)..(172): n is a, c, g, or t
  misc_feature (179)..(179): n is a, c, g, or t
  misc_feature (182)..(182): n is a, c, g, or t
  misc_feature (189)..(189): n is a, c, g, or t
  misc_feature (201)..(201): n is a, c, g, or t
  misc_feature (235)..(235): n is a, c, g, or t
  misc_feature (281)..(281): n is a, c, g, or t
  misc_feature (315)..(315): n is a, c, g, or t
  misc_feature (326)..(326): n is a, c, g, or t
  misc_feature (337)..(337): n is a, c, g, or t
  misc_feature (355)..(355): n is a, c, g, or t
  misc_feature (364)..(364): n is a, c, g, or t
  misc_feature (377)..(377): n is a, c, g, or t
  misc_feature (380)..(380): n is a, c, g, or t
  misc_feature (433)..(433): n is a, c, g, or t
  misc_feature (440)..(440): n is a, c, g, or t
gcgccgccgggagaggcgagcgcgaggcagagagcgcgattcggctccaaactccggcgctgcagccgatcggactctgggccgcggtgggcaccgcgcgcagctagggagccgagaaccgcggcgagccccgaggacgcccagagcgcgagggtcgctgggngtggggagnggggggngcngagtggnggggggggccgnggggtgccgtggggggggggggatgggggggggngggggggtctgggggctgggggggacggggtgggcgagtggggggnggaggagggggtcgtggggggatggggagggggngggcggggggnagggggtgggngggggggggggggggggnggggggggnggtgggggggggnggntggggagggggggggggggtggggggggtgggtgtgggtggtggtgggggggntggtggn

SEQ ID NO: 655627 - DNA, 407 bp, Homo sapiens
  misc_feature (69)..(69): n is a, c, g, or t
  misc_feature (82)..(85): n is a, c, g, or t
  misc_feature (89)..(91): n is a, c, g, or t
  misc_feature (100)..(100): n is a, c, g, or t
  misc_feature (102)..(103): n is a, c, g, or t
  misc_feature (106)..(106): n is a, c, g, or t
  misc_feature (113)..(115): n is a, c, g, or t
  misc_feature (240)..(240): n is a, c, g, or t
  misc_feature (243)..(243): n is a, c, g, or t
  misc_feature (249)..(249): n is a, c, g, or t
  misc_feature (284)..(284): n is a, c, g, or t
  misc_feature (341)..(341): n is a, c, g, or t
  misc_feature (343)..(343): n is a, c, g, or t
  misc_feature (349)..(350): n is a, c, g, or t
  misc_feature (353)..(353): n is a, c, g, or t
  misc_feature (355)..(359): n is a, c, g, or t
  misc_feature (361)..(361): n is a, c, g, or t
  misc_feature (363)..(363): n is a, c, g, or t
  misc_feature (366)..(366): n is a, c, g, or t
  misc_feature (368)..(370): n is a, c, g, or t
  misc_feature (375)..(376): n is a, c, g, or t
aatccatgaggcagttactatcattcccattgcatggatgagggaggtgaggctcacaggagccaggcngcttgctcatgannnngcannntagggccantnnagngccaggnnngggcattggtttcccatgagatggaactgtaatcgtggagactttggaggtgccactcgggtcccctaagtcagacatgacacaaacacagcagggccacaaggacctcagccctatgcccatcnttntggccntgggcagctgtggtgtacacccggacccttcccanagtgcagatcttcactctcgctgaaatgcagtgcagaaaatattatttatggggtgncnttaaanncangnnnnntntnttntnnnttggnntctttgtaaagcctgaactttccattctgag

SEQ ID NO: 655628 - DNA, 1108 bp, Homo sapiens
ctatatggaggtgctcaataagcaaaagtggtcggaggctgctgtattggacagctcagaaacaagatttccatcaccacagaaaggtcggctggcagcactggaccaaggttgatgggtgtgtgctacacaggtgatatgctcactgtggtagctggatggagctttagctggttcgtcggaataaaagacggctggtttccgtgtgttcaaaaaaatgcaaacccatctaagaacacagaaagaaaaaaagggtcgagcgccgcgactctctagagatataatctccacttgcaagagggcgcaccaaaggctttaacgggctgtgtccccactgcgaatttttcttggcgatacacatattgagtgggtgcctcctatatagtttgcgaggagctccagacatatgtaatacagcgatcacggagactttggcgctcggtagctggttataacaaacaaggttgcgcagtccagcactgggggggggaaactaccttcggtggctgaaacccctttcggggccagatacctcctcgagtgctgcggacagagtgtacctcacttataacacactagatcggggtgcgatggtcgcgaacatctactttgagtgcgtaccaaacatcctatcccccatatgcagggaaatgcatctatacaacaacggcactccaaaaacggcgtggaaaacaggttttaaacagacatatgtagcaacaaagaggaggtgtatataagcgtgaggtggttcggcaaacccataatcgcaggatgggaatatacatgccgtttaagggtgaacggtgattagcgaaaaaaggtatatagggggcgtctaaacacagtggcggactacaccgcaaaacaggactgaccgaaaacaccaaatcatagatgaactacaccccagccagaggaggagaccatcccgacccgacgccgcaacacacaaaaacgaggaggaatgagcaaccaaacccaatggcgacacgaccccgacacaagatgtgcacaacaaaacactacaaccccacacacccagagccgagaacggagcgacgacacaacagatagaacacatctcacacggagaccaagacaagaa

SEQ ID NO: 655629 - DNA, 190 bp, Homo sapiens
gtatgtcggaccgatgggatacaggcatgtgccagcacgcctggctaattctgtaatttagtagagatggggtttctccatgtggtcaggctggtctcgaactcctgacctcaggggatccgccctcttcccggagtgcacggattacaggcatgagccactgcagccgaccaaaactgatataattttt

SEQ ID NO: 655630 - DNA, 137 bp, Homo sapiens
tgagacagaactactaacaagtatatgggcttacaattatacaaacttagagggcataatagaattgaattttgattgcctcttttactattatcactacgactgtctgctcacgatttctgtgccctatcaagggt

SEQ ID NO: 655631 - DNA, 115 bp, Homo sapiens
cctacgtggagtgcaactccaacagtcctctagaggctgtgtgagttgcaaggaccttggatcatgttaactacattaattctattctttccttttgtgccactacctatatatt

SEQ ID NO: 655632 - DNA, 534 bp, Homo sapiens
tgctaagcatagcatatatacttacgtcataagtaccccatagaagttagacttagtctgcacttcattgtcacatacactatcagcatttgcccctgccctagagatctgtggaacttgaacctgagagaggattaagggtatctggcagaaaaaaaattctaagcaggacagcattcaaaatatgacctgggtgctctgaaaaacatatcagttatatgcatttacaaagagttggcttgaacttggaacttatgtatataagggaagcagagcataaaggtatggaaaatttgcagcctcaccatatggtagaaaagaaaaaacccgtaaaccttcaagtcagctgcagaaatttgcataaagtcattagcaccccactgttaatcaccaagacgatggggaaggtgtctgtgtctccagggcatgtcagagaacttcaagacagcccctctcatcacagacccagaacctagcagggaaaaaatggtttcatgggctgggcccagagccccagtgctagtctgtgcagcc

SEQ ID NO: 655633 - DNA, 597 bp, Homo sapiens
  misc_feature (597)..(597): n is a, c, g, or t
aaaggaatgactaacattaagaaatgcgacagatagtcaaggaagttgaaatcagaacaagacatttaagagcaagtttgattttggagtgattgtgagcaggaagggcttgacatccggtaaatcaagaaagcagaggattaagaagcgagtgagctggaccaggcagaaagaatgggcagtgaactctcacaggaaatctgacagtttctcatcaatagacacgatcaattcaatcccattttgcagtgacaaatggcaaactgcatgcaagtcacagggggtatatgctgggttaatatgcatatctgtattttcagacgatacggagactgtgatacgtattcataatcaacatgagggagattactaaggcagttcttgtaaagaagatgaatgacaaatacaatgtcaggccaggcgtggaggctcacgcctgtgattacagcactttatgaggccgaggtgagcgaatcacgaggtcatgagatcgagaccatcctgactgacacggtgccccgtatctactatagatccaaggatgcaggactagtggtatgcccggtagtcggagctacagcgagctcagtggcgccn

SEQ ID NO: 655634 - DNA, 943 bp, Homo sapiens
aggactcttagtctaaagtacctttagactctgaagatctagcagctttttaggaccagaagttgggggtgcatttcccttgcatataatttaccagtttttttctttatcccaaaagtggctccagaagttcagccccttggggcttagttgccaggagctgtcctgtattccaccactctaccccaggccagaacaaggactcagccgtgctgccccctgcaggctcaggcctaggtctgtgggctgcttagggcactattgatgtcactgaagaaggagcaccttgaccagacagagattgtgaaggtgcaagtctagccacacctgaaccaaaagaaaaggagggagtgcggcagggccaggcagcagaagccagcacctgctgctcctcattagtaaccaaggcttgccaggcaacagagcaacaggtggagaaaggctagtgacccttcagaaagacccagttgattgggcagacacaactcaaggtatttgcaagccagccatctacaggctataggctacatcactacaggctactgagggagtcttcctgcttgggtgtcttcccgggtatcaccagaactccagcatcatgcgagtagcaggcgtataaagtcaagtgttcaggaacaggtagttctcactctttgttactctgaacaagatggtaacagggagggtcaccagtgagaatagtctccaagagctacacactcgcgaacagggcccttgcaagtgtcaagtaagcaggtaggattctcctctatggcctaggcccctaacgacccgagttttgttcgggccgaccaagaagccctaagagaacccgccttcatccagcagtgggtggccttacaagcaactaggggcagagagccaacgtgcacagcagaagggtggaacacaaaagagcgcacacgggggggagaagcagaac

SEQ ID NO: 655635 - DNA, 119 bp, Homo sapiens
atcccctgtaccgccgtaactggatggatggagcgccgtgcagtcccagactatctcgcggagagctgagcgcaggagaatggcctgaatcccaatgaggccggagatttgcatggcag

SEQ ID NO: 655636 - DNA, 385 bp, Homo sapiens
cgcaaggatgaggacggtgcttggcggatccccagcccccgggtatcagcggatctatgaggcgctggtgtttctggaggacatgccgagtttcaagttgcttgcgaaccgctgggcttagccttgatccaccgataaacaggctggttgtccgggtgtcggaatgatgaaagtgccctctgaactggaaagattggtgttctctacgcaacgatctgaccggttcaagaaaggcacttccagtgcaagtgtcccacacgttcggccctgactctgctgtgttcgacgaggacaatctcgtgtcctgcgcgggcctggtcccggtgatggccctggccgagcaagcaggcctgacgcggttgttggacaacaagattcacatcga

SEQ ID NO: 655637 - DNA, 167 bp, Homo sapiens
taggccggaccgggtggcggtgaggtggttacttgagatagtgatgctcacgatcagctggccaacatggtgaaaccgccatctgtactaaaaaatacaaaaattaagtgggtgtcgtggcgcatgccgtgtagtccgcagtgtagttagggcaggctgggtgcatg

SEQ ID NO: 655638 - DNA, 131 bp, Homo sapiens
  misc_feature (47)..(47): n is a, c, g, or t
  misc_feature (92)..(92): n is a, c, g, or t
atgattttgcatcagctagactgagttgattctgaccagactgtggntttgaagtcggaaccgattaaattttaaaaaggagaaaaaataanacctagttagtgataaaacatgaggcttttaatggtact

SEQ ID NO: 655639 - DNA, 114 bp, Homo sapiens
tctttggactaacagttaaatttacaaggaggatctagagggttctgtgtggcaatatttaacagttgaactaacgattctatcttggacaatccagctatcaccactccgcag

SEQ ID NO: 655640 - DNA, 204 bp, Homo sapiens
gtctgagtagataggactacacggtgccactaccacacccggctaatttttgtattttttgaagagatggggtttgccatgctgcccaggctggttttctgacctcaagtgatccacccacctcagtctcccaaagtgctgggattacaggtgtgagccactgcgcctgtcagaaaacactttttattttgaaaaaattttaaa

SEQ ID NO: 655641 - DNA, 248 bp, Homo sapiens
cttgctcctctaataataaggagctagcaggataccgatccaatggtagaatacctaccagatatccccagagactgaatctacctactaccaggtcagcctgcactacagatagctccagcgtgggcagcagtggcaatacccatgatagactatatgtaatgataagactttaaaccagctaattctaaagatgacatacttccgatggacctggggaccttctatcgggagtatcagaaccctca

SEQ ID NO: 655642 - DNA, 197 bp, Homo sapiens
ctgtatccctgcgagaacatgaagtgctagctgtgatgggatctggtggcgctctctgagtgcatcatgtacaaggtcccccatcatcagaaagaagtccttgaggcgcaccctgtccgagcgtgccctgcctgaaggacttccatgaagaagcacaagctcaacccagccagcaacatgtacttcccccgagatgg

SEQ ID NO: 655643 - DNA, 1256 bp, Homo sapiens
cacccctctacacgctgggcgtcaactacccggatgaaaacgtcgattccagctgctcgcccgtctacacttgccatcttctacacagcggccatcctgggtcccaggctgaccgtgctagccttgattgtggaaggatgcccgtgcgtgtagaatatctaccacgagagacattgtgtgcaccgacggcgaccggtacgtcgtgactcatccgaacgagctccactgttggtgttcggtcgcctctggatgggatcgtgctatcctggcgctctgtgcgtccgcctgcgtatatcttacaccggcacgttcccgatccatgtgtggtgtacctctacggtcatgctcgccagtgtgtccacacgcgactagcgcccggtcaatagagagcggctggagaactgacgacgcagattgcaacgggagcaagcagcccagtgaggtgaagcgactgacgccaagcctcaagggatcttatggcgaacaatctcatcacgaagaccttgacctctactcctaatccttggtctccgtgctgataagtagactcaccaacagttacatccatgcttgctgacctagagccccagggagtccactcagatgggcccaacttacctcccatttcaaactctgtgcaacttgttccccaccccgttgtacaagacccacacaaataggcatgtgctttagagacagtacgcccaatgaattatcaaagtcccttagcacggtttgcacctcccacgtatacgacttgacacaaaccatgtgcttgtagaggtacctctgggtgcgtagccaaggaccggagaattggctgggcttgagctatgctcctgtcccatgggtgttccgcgcctctacctttgtggctggaccctctcatgcccttctagtgccctcccgcggcgggttcctcccgtgcagcgctccatttcgaaccggcaatcttgtccctctgtttcccttggacattgccgccttgtttacctgcccctttgaccgtggcgaggccgtttcccctctccgtttctgttcaccttccaagctttgccaccattggtctccccctcaccgtcgattcgtccccgccctttggccccgagggcccctggttccgtcggaacacttcccggacgcttgcacacgaggccccggggtaagggcccctttccccccttatggcctccccgcaataatgtggtcccgaccgtcgctgttgtgaacaaccgccttaacagctgggcgccttc

SEQ ID NO: 655644 - DNA, 171 bp, Homo sapiens
ttggggctcattcaggtacagcacagctacagagccgggaagcagtgagctaggtgtcccggagcagcctgacctccaggtatgggcttggatttttaatggtccctcttcagtattccacgtggggggaaatgggcttgatcctatgggatcctttatggcaggactggg

SEQ ID NO: 655645 - DNA, 824 bp, Homo sapiens
  misc_feature (400)..(400): n is a, c, g, or t
  misc_feature (506)..(506): n is a, c, g, or t
  misc_feature (553)..(553): n is a, c, g, or t
  misc_feature (573)..(574): n is a, c, g, or t
gaatgggactataactgatatatcatgaccacaccaactgagggtgtggagtaggtcacccattggggatggaaaagggaggcttcggccatgcctgtggagaagaaaccaagtcagtaatctgcaagaaggcccatctggtcacatgaaggtcaatctcatggtcccacaataaaagccaacttcagaagccatttatgccaagagagactgtaaggtacctgcaccagctggaggagcagatgaaagcgaagaagtgctgcgctaccacaattatgcgaatgtgcacccaaccatgagcaatactttcattctgttcttgaggctcccagcttctgacacaaatgagctagggaaatttaaaaatgggaacagatgaagtaagagggaaagatttttnagaattgaaataagatctgaaaggaagttgtaagcattgattgaaatattaatacattaattgcattagaccatcagctcaatgtatgttttgatccataaatggncatgactataagtggcaagattaagtagtcactgtcaataggattanaatcccatagggaagtttanntttgctaaataaaaaagaaacctctctcttcttgtctttaaccgtacccacaacacacacgcaacaaacaacaaactttttgggcgccccgggagcccgaaacttttaacacacttcgttgggcccgggccccgggctaggacctggccacggcgtcagaaaccggccgcaacggtgggttccccaaaaaagccggggccgcgtttaacaacaaggggctggccctcggctcacagggccgcgtacgggg

SEQ ID NO: 655646 - DNA, 135 bp, Homo sapiens
aaaaaaaaaaaaaaatttggggaaggaaaaaagaaaaagggaaggggttaaaaaaatttaaaaagtaaaggggggcctaaaaagttaaagaaactacttagggggaaaggcccggcgtaacggggtaccgacccc

SEQ ID NO: 655647 - DNA, 329 bp, Homo sapiens
atatggaatgcggatatctctataatgcgggagaagtttgtgtctcggccgacagtcacatggccgccagtggaatttgggacatacaccttttgtgtgatgagttgtatactgatgccacattacaggagagagctgaacgttctctcaagccagaggaggaaacacattaaagtcccagaagtctctaatatatcctttggcttttttccagtgaggtaaaatacagggcattaatgcgcgggtacatatattccccaggttgtacttaaagtctaattaaaaccattctgtgttaagtgttacacaaaaaaacacaaaaaggggtc

SEQ ID NO: 655648 - DNA, 352 bp, Homo sapiens
gggggggggtccccacaaccccccccataaattggcgggaaggtttttaacagggttttttaaaaggggggggctcccccccaccccgccctttttttttaaaggggggggggtttccccttttcccaaagggggggggggggggggttttcccaaaacaggcccaagggcttttttggttttaaagggggggggcccccttttggggggttgcccccgggggtttaaaatttctttttccccgcccccccggttaaaaaaaccccccccccggtttccccccagttttttttttttttttaaaaaaaaaccgggccctttcccacaaaaaaacctttttttggttccccca

SEQ ID NO: 655649 - DNA, 614 bp, Homo sapiens
  misc_feature (349)..(349): n is a, c, g, or t
  misc_feature (459)..(459): n is a, c, g, or t
  misc_feature (588)..(588): n is a, c, g, or t
atttgttgtctggtatgtgatgaaatgaatgtaatctggatattccactttaacatctcaattgtaatatatgtacagtctgattttgtagactcctcactatatgtaatgggatacttgtggtggatgacatatcgtctcgttatattatacgtataatatatgtagataacacctgttttgtctgacgggtgttatctagctagagtggtcgcgatttagtacggtaattcacagagtgttatattctttcgtggataacatcctctgtctaatacgtcatattgtatgacctctgagtagcgtcccctgtgcttatattctctataacagtttcttaaataatgcntataatagtacactgagtagtactaaagagagactcttacttggattgctcatgtgggtatgatcataatatagactatatgatgacgcacatagtcccgcatattaccntatttattctcattttaaatacatagttatatcgtttcgatatggggtaaatatactcaaattcatacttggtagtagctcgcgataaaaatagagggagaagtagcatagttgtgagatttctacttntgttgcatcaatcatcctcttattct

SEQ ID NO: 655650 - DNA, 353 bp, Homo sapiens
agctgctctcactctgacccagactccgactgaggcagcctagcgaggaagcaagaactttaactagagggctgatctttaactggaaagctgcttatctcctttcaccacaccctccttccctgtgtcttttaacgccaaactgtctctgcctcttcccggagaatccagctgggctagaggctgagcacctttggaaacaacatttaagggaatgtgagcacaatgcataatgtctttaaaacgcatgttgtgatgtacacattttgtaattaccttttttgttgttttgtagcaaccatttgtaaacacattccaaataattccacagtcctgaagcagcaggaggagga

SEQ ID NO: 655651 - DNA, 249 bp, Homo sapiens
tctacaggatccccgctcgggactcagagggataacttaagagtacttacccagctacttgctttgtctatttatagtggaatacgtatacagatagtagttcaggcactattccatctcaattatgatacacattgcattactgtcttatttcaagaaaggaaataccaccataaatatcatggaccacgttacagaaaataaacataatgtgctttactgaactagttattcattcacagctcccga

SEQ ID NO: 655652 - DNA, 157 bp, Homo sapiens
  misc_feature (147)..(147): n is a, c, g, or t
agtgcttctgtctggtgtgattggcagccatagacagtataaatgtaggacagccagcgtccatatctgacctaactcagggctgccgtcaatcattaaccaccaattattttaattcccatgtcttcctatcctcaccctcttcangctttaaacc

SEQ ID NO: 655653 - DNA, 268 bp, Homo sapiens
ggtccctgccgttacgcccagccaagcccagccaagcccagccaatccccgcctgatcgcggggcatgtctgtgagccagaccccgtcagcggagagggacctaactagagcaccagcctgcatgtgaacttccttctctcactcattgcgttcccagcgttgccagctggtgacaggggagatggacgtaattttgcgtgtggaaagacttagacgtcttgcccggaagtgataagtcccggcctgtctgtacacgctgatgcccgt

SEQ ID NO: 655654 - DNA, 160 bp, Homo sapiens
tgagggagtatgtctttgaacacctccctcagtgcggatttatatatatatttttccttcactggtgtcaagtggaaacaaaaccaaaatttttaaaaaaaaatcgggccaggtgaccacattaacatgattctgttggtgcagacattaaatggtaatg

SEQ ID NO: 655655 - DNA, 175 bp, Homo sapiens
gatgagcacaaagtaccagctagctcgctcaccgaaggcgcataacaataagaaagatcataacagactcctgagaagcaaaatgaacgaagatctgttcgcttcattcagggcccccacaatcctaggcctacccgccgcagtactgatcattctatttccccctctatggatc

SEQ ID NO: 655656 - DNA, 194 bp, Homo sapiens
ccaatgcattccctttatactgtgtaagccaggcatggtggctcacacctataatcccagcaatgcaggaggctgaagtgggaagatcgttgaggccaggagttcaagaccagcctgggcaacctaagaagaccctgtctctaaaaaagaattaaatataaataaataaataataaaaatataatgtttaaacc

SEQ ID NO: 655657 - DNA, 101 bp, Homo sapiens
caggaagacatggtttcacaaaagaagcctacaagaagtacatcaatggattacatgaaatcaattcgaacagggaagcttgacagtaatcagagaccagt

SEQ ID NO: 655658 - DNA, 404 bp, Homo sapiens
ccggattattaacaaagtactttctaggagctataatcaaagttttaaaaagaagttaggatatatttagagtattccgatcgtgaaaacagataattgcccatgccaactacaaggacagacatgatgggaaattatgcacctggtcaaacttagcttataagcagacgatgctgtaaaaactaacggattctctgatatatattgtaagttattagtactgatctccttttccagatgctgcacactcctggttaggaactttaatagcgttgcaacgaaatcctatatccagtttcctgtaatataattgaagaaaaatacatccaaataaagactatattattaacagaccagatagcatcagaaatcatgtgactgttatgattatcagaatgtcttaa

SEQ ID NO: 655659 - DNA, 235 bp, Homo sapiens
ctcctgtcagcaattgcaatctggctttatagcatctatatgtccccagcacccagttctgacgccaggcacttcaaatgtctaggaattgactgaatgaactaagaactcctgtgatgggtccgggaactcgcctgggcacaaggtgccacaaggcacgcagcctgcccaggccctctctcctgtccatcccccacattcccctgttgtgtccttgtgatctcgcaaaatcgag

SEQ ID NO: 655660 - DNA, 272 bp, Homo sapiens
atagtgtggtgttatggacattttcctgcaggacatgactcactcaagtaccgcacgtatcttgttaagctcgtatatttcccataattcttcgacctaatccctgatttcgctgcggacctgtatattctcctgttactccactgacttctgcagattgtaatacatcccttagtgacattcccactgtgtactgaggtcgctgtccagaagccaccaagatattcgcatattctacacagagagcataggatcacgcaattccgggtacc

SEQ ID NO: 655661 - DNA, 182 bp, Homo sapiens
gggttctccccgtgctgtgccatatacgaacacacactggtactggggagagacctgtgaattcaacatcgccaagagcctcgtgtatgggatcgtgggggctgtgatggcggtgctgctgctcgcattgatcatcctaatcatcttattcagcctatcccagagaaaccgtcgaattcgag

SEQ ID NO: 655662 - DNA, 560 bp, Homo sapiens
  misc_feature (38)..(38): n is a, c, g, or t
  misc_feature (42)..(42): n is a, c, g, or t
  misc_feature (52)..(52): n is a, c, g, or t
  misc_feature (421)..(421): n is a, c, g, or t
gagataaaattcccatcctatacccacatttttctggnaaangaaaaccggnttcactcaaagacatgaccgatgcccatagcagctttgttcataatagccccaaactggaaacaaaatgtccaggaacagatgaatggataaacacactttaacatacccatgcagtgcaataccacgtggcagtggagagaaacgagctaccggtatgcccaacacacagatgaatctcagaaacgttactgtctgtggaagcaagacacgaaagaatgcagactgtgtgattctgttcataaggaattctggaatgtgcaaagtgaaactgtcataacaggaggcaggtcactcgttgctggaggctttggggtgggacgttagatggccagagaggaggcaggaaggcacttttaggggtgtgggnataacatctacgtgttagttgtgcaagtggatacaccagtacgttaatttattaggggtggttttgcatacacttggagtggcaacattttgttcatattaattatttctcaataaaataaaacaactttcatagttca

SEQ ID NO: 655663 - DNA, 1097 bp, Homo sapiens
gcgctttcggtgaagttctcccacggagaaagccatgttgcagtatcggatggcgccaacgatcgtgaagcccaatggcgagaagccggacgagttcgagtgcggcatctcccaggctcttctggagctggagatgaactctgaccgtcaatggctctagctcacgcgtgagctgacatattactggctagctaacggaaattgaaggttgcgtggtggtccgtgacacagctatcagtaatctttgttcccgttcctcgatcgtgagcatcttgtccgagcaaaatccgaatggtccggctagctacgcgatattcgtgagcaacagaagcttcaggtggggaaggcatgtcggtctttattcgctcagtaggcagcaattctgtgctaacgtccaatctcgaaaaagccgctatccatgacaattaagccacatagcgttcccaggaggccgggtactcctgaacagcctgtgcctgcgaatgccatcctttgagcgacttgggatcttgcccccaaagcgaacaagttggtacgcggcaatgatgaatccccgcgttcgaagagctaatgattgtgccaagacacagggctacagtatcacggtctccattttcgcgcatcaaaaggcaacaagccaaggaatcaccattgtgtgaaccatcctaggtttgtaaccactctttccctggtgggtccttagtccaggaaaggcctccactggggcccacgagattgctacaaacttcttggcaattttcggccagtatgttcctcaactttcgtgacacacctaacaatattggagctgtaagctcaaatgacccgctgctacttagtctttcaccattggtacaaagaatccattggctttcaacaggacataggtcttgcgggagcgctagcgggggttctcctcgtcccgaggattcctcccatgggtggggccggagtttgccccgtctcgcaggagcttcccctgggagcggcgtcctccccggggccgctcgccaggtgattgagtcccctctgtgcacgggggataccctggctggggggctccccgggggggggccttcggggccgtggccccccgg

SEQ ID NO: 655664 - DNA, 135 bp, Homo sapiens
  misc_feature (10)..(10): n is a, c, g, or t
  misc_feature (76)..(76): n is a, c, g, or t
  misc_feature (107)..(107): n is a, c, g, or t
ggggctgccngaccggccggccgccgcggcgcgggggagccaccgggccggccaccatggaggttccttgcagctnacggaggcgcggtgacgtgactgcggacctncctgacgaaggctggccgctgactgtgg

SEQ ID NO: 655665 - DNA, 454 bp, Homo sapiens
  misc_feature (119)..(119): n is a, c, g, or t
ctacactattatactcagaaagagaagctcaggatgctgaatgtaaatgctacagccatacagctagttaagggacagagctaatcccaaccaaggtccctttgactctgaaccctctngagaatgtgcagtccctgtgatcctttttttgcataaatggcaacaaagtagtccagtccaaacagcctccctgctcattcatgaaagctggagtgatggtttgtgcttggagagtgctcaagtagagaagagagacctgtcccctccctgcccttggtgttggcaaagggagcagggaggacacagagggaggcagacgccagctcctttccttgtggctctctccaggtaactggcagcctggaggaggtggcggcttaatgggcctagcccacgaagagaacttggacttgaaggtttaaacagcaacctctcaccaataatgaaagattag

SEQ ID NO: 655666 - DNA, 502 bp, Homo sapiens
actgtatagtcttaaaaatagcattatactggccaggggtggtggctaacgcctgtaatcccagcacttgggaggctgaggcaggagaatcacttgaacccgggaggcggaggttgcagtgaagccggaagaaccggcaaccaatggaatctcaagctcggggcacacgaggatgagaagatccgcgtctccaaaaaaaaaaagaaggggaaaaaacaaatagcattatacctcttcctggtctcaaccggccatgaaaattcggaaccactccaaatgccagcttgagtattcccagaaacaccagtctctcagggtattcaacacatatttctaaccttccttatagtaactacgtcatactttcaaaagcctcagggtatatcatcttcctaaaccggctacaatccagggcagctactttaaccaactagtgtctctagtggcgaaccaactaggcctattccactgctgtgtagcctcagggcctacctgggtgcca

SEQ ID NO: 655667 - DNA, 875 bp, Homo sapiens
gctgtggtctacatcattgccgtgctggtgcgctcatgtctactgcatgaagcgtgtgcaaaaccatgcgggtgctgaagcaggccaagggcgagcgtagccagtagcatggtagagtgcctcagacggtgggccttttgacggagcagggtagcacctcagacagagatccaagaggaattggctcttggacccgcattgggctctcgtggccctgcggtcactcatagcaagacggccacgagcatcgaagtcataggaatgcacattcctcgacaggatcttagccttgaaatgacgcattcaacgcaacaggctggggacagagctgagtcaggcggaagtgatctctgagccacaggcttccgcgggttggcatgcagggcagtttgtgcgtgaacccgtggtctactctgtgtgcccgacggccgtgacgctcggaagggtgctgacgcggcggacggctgtcgtcactctctcgggggcgccgattagtcgctgtagtctggcggaccgacgtcggcgaactcgcccggctgggtagccgcgtcagtgcggacctggttaccctgccaggatcggagcttggcctacactggtggcctgggcatgtgttgcctcgggagggattgcctttgagagcctactcgcgggggttcctgccgagaccaagagcatggctgccttgggaggctcaggcgtgccacgtcccccagcacgccctgggagcggttgtgaggcaggatgtggtgggcccgagttttccaacggggttccagtgtcgggggcctgttcccgggaagggacgattgggctgccttcggggcctaggcgtttgtggcctaactgtcctggttcgtccccccaaggcacca

SEQ ID NO: 655668 - DNA, 340 bp, Homo sapiens
ttcctcttgaataacgcctataccgtaatgtctactttctaagaagcaggcaactagaagtgtaacaatacattccaggccttttatttcaatagtaaaataatacatgtcttgttctaacactttatcctttaccccttttctatttcgatcctctttggcaatcttatgtcatagtttttcccgggttaaaaatagtctccagatgggtaagatatacacagagaaggaagatatattacaaaagcaccttttagaatatcccatgttctggcaatacaaacacgttcttctgaaaggtagctactcccagttttttgcagtaatgttagagatacgg

SEQ ID NO: 655669 - DNA, 297 bp, Homo sapiens
agccctttggggctttgggggcccctaagtagaaaattcctatgggcctgtttcctgggggcctttgtttgctgggggtttgcttcccccaaaatcctaaggggcaggggggcctgggcatgggtttgtgggacccctcccgcccgttgggtttggccaagggcccccgtcggggtgttgtttcctggggcctcccggctgtaggggtttccaaatgggggggggggttgggggggggccccagttttttttttaaaatttaaactttggtaagacccttttatttgggccccccca

SEQ ID NO: 655670 - DNA, 546 bp, Homo sapiens
tagctgtactgtacccccgcagcatagtatcgcacctggcttaggatgcatcgcgactgcgtagagaactacctgtgatctagtagagaatgaatgaaaacagactcagaaaaaagatctggctctgtctcattcggaagaagctgcaggctgtattccccatgcacttgcttcctggctgcaaaccttaatactttgtttctgctgtagaatttgttagcaaacagggagtcctgatcagcacccttctccacatccacatgactggtctttaactgtagcactgtggtatacatgcaaacatccgttcaaaatctgcgtcgcagactataatagaagatgaacacacagaaataacgaataaaaggtcttatcctcataattaggaaattttaatcgaaaacaacacacatgtacacaaaggtgtatctaataagcaatatataaggcagtgtctagattaccgtgctagcctgggcatcatggcaaaacaccaattctacaagaaaatgccacaagttagcagtgcatggtggcatgtgcctg

SEQ ID NO: 655671 - DNA, 130 bp, Homo sapiens
taaaaaaaaggcctttggattgttcaaaaaatcatgggcccttcaaaaaaaaggaatgctacttttttgtggtttacggggatttttttcaaatttttaaaaccctaataaaaggtcccttaaaatccca

SEQ ID NO: 655672 - DNA, 1018 bp, Homo sapiens
  misc_feature (28)..(28): n is a, c, g, or t
  misc_feature (87)..(87): n is a, c, g, or t
  misc_feature (99)..(99): n is a, c, g, or t
  misc_feature (108)..(108): n is a, c, g, or t
  misc_feature (119)..(120): n is a, c, g, or t
  misc_feature (134)..(134): n is a, c, g, or t
  misc_feature (143)..(145): n is a, c, g, or t
  misc_feature (161)..(161): n is a, c, g, or t
  misc_feature (171)..(171): n is a, c, g, or t
  misc_feature (173)..(173): n is a, c, g, or t
  misc_feature (185)..(185): n is a, c, g, or t
  misc_feature (196)..(197): n is a, c, g, or t
  misc_feature (199)..(200): n is a, c, g, or t
  misc_feature (205)..(205): n is a, c, g, or t
  misc_feature (212)..(212): n is a, c, g, or t
  misc_feature (218)..(219): n is a, c, g, or t
  misc_feature (221)..(224): n is a, c, g, or t
  misc_feature (228)..(228): n is a, c, g, or t
  misc_feature (230)..(230): n is a, c, g, or t
  misc_feature (234)..(234): n is a, c, g, or t
  misc_feature (263)..(264): n is a, c, g, or t
  misc_feature (287)..(287): n is a, c, g, or t
  misc_feature (298)..(299): n is a, c, g, or t
  misc_feature (301)..(303): n is a, c, g, or t
  misc_feature (306)..(306): n is a, c, g, or t
  misc_feature (308)..(308): n is a, c, g, or t
  misc_feature (315)..(315): n is a, c, g, or t
  misc_feature (325)..(325): n is a, c, g, or t
  misc_feature (328)..(329): n is a, c, g, or t
  misc_feature (331)..(331): n is a, c, g, or t
  misc_feature (333)..(333): n is a, c, g, or t
  misc_feature (335)..(338): n is a, c, g, or t
  misc_feature (343)..(344): n is a, c, g, or t
  misc_feature (346)..(346): n is a, c, g, or t
  misc_feature (360)..(362): n is a, c, g, or t
  misc_feature (371)..(372): n is a, c, g, or t
  misc_feature (391)..(391): n is a, c, g, or t
  misc_feature (413)..(413): n is a, c, g, or t
  misc_feature (438)..(438): n is a, c, g, or t
  misc_feature (481)..(481): n is a, c, g, or t
  misc_feature (942)..(942): n is a, c, g, or t
  misc_feature (1011)..(1011): n is a, c, g, or t
tctgcacaacgaaactgaggctattganacgtacaccagaaacaacacattcaataacatagaagaaatgtctgcaaaaaaaaaaanaaaaaaaaatanacacttagntcaaccaaccnncagcccccccaacncaaaccccnnnatcaagcctcccactngcacactttncntacaaagattgngggtgggaatnngnnatttngtttgcncggggnnannnngggngnccgncacccgcacccacagcctttcctgcctgnntcccacatcaagggatatcagtntcatagaatannannnaangnggcgcangcgtaccagnganngnantnnnnctttnncnacccagctcatttnnntaaaaacgnngggggctattggggcgaangggggcataatgggggggggcnggagggccagggggggctctttccnatcagcacatcacagagcagacagactacctgcggggggggtnctgcacctcacgggcccagggccgtctcttcccagccctctccctcacatgctctgccagtctacacacactggagcaaaccccagctgtctccacccagatgggtggtgcccctccctccttaccaagatgccagagtcagaggggagggagtagtcaatccacaccgagcctgccacattgcagggccgtcccaccccgactcaggagtcagcacagggaggggtgggggggtctttttcctcgttctctatgccacttacttactacagtgcaccttggcagcagtcagcactgttacccgctgatggccgaggaagaaatgcgaagtaggcttgctcttagcacagcgagagatcactctagatatggctatggaggaaggtttgcagacagcagggtcggttcagaaaatcaattccacaaaatgcatttatctgagatccaaacccttcgcatanccagtgtaaatttattttttttacagcatccaataaatcccagtaaaggggctaaatgaagatcttaanatgaaaa

SEQ ID NO: 655673 - DNA, 250 bp, Homo sapiens
tcaagttcgacaactggtaacctgatgtatggtgaaaggaggtgctaagctaggaagaattggtgtgatcaccaagcagagagaggcaccctggactctatagacgtggttcacgtgagagctgccaatggcaacagctttgccactcgactttccaacctttttgttcttggcaagggcaacaaaccactggatttctcttccccgaggaaagggtatccgcctcacccttgctgaagagaagaaacgc

SEQ ID NO: 655674 - DNA, 113 bp, Homo sapiens
cccaatggcttggctgaagcggccattgtcttgtaatcttttggtataacctttctaacataggatgccgcatcttcctccgtgtgagacctcagcgctgatagcacctcgtc

SEQ ID NO: 655675 - DNA, 1665 bp, Homo sapiens
  misc_feature (113)..(113): n is a, c, g, or t
  misc_feature (212)..(212): n is a, c, g, or t
  misc_feature (987)..(987): n is a, c, g, or t
tgttaacgtggtagactatagagttcggcgtggtacaaaagggcggagtaaatatttgtttttgccgcgccccacgagagaggtcccctctgtgagtagaagtgtgcaatttnctccacctaagacggcgctcgcgtccctctcctgttgtgtcgtaggtgtgagtacaattaagacgggacatgaggcagttgtgttgttggggtggcgcnccccccgccacctatagagtgatagaatgaaggtgtcgcttttcttgtccgcgcgagaaagaattgatgcgccacaccaagagatggcgagtggtgtaattagtgactccttcgttaatttgtgtcctgactagtaggggagttacatatataagttcgctctccatattatagggtcctcctccttctagttttgcctaccgcccccaaagggggaggtaaaatatatattatgaggcgcgccaccagtaataggttggaacaccacgcgagacccctttctggagaaaaagatgttgtcgggcagcatttttggggccctgcaagcaggggaattgttggggccgcaccaacagagagataagataagctccttggtggggaccacaaacaacttcttgttgctgtgaaagtagggttgaagaccgccttgctctcctaccgggagtacttaccctcccccgcaactactattgtggcgccgcgctcttgtttggtgtcaactcgaccaccaggagatttctccaccagaagaggggtaaagttctaccacaacattgtgaggaagaggttggtgaggagcggcccccccacaagagtggtgttctctcgatgaacaaaagtggtggtgttggtgtggcacaggcgtggttgtcgtgtgtcgcgcctcttcttttctgtttttcacacaatgttctttctctacactggtgtgatacaccctccttttgtggttgtgagagagtctctctccaacacaccaggggcgttcttntcgtcgattatgtaaacaccactacgtctctgtgaggagagagatctgtgttgagagaagacccgacactacagtagagtgtggcgcactgctgggggggtgtaacccccccaccactttgctgtgatgagatcctctcgctgaatatatagttgaacgctctatgattagtcctcgacaccaccaggagccgtgctgttgtgtttttattaggcccacaaagtactcactactatagagagagagacgcgcgataaagtgtggctcttgggacacgagatatatcacgcctgtgtgagattggcgctcgcgagatctctcttgtgtgtttaaatatccggcgcatcacatctctgcacactggagagagagattgtgagattcacagtgagagagatctcttatatacctggttgtgtgaaaaccgccttcacaaagagggccacataaacttcccgtggcccttcacacaattgtttgtttccaccgccagaggtggagaatgaaagaaaaaagagccaccccacttttgtatagaaaggtggaagaattctggccacccgggagggaaccacgatcccaccggcttattagaaaaaatgtaactaaggtgtctaccccatgattatattttctaagactggttggtttaataacccgtaccctgctctccaaatt

SEQ ID NO: 655676 - DNA, 364 bp, Homo sapiens
gcacgaggtgaaacatgatgcaatcataagtcataggatgtagtgatttctcacctgtgtggctttccttcaaaaagttgtatgcagcctttctgtctgtgtttgctcactgttgtatccccactgccctgagctcagttcatatttgttgaatgaatgaagagttcccaaaggagtagacaagacagaggatacctaacttgtaatacatttagatttgggttactattccctgatgccttaggatctttcacaagcacacctaacacttgggggttctgtctagcctctaggacccatctgttctctacaggtgctccttaacttatgatagggcaacatcccaataacccattgtaaagta

SEQ ID NO: 655677 - DNA, 329 bp, Homo sapiens
  misc_feature (54)..(54): n is a, c, g, or t
  misc_feature (177)..(178): n is a, c, g, or t
ggctgaggcaggagaatggcttgaacctgagagacagaagttgcagtgagccgngattacgccactgcactccagcctgggcaacagagtgagactccatctcaaaacaacaacaacaacaacaacaacaaaacagttgtatcccagtaaataaaatggtttagatgaagtgcacanntttttggaaagacaaaaactaccaaaactgactcaataagaggaacagacaatctgaatagacctgtaacacgtgaagacactgaaatagtagtcacagaactgcccgcaaagaaacagcctaggcccatatggctttactgctgaatttt

SEQ ID NO: 655678 - DNA, 503 bp, Homo sapiens
gtcaaatcggagaaaaaaagcttttgaggggaaacgaaaagaacaggaagaaaaagaacaccaaattagagaacaaatactttaacaaagaaaacagaagttttgagaaattactgaaaaatttcagcgtgcccatgttcctctttcacagcggaggaaagcagtttcccgaaaaccagttcctccattagaagaggccctcaaacaaattcaggaattcacttaaaatcagaaagtaacctttcccttttccgtagaccaacaaataacttgagagctatagattctggctttgctttcggcttatcaaaaatgatcacaggcttcagaacaactcttattcaaatcaattgtgagaaaagaatggatggaaacatgagggcaactttgctactagcaaaatgtgtttcagcttaaactgggggaacttagaacctcttgagatcaccatctaagcattgctttgtgatgaaggtatcgatacccatctgcctttctattgc

SEQ ID NO: 655679 - DNA, 137 bp, Homo sapiens
tcagaactctgggatgcagagcgtgtgcggttgcctgcaagtcaggatttgagaccagcctggcaacatgtgaaaccctgtctctaaaaaaaaaagaaaatttagccaggcgttatggcttgcatttgttggtccca

SEQ ID NO: 655680 - DNA, 221 bp, Homo sapiens
tcattcttgtttttttgtgcttttttgtgttcttcagttttttctttttattgtgttcatggtctgtgacaaactaaaccaccctttttggggttattctcaaggcaggttttagctatttaagtggggggcccaactaagggctttcatggctggatctacttttcaggctaatttgtccaattgttagcgaggccctggatccctggtgggtgttccct

SEQ ID NO: 655681 - DNA, 326 bp, Homo sapiens
tagggtggtcatggaactttgagattaaaagcattctacaggccaggcgccgtggctcatgcctgtaatcccagcactatgggaggctcaaataggccggatcacaatgtcaggagatggagatcaacctggctaacatggtgaaaccctgtctctaataaaaatacaaaaaattagccgggcgtagtggcgggcgcttgtagtcccggctactccggaggctgaggcaggagaatggcgtgaactcgggaggcggagcttgtggtgagctgagatagtagcgccactgcactccagcctgggggacagagtgagactccatctca

SEQ ID NO: 655682 - DNA, 189 bp, Homo sapiens
aatgtcaggatatcatttggcacccactggatcagcagtcagtgcagcacacatcctcaacaggtgtcataaaaaaatagccagtaaatgataggctacagcaaaaccacactgaaacatttgatgaatttcactgccagtcaaacagacttgtgcaacacttgaaacactcagaaccatgactacacg

SEQ ID NO: 655683 - DNA, 151 bp, Homo sapiens
ggcgtgcagcggcctgggaggagagtggggccgccggcgcacggttctcactgagcctgccgggaggtaagcgcctggtccagccgggccccggctgtacccgccctcggtccaacgcgccttcccaccccgggaaggctcccgagccctg

SEQ ID NO: 655684 - DNA, 739 bp, Homo sapiens
ccgctaccttcacgccaatggtcgcctcaagtattctttatctgcctctgtcctacacatcgggcgagccgcctatagttacggatcatttctctatcgtcagaaacctgcaaacatcggctacttatcctcctgacttgcatagctagtatgcaacacgccttcatatggctattgtcctcccgtgaggccaaatatcattctgaggggccacagtaattacaaacttactatccgccatcccatacacttgggacagacctagttcaatgaactctgacggagtgcctacgtcagtacgacagtcccaccctcacacgattcttatacctttcacttcatctatgcccgttcattattgcatccctagtcagcactccacctcctattcttgcacgaaacgggatcaaacaaccccctaggaatcacctcccattccgataaaatcaccttccacccttactacacaatcaaagacgccctcggcttacttctcttcattctctccttaatgacacttgacactattctcaccagacctcctaagcgacccagcactattataccctaacccaacccttaaacacccctccccacatcaagcccgaatgatatttcctatacgcctacacaattctccatccgtcctcacaaactaggaggcgtcttgcctattatatcatgctcatctacataatcccttctcctattccgacacaagcttatatttgccctaaca

SEQ ID NO: 655685 - DNA, 1084 bp, Homo sapiens
  misc_feature (18)..(18): n is a, c, g, or t
  misc_feature (135)..(135): n is a, c, g, or t
  misc_feature (969)..(970): n is a, c, g, or t
  misc_feature (975)..(975): n is a, c, g, or t
  misc_feature (1004)..(1006): n is a, c, g, or t
ccctcacacccatctcancgcatatgcaagagcaagaggggctgataggatgtcttcatttggtgattttgttgcattgtccgatgtttgtgatgtaccaactgcaaaaattatttccagagaagtatctgatgntataattcccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgtacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactgactgaagtttctatcagctctgatgccttcttccctttccgagataacgtagacagagctaaaaggagtggtgtggcgtacattgcggcatccctccggttctgctgctgacaaagttgtgattgaggcctgcgacgaactgggaatcatcctcgctcatacgaacttcgggtcttccaccactgattttaccacacactgttttttggcttgcttatgtgtaggtgaacagtcacgcctgaaactttgaggataactttnnaaaanaataaaacagtatctcttaatcactggannnatagttaaaaaaaaaaaggagatgaacgcactacccagagctgacccaaagtacgaacgagacaacgaagctactagg

SEQ ID NO: 655686 - DNA, 1152 bp, Homo sapiens
  misc_feature (18)..(18): n is a, c, g, or t
  misc_feature (135)..(135): n is a, c, g, or t
  misc_feature (1037)..(1038): n is a, c, g, or t
  misc_feature (1043)..(1043): n is a, c, g, or t
  misc_feature (1072)..(1074): n is a, c, g, or t
ccctcacacccatctcancgcatatgcaagagcaagaggggctgataggatgtcttcatttggtgattttgttgcattgtccgatgtttgtgatgtaccaactgcaaaaattatttccagagaagtatctgatgntataattcccccaggatatgaagaagaagccttgacaatactttccaaaaagaaaaatggaaactattgtgtccttcagatggaccaatcttacaaaccagatgaaaatgaagttcgaactctctttggtcttcatttaagccagaagagaaataatggtgtcgtcgacaagtcattatttagcaatgttgttaccaaaaataaagatttgccagagtctgccctccgagacctcatcgtagccaccattgctgtcaagtacactcagtctaactctgtgtgtacgccaagaacgggcaggttatcggcattggagcaggacagcagtctcgtatacactgcactcgccttgcaggagataaggcaaactattggtggcttagacaccatccacaagtgctttcgatgaagtttaaaacaggagtgaagagagcagaaatctccaatgccatcgatcaatatgtgactggaaccattggcgaggatgaagatttgataaagtggaaggcactgtttgaggaagtccctgagttactcactgaggcagagaagaaggaatgggttgagaaactcagggacttccttcttctctgcctcagtgagtaactcaggcagagaagaaggaatgggttgagaaactgactgaagtttctatcagctctgatgccttcttccctttccgagataacgtagacagagctaaaaggagtggtgtggcgtacattgcggcatccctccggttctgctgctgacaaagttgtgattgaggcctgcgacgaactgggaatcatcctcgctcatacgaacttcgggtcttccaccactgattttaccacacactgttttttggcttgcttatgtgtaggtgaacagtcacgcctgaaactttgaggataactttnnaaaanaataaaacagtatctcttaatcactggannnatagttaaaaaaaaaaaggagatgaacgcactacccagagctgacccaaagtacgaacgagacaacgaagctactagg

SEQ ID NO: 655687 - DNA, 174 bp, Homo sapiens
gcacagatggcgggacatgccacgaggagggggggaaggccggcggcatggatggccgtgggggacactggagtcaggctggacagccctgtcggtcagcgtgtcacaccaacatccagctctgtgtagtagaagtcctcctctgtgcgctccgctgcggtggggagtcccggc

SEQ ID NO: 655688 - DNA, 132 bp, Homo sapiens
  misc_feature (26)..(26): n is a, c, g, or t
  misc_feature (103)..(104): n is a, c, g, or t
acggacgtccagctgagatctcctangcgaaaaaaaaaaacactagttaatcaacatttgtggtccgccgaaataaccattcgtaacgttagacccccacctnntcgaaatgtagactggtgtgagtgggag

SEQ ID NO: 655689 - DNA, 389 bp, Homo sapiens
ttacacggagctgtccggataccacagctacagcacctatgctcacggatcactctcgatagatcatgtatcacagacgagcacgatgagcagcaactgccgactaggtacagcttcccgagaaaaaaggtcatcgctcttctggtggcagtcctccttgaaagaggttgctgatgatgttgctgcccgcagggacacaaattgttcttgagcactgaggtggtcacagcagtcagtgtgctggagccacagaagtcaatcgtctcgtgaaaggtcttcaccacagccttggcgtagatggcgtcatcatccaccacggactgctgtagggcctggtcatagaactgcttcacatccttggcgatctggtccttggcctgtggtaaaga

SEQ ID NO: 655690 - DNA, 887 bp, Homo sapiens
  misc_feature (474)..(475): n is a, c, g, or t
  misc_feature (527)..(527): n is a, c, g, or t
ggtctagctgcgttcatgggtatatcttaccctgctgtggaaaaagagcgagcaggagatagagagaggaagggagaggcatgtcagaggagggaggcttcccataaatgtcagttaggacaattcaagccaaacttcaggggagatgccccctccgaatattcagccttcttattgaaaaatatgatgatggagaggcagggaggatttgcagagaaacgtaaacgaaatggtcaaggaaaattcaattagagtccttaagtgatggggagagggtgagaacaccagacaaaggcagggaaataacgaaagaaaaagattgaaagctgagcgagctcttattggaactgagtgtatgtgcgttggacttgatttatgacctttaagtgttttggcaaagatggaatattgctgtcatagccataaagtcactttgaattattgagagagagagagagtagtgggagagagacnncgaagagagagggtggagggcacacgagactgcaaaagggagtctgcacatngagaaagagacaggctaaatgaaagagtgctagagtcatggtaataaacaaaacagtcaatttaatttattcaaaatgctacactccacgagggaatttcgtggagacatggtgctaagaatattgacggttgcttttaagcgttgagaagagcagaggcggagacacaaggaaggacaaaaggaaaacaaaagacaaaggcgagggaacagcatattggacaaagccattaagttcattttgcgttccaccggtcagtcgttttttccgagcttcagacagtgcgtgtcaccagctctgtggaaaccgttgggtgggaggaagggaggagggatttggcttgtaggctaaccctgggaa

SEQ ID NO: 655691 - DNA, 526 bp, Homo sapiens
tatggatgtgatttgtactctttctttaaacaagcaaacaaacagacaaaaaaccttccaagctctgtaagctttaggctgcccaggcccagactcgggcctcggctgtgggaagttttagtttgggctacgatgttggtgccacatctgctgcatgtcctcagggggctctcatcccatagcagagatctgtcataggtgagagtcatccctacggaagcaacacctgaaaggcatccagggtgagccagttctggggcaggctgaagcctgtcgagcttcactggccaggtaaatcaggagactggaaaggcttctctgacttcaatcttcctcttctgcaaatatggagatgagaccttcctggaaaggttaaaatattgaaccataggtgaaactgcctggtctagccccaggcttgtgctgggagctcaggaactgctgatgaaagctggatggagatggctcaggggagcgcatgcctttcatggggatagtctggcctgctgtctgtcaaattaacctg

SEQ ID NO: 655692 - DNA, 341 bp, Homo sapiens
gcaccaccatcactttgccttgcctggctccagatgagtaagaacgtggccacgccaggccaagtggtggcagtggcaccagaagagttgtctgcagggagcccaggcagcccgaaaggcagggcagtggtgcagcaggacgtgtgtgcggcccaggctggtgctagcttcccgctgggctccagagtccggacgcacacacagtggctgaaagcggctgctggcgacctgacgcctcggcccgggctgccgtcctcgcaccacaccagcggcctcggagcgccgccactgccacaactcggctcccccgcccggacacagctcggtgtctgcagcggcgc

SEQ ID NO: 655693 - DNA, 171 bp, Homo sapiens
tggtgggttgctgggtttcagcgcgattgccttcaaccatggtgaggtctgcactgccggctcgcgctgctggtcgagcgttcgatcaaagacaccttcctgccgtcgggtgatcgaggccctcaagggctggaaaccctggcaatccactggaccagaacgacccaccga

SEQ ID NO: 655694 - DNA, 186 bp, Homo sapiens
gcgttgctgggggaaacagaatgggtacttgagtctaagctttagtggcaggccacagggcggggaggggattcaggcctggaccatgcccaggacagaaaagcaggagcagaacactattccaagaaagaccttacggaggaactcttgaggcgcaggttgcagcaggaagttacaccccgggct

SEQ ID NO: 655695 - DNA, 416 bp, Homo sapiens
  misc_feature (165)..(165): n is a, c, g, or t
  misc_feature (372)..(372): n is a, c, g, or t
  misc_feature (389)..(389): n is a, c, g, or t
  misc_feature (407)..(407): n is a, c, g, or t
agtctgtaaactccttcccagcatagggacccatgtttccatgttgctttgtgccccccagtgccctagccatagtaccctagcacatgataaccctcccacgtttttgctgaatgtgaaatataaagaattaagcagctgggcacagtggctcacacctgtaancccagcactttgggaggtcgaggggggcagatcacgaggtcaggagttcgaaacccaggctgaccaacatggtgaaaccccgtctctactaaaaatacaaaaattagccagatgtggtggcgcacacctgtaatcccagctactcaggaggctgaggcaggagaattgcttgaaccccggaggcagaggttgcagtgagccgagatngcaccgctgcactccancctgggcaacagagtganctctgtcta

SEQ ID NO: 655696 - DNA, 177 bp, Homo sapiens
  misc_feature (176)..(176): n is a, c, g, or t
gacctgggacgtaaatgatgagacgggtactttggcggacatgaaggaactggcatatggaaccttggctgtgaagctgcagactataagacagcatgagacgacaattctgctactgcaatgatgacatcgtttcagaccacaaaaagaaaggcgatgaccagagccgcaaggcng

SEQ ID NO: 655697 - DNA, 666 bp, Homo sapiens
ttccggtgtcgatgggtcatcggcacgggcggtccgctctatgggtctgcaagtcggtaccacatcacggatcatctgccttatgggctcgggtgatgatggttcctcgacatcgagcttgcccctgtcgggtttgcgtacgagttccacgtcactgagcttccgcgtcctgggttcggtaggtggttccatctaaggcgtcatctgcatcatgggtcagcgtggtagtactgcctcagcctcctgcgtagctaatgagagtgtcttgacattatcatcgtctcagggtgtgagcagtctccgcagacgtcgacagtgtgtcctgatacagtcatcagctgagggtggagctgagggtgaaatggtagtgagctgacgctcgataggtgtctggagatgatcatccattgagggtgtaagcggctgccgcagacgctcggcaggtggcgtgatattatcatctgctaagggtggaaggggagttagctcacgcaggaaaggtgtcttgagattatcatccgctgagggtggaagcggtcgcctcagacgctcggcaggtggcttgatattatcatctgctgagggtggagctgagggtgtaacgtgagtgagctagcgctcgaaaggtgtcttcagattatcaagcgctgagggtggaagcggccc

SEQ ID NO: 655698 - DNA, 1527 bp, Homo sapiens
  misc_feature (55)..(55): n is a, c, g, or t
  misc_feature (171)..(171): n is a, c, g, or t
  misc_feature (472)..(472): n is a, c, g, or t
  misc_feature (541)..(541): n is a, c, g, or t
  misc_feature (613)..(613): n is a, c, g, or t
  misc_feature (697)..(697): n is a, c, g, or t
  misc_feature (767)..(767): n is a, c, g, or t
  misc_feature (938)..(938): n is a, c, g, or t
  misc_feature (1387)..(1387): n is a, c, g, or t
catcatgctgcaaatgaatgagtgccaggcatcaccatcactaaccatgtatatncatgatgaatgtgcaatgtgtacgatgcttgttcccaaccactgtatatcaacacccatacccatgccatgcaccatccattacagtgattacattcaattggcatgacatatccnacagaactcatgaacactgttgcttgacaatacatatcacatcactaagccaaaatttgctcaatctaatgaccaaagtcctcgacattgtgacttgctcaagtggattgccatacccatcactccaatatccaacaatattgaccactggatgcctaatcctgtacatatgctaggcctccataagaacacacacaatttacagtaccatattgatggacacagacatataatttctatatgtgtatcctacatgaatgtcaattgtccaacacaacaagactgttgtatggcataaacntcaattcaatacaccatggacacacatgagagatacacacctgatcactagtcactgcctttgctattntcttgtctgcatgtcataactacacatggacatagatccatgacaaccactgtttaccaaccatgttactcntacatcttattgtctggacatgtggagcgtaacggccaaagatcccatcacgaaaaacaatcctatacattgactacatgttcntccaatagtatacaaatatgcaaaacaaagcactgactggttcaatggtacaaatgtgttcctgggatantctttcgaccttgcttttcccattaggtttgggagaatcattgggccacacatcacttcaaatgaatgcctaatatattgcataattgtttgagggattgaaacatgaagaatggtaaaccattcaatgatatacacaagggaacgaattggaaacccattaatttcttgntcttggtgtttattatcttaaccagggagaataggattgtgatgtgagaaatttgatatcaatgtcacggacaacattgaatatataattatggatatgatgtagtttttctagtgttttaatttaccggaatttcttataatggtgttggtatagaatacacatgtatatcgataggataatatgacaagagaaccaaactaatgtatataattgatagatgatttgtctagttgtgctgttattttatgttggcatcccggggtgttcacaaaatgttagaacatggatccggtggactcatgtaaaacaaacattgttttcgtgctgcatacactactaaacatacagtagaactcaatgaatagagacaacaaagaagaacaaaaacagacagcgacacttattctgttgcatccgtagtgagttacttgtcatttacgcgatcnctacacactagaagagacctcagtcgcaggtgtcattatgtatcttccttctcgtctgcctctcttcttcttctttttttcgttctttctctttgcttctctggtagcctcgtcggctccacaagaaaacacacaaaaca

SEQ ID NO: 655699 - DNA, 119 bp, Homo sapiens
gacacagttcatgtcagcccagcgtagccaagctcaggacaactccatgtacagtcccagacccagcctgtgtctttggctaacacccagccccgagtgcccccagcctcatctccggc

SEQ ID NO: 655700 - DNA, 357 bp, Homo sapiens
cgcgtagtgacgctctctccgctactgctgctacgacaagaccactggaggactaagctgcaggacgaaagcatgaagagcctgatccttcttgctatcctggccgtcttagcggaagtaacttggtgttatgagtcacatgacagcatgggatcgttatgaacttaatcccttcattagcaggcgagatgcaaataccttcatagtcccctcagcagagagtggagagctagagtccaagagatggatccgagaacgctcttaggcctgtccatgagctcacatagggaagccgtgtgatgactacggacttggcgaacgtaaggccaggggggatggatacaatgctgcctatga

SEQ ID NO: 655701 - DNA, 326 bp, Homo sapiens
  misc_feature (71)..(71): n is a, c, g, or t
  misc_feature (216)..(216): n is a, c, g, or t
  misc_feature (254)..(254): n is a, c, g, or t
  misc_feature (282)..(282): n is a, c, g, or t
  misc_feature (289)..(289): n is a, c, g, or t
  misc_feature (316)..(316): n is a, c, g, or t
acctgaggtcaggagctcgagaccagtctgaccaacgtggtgaaactctgtctctactaaaaatacaaaanttagctgggcacggtagcacgcacctgtaatcccagccacttgggaggctgaggcaggagaatcacttgaacccaggaggtggaggttgcagtgagcccagatggcaccactgcactccagcctggggaacgtagaaagaccgtntcaaaaaaacaaaaacaaaaacaaaagcacaggctgtnttcaagaaagagcaagatctggtctgantggagtngggatagagcatggggggtcaggggtnggaaaagact

SEQ ID NO: 655702 - DNA, 224 bp, Homo sapiens
  misc_feature (46)..(46): n is a, c, g, or t
cgctgacgagatgctaggcgctcggctggttaccgaacatctggancggtgatcactgcatactataatggggtgcactgcaaaatcttcagtctagagaacgagactaattgagaaccatgctcaatacttcctcaggttagaactgcagctgcgagctgatcttaaagtgcacaatctggctctgtttcgtcgaacgtcagctcgtgttccgggcagcgggc

SEQ ID NO: 655703 - DNA, 220 bp, Homo sapiens
aaagaattgaataatggcatgctctactctgggtctctaacgccacattggatacagaaggtttcttaactacttgattagaaaatcaaaattatatgtatcatgttaaaaaacaaaattatacagttcagaaggctgagacatggtcatttaaaataactatcattatggcggtgaaccgagatcgcgccattacactacatacggggcaatcaagctg

SEQ ID NO: 655704 - DNA, 311 bp, Homo sapiens
  misc_feature (73)..(73): n is a, c, g, or t
ctggaagactaataaaaggactgtgggggaaaagttaaagaaatctcacagaaagcaaggaaaaaagattttnccagtggcacacacctgtaatcccagctactcagaaggctaaggcagcaggatggcattagctcaggagctctaggccagcctggtcaacatatgaaatatcattagaaaaagaaaaaaaggtagaatctttaattaaaaaaaaaaaagatggatagaaaagactaccagtctaggaggtcaaacagccaaacatttgaaatcaagaacaagaaaaaacagaggtggaaaatcaatta

SEQ ID NO: 655705 - DNA, 1065 bp, Homo sapiens
  misc_feature (300)..(300): n is a, c, g, or t
gtcgcggcccatctcaactcactgggggcgcgctgtccatggcacgatcattgttatatcgtccccatagtagcccacaccgaaactttttgtccccaacaccctttgggtaaacgtgccacacatatggtgtgagcccaccccttgcgtttaaaaaatcttccgggcgttttcagggataatcgtccctagccaatctatatcttggtgtgggctctacgggaatcaactacgtgaaccacctgcttttctggcggccatcatgggagcaaaccttatggcccaaaagtattgcacctntatggtctttgtgaccctatagcccttcctgtggggacccatactgtttgccttcgcagatgtgctcccttttggccggccggcccctttggggcccataaagtttcgcagcgaccaataccctgttggggccctttccaattcggccagttggcatttggcgcttccctcaataggggatttcccctccacgtcccaggcggtccatgggggcccctttgtcgaagccccttccccggccgctgctcttgttccaccccccgtattcccctttcgccgtttcgcctgtcggcccccttactatcccgggcttggctctccattacctggcaacggggtgcaacttttggtcccctgtttccgtggcccctccactccggggtcattctctcgtccgcacgtgaacgcacaggcgatcgcgcatggcaacgcggcgacatggacgcgttgcgcgaaacgagttgactcgaatcccaacagcgtctccgatagaggagactgggccgcagcgactgacgtatcatatggagcctagcatacagtgccaagtgttgacccctttggaaggaacaagtggctccgcgtacagaggacccctcaagtaccttagggattgacatcctgggcctcaggtcagagcgcagccctgggctgggcggctcctcaggacccagagctgtcgcctggaaccatctcctgatgccatggctagagtggcccccatgacttctgcccggggtgttgaataccctcaggttcacagac

SEQ ID NO: 655706 - DNA, 444 bp, Homo sapiens
  misc_feature (438)..(438): n is a, c, g, or t
ctagagatcacgcagcatttcagcagcgtgaagggactcgtagctggtatcactgcagtgcttgtagcagctgtagaatctctgagctgcgtgcagtgtaattcatgggaaaaatcctgtgtcaacagcattgcctctgaatgtccctcacatgccaacaccagctgtatcagctcctcagccagctcctctctagagacaccagtcagattataccagaatatgttctgctcagcggagaactgcagtgaggagacacacattacagccttcactgtccacgtgtctgctgaagaacactttcattttgtaagccagtgctgccaatgcaaaggaatgcagcaacaccagcgatgccctggaccctcccctgaagaacgtgtccagcaacgcagagtgccctgcttgttatgaatctgatggaacttcctgtcgtgngaagcc

SEQ ID NO: 655707 - DNA, 1530 bp, Homo sapiens
tttggaaacacaaaggtttatttaaaaaaaaattgggtgggtagttctttaacatttctcaggggtgtgaggccaattctgtgggacccagtgtgccccaccacaaaagtgtggccacagctcgctgtgggggcgggggaaaaaggggaggggggtgaaagtgaaaaagagcccggtttttctcctctcagaggggcgtggggggtgtgtggagaaacacaccacacccctctttgctgtggtgtgccctctcctctgctggggctctccgagagagagaggagaacagacgagaagtgaaatatctctcgaggcgctgtgtgtggggttcttctccaacaaacccagtgtgtcgccccccgcagagggtgtgggagagaggagacgcatatagagagagcagtgtagacacagagaggggcgacacacagagagcgcacaagaacaagagagcagtgtgtgtgtcactcttagaacacacagacagttgatacacacacgcggaggggcgcgtgtgagagggccgtgtgagagagagagagaacactctcaagagatatcacaaaaactcacccgagtgttcatcacacaacaacacaaacacaacacacaaacacacaacacaacaacacacacaaatagaaaacacacacacagacgaaagacgacacacacaaacacacacaacacacacaaaaccaacaaacagagagagcaccacaaacagacaactaacacagacagacacaaaacacacagcaagaatacacaacaacagacacacacaagagggaggggcgcgcgccgcgagcgagcgagaggcaggaccacaagacacatctctcctccctcggagggcgaggagggcggaacctgagcgaagccccacgaacgacgacccacacacaacacagatggtagagaagaacaacgcaagaaaaacaagagacgaagggcacccacaccaaccaagaagaagggctacaacacctcaagcaaaaagacaaaacgagcaacgacacaaacccaaccaacagccagcgacgggagcgatgcagcagcaccacacagcacacaggggcgacaaaaacgcagcgacgaccacacaagagcagagcagcgacatcatagaggccccccaccactacatagccgagcaaacacaacaacacagccaccacacccgacggcaaggcaggcggcgacgaccaaaaccagcaccagacggcggtacaacaagacaccccacccaccagccacgaaaaacaaaacacctacggcaaacgacacgccccgacgaacaacagccggccaacagaagaggcagcacatcacaagccagcgccgaccacacccagccgcccgagacggaggacgaccaaaccgcagcagtaccacccacccaccgggtgggcgcgacgcggcaagagacaacgcagcaggccgaacagccacaacagacacgacacgaccccgacgagaagcccggcacccaacatcacgcacgcccagaacacaaaccacacgggg

SEQ ID NO: 655708 - DNA, 458 bp, Homo sapiens
caacacaaaacttcaatcttggcttcggtctgctttctcttcctctttagcaaatccatatcttgagtagaagttgcctttgagcataagatatctcttgtttcactctcgtggcgcttgtgaattctctcaagggtactcttttcccgaagaacgcgagcttcagatttggcttgacaagctttctcaaaatcattctggaccatggtaaagtccttttcatgactttctgttagcctccagttataatgtttgctatctcggtatcttaaaaaagctgcatcttttggacgcatttgtgcccgaagttgctctctctatttctctcttatactcatctagctatatgactaaagatccgaacttgatacgctgagggtaaggatctgcaaacggatcatcaatatgctgaaggttctcagcgagagaatctctgttaaatgtcgaacttgtatgag

SEQ ID NO: 655709 - DNA, 790 bp, Homo sapiens
aattcgcggccgcgtcgacagagacagaagggatggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgggccaccaatggtactgaacctacgagtacaccgactacgggggactaatcttcaactcctacatacttcccccattattcctagaaccaggcgactgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgtacacgaccgggggtatactacggtcaatgctctgaaatctgtggagcaaaccacagtttcatgccatcgtcctagaattaattcccctaaaaatctttgaatagggccgtatttacctataggacccctttacccctttagagcaaaaaaaaaaaaaaaaaaattgtggggcgcccgaaagtttaacactcgtggggcgcc

SEQ ID NO: 655710 - DNA, 176 bp, Homo sapiens
  misc_feature (3)..(3): n is a, c, g, or t
tcnatccgaggttagtcatgtccaccacgcccgccacccccaaggtaggtttcgtaagcctcgcccgcccaaaagccctggtcgattccgagcgcatcctgacccagctgcgcatggaaggctatgaagtcgtgcccacctacgaggacgccgacgttgtggtggtcaacacccgc

SEQ ID NO: 655711 - DNA, 103 bp, Homo sapiens
aagtatcttcctctttgacctccccaagcgctagggttacaggcatgaggcaccaggccgggccaatcatgtattttctaagtatttaaattgcttttcattt

SEQ ID NO: 655712 - DNA, 567 bp, Homo sapiens
  misc_feature (466)..(466): n is a, c, g, or t
  misc_feature (478)..(478): n is a, c, g, or t
  misc_feature (523)..(523): n is a, c, g, or t
  misc_feature (525)..(525): n is a, c, g, or t
  misc_feature (556)..(556): n is a, c, g, or t
aattcgcggccgcgtcgacagagacagaagggatggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgggccaccaatggtactgaacctacgagtacaccgactacgggggactaatcttcaactcctacatacttcccccattattcctagaaccaggcgactgcgactccttgacgttgacaatcgagtagtactccnatgagccccatngtatataatacatcacagagtctgatcagagtgtcccacataggntngagcatccggagtcaaccaacattcacgganagacggggccg

SEQ ID NO: 655713 - DNA, 395 bp, Homo sapiens
gacgtacatataaggtggggtgacctgaatatcaattaacacagtatataaaatcctctgcatctgcgcctttgaaaaagcatcacagggctgggagcagtggctcacgcctgtaatcccagcaccttggaaaggccaagacgagtgaattacctgaggtcaggagttggagaccggcctggtcaacacggtgacaccccgtgtctaccaaaaatacaaaaattagctgggcatggtggcaggcgcctgtaatcccagccactggggaggctgagacaggagattcacttgaacccgggaggtgaaggttacagtgagctgagcttgcgccactgcactccagcctggcgacagagggagactccgtctcaaaaaaaaaaggggcaacgctaata

SEQ ID NO: 655714 - DNA, 626 bp, Homo sapiens
  misc_feature (70)..(70): n is a, c, g, or t
  misc_feature (73)..(73): n is a, c, g, or t
actgaacataagaaaattcattctggagagataccttacaagtgtgaagaatgtggcaaagctttaaccnctnccatcccttactcacataaaagaattcatactggggagaaaccctacaaatgtgaagaatgtggcaaagcttttagccgatcctcaaaacttactgaacatagataattcatactggagagaaaccctataaatgtgagagatgtgacaaagcttttaaccaatctgcaaaccttactaaacataaaaaaatacatactggagagaaactacagaactggaatgtgtgataatgattttgacaacacctcaaatttttctaaatataaaggaaatcatactggtgaaaaattctagaaatgtaaagaatgtgtcaaagactttaaatggttttcacacttcattgtatgtaagataattcatactggagaaaactacaagtgtgaagaatttggcaatactgttaattaaggctcaaaccttattgcacaggaaagcgtttatacttaagaaaaattgtacaaatataaagagtgtaaaatagccattaatatctgttgacatcttaatatcagaatgttggtacttaataaaagcattataaatgcaaaaaa

SEQ ID NO: 655715 - DNA, 535 bp, Homo sapiens
  misc_feature (154)..(155): n is a, c, g, or t
aaaaaacttgaattgagagagtacacaataaaaattaaaatgctacggacttttaacttgtctttgtttaaaaaatttgcctgcaaagtatcatgaccatgccaagtgatgaaaacaagtttgatagagaaaacattaattttttgtactatcnnaatattataatacggtctctacactataagtaggctatgttctcaaatccattgtaaattggttgcttagacctggtatgtcacaaggaaccatgtaccagccacaaagcacacttgactttctgcagtcacttacaatgttgtttctagggaacaactcattctgaatttgctgcacctctggccctgagagctaagacttcccagtagcattgctttcgatctagtttccggtctagatccccacttctgtaccgtctccaccaaagcgattaggagactcagaatagcttttgcttttgctaggattctggtgagccctgaaagtccccagtagtggcagggagggaatttaaagcctccgagccggaagaaataat

SEQ ID NO: 655716 - DNA, 1056 bp, Homo sapiens
aattcgcggccgcgtcgacagagacagaagggatggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgggccaccaatggtactgaacctacgagtacaccgactacgggggactaatcttcaactcctacatacttcccccattattcctagaaccaggcgactgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgtacacgaccgggggtatactacggtcaatgctctgaaatctgtggagcaaaccacagtttcatgccatcgtcctagaattaattcccctaaaaatctttgaatagggccgtatttacctataggacccctttaccccctctagagccataaaaggtactaatgtggtggatgctggctcgggaagtactgccgcatgcgtgggagcatttaaccagttgtaaccaccgagggccaggtcatggcctgatctgtacttcttatggaagatgcgtgcccacatggggagccgataaacaggctactgatgtggacggctttgaccaagcccgattttgcggatgacttggcctgggccgtcctggaagcacgcctattcggggggagcactagggacaacaccggcacagttcccctgcgagaataaactaggtaagggtgcacaccgcatgtctggtgatcagcacgat

SEQ ID NO: 655717 - DNA, 451 bp, Homo sapiens
  misc_feature (394)..(394): n is a, c, g, or t
  misc_feature (434)..(434): n is a, c, g, or t
  misc_feature (448)..(448): n is a, c, g, or t
ctccgcatcctccaatccccactctctggtaacctctattctactttctgcctctatgaatttgccaattctaggtacctcatataagtggaatacagtatttatccttttgtgtctggcttctttcacttagcataatattttcaaggttcattcatgttttacatgtatcagaatcttgttttttcaggtggagtaatgttctattgtgtgcatatgccacatttggtttatccattcatcagttgatgcacatttcggttgttcccacctttgggctattatgaataatgttgctgtgaacactggtatacaaatatctgagtgggaattgctgggatcatatggggaattctgcattttaactttttaagggaactgccaaactgttttnccacagaggctgttaacatttttacatccaaaccaggcantgggaccgggggtnaaa

SEQ ID NO: 655718 - DNA, 994 bp, Homo sapiens
ttcgcccagcatagaacagggtatcaacattgtcactgagtacgcgacgtcataatcactttaccctatctcgtttcctatgtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgggccaccaatggtactgaacctacgagtacaccgactacgggggactaatcttcaactcctacatacttcccccattattcctagaaccaggcgactgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgtacacgaccgggggtatactacggtcaatgctctgaaatctgtggagcaaaccacagtttcatgccatcgtcctagaattaattcccctaaaaatctttgaatagggccgtatttacctataggacccctttaccccctctagagccataaaaggtactaatgtggtggatgctggctcgggaagtactgccgcatgcgtgggagcatttaaccagttgtaaccaccgagggccaggtcatggcctgatctgtacttcttatggaagatgcgtgcccacatggggagccgataaacaggctactgatgtggacggctttgaccaagcccgattttgcggatgacttggcctgggccgtcctggaagcacgcctattcggggggagcactagggacaacaccggcacagttcccctgcgagaataaactaggtaagggtgcacaccgcatgtctggtgatcagcacgat

SEQ ID NO: 655719 - DNA, 685 bp, Homo sapiens
gcagggctggctcaggtgcacaggtacccagtggtgtgtccactgtgagggcaggcgctgtgcaggtgggtctgtggcaggcggtgggctcccaccagcgcgggactccttggaggaccccgccatcgccgcttgcggagggctctgttgtcagcgtggacttcgcggggcctcgccgcccgtcgggactggattctgcgaccacaaatgttgcgctgtactgtgtgtgcgcatactgtaatgatcactcttgccgtgcacgcgatcccacgtacttctccttttctcgtggcgacgtcatcgccatcagccctaaaatgctagcttctcggggtcggtgttcttctctgggatgcgtgtctggaacgtgtagttggccatgttccagaaggctgaatccgtcgcccgggcacagctgcatggggatatgccaggggtatccgctcagctcataagtctagctagatgtgtttgcacatctggtcctgggtggtggaggagtgcctcctcagggagacgtggtgcactggccgactccctgggcaggcataactccatgcgcgaaggttctgcattcgttcacgcgtccgggcgacagccacctgcagagactcaggatcggaatggccctacactgacccttgcaaggtgcatctgccgctgtggctctgggggggtacgctcc

SEQ ID NO: 655720 - DNA, 960 bp, Homo sapiens
tggggtatgtcagccaccacattaacaacagtaaatatctcattcacacgagagagaggaccctcgtgctcatactagcccaggtatgcaatactaacatctcagacgctcaggaaatagaaaccgtctgaactatcctgcccgccatcatcctagtcctcatcgccctcccatccctacgcatcctttacataacagacgaggtcaacgatccctcccttaccatcaaatcaattgggccaccaatggtactgaacctacgagtacaccgactacgggggactaatcttcaactcctacatacttcccccattattcctagaaccaggcgactgcgactccttgacgttgacaatcgagtagtactcccgattgaagcccccattcgtataataattacatcacaagacgtcttgcactcatgagctgtccccacattaggcttaaaaacagatgcaattcccggacgtctaaaccaaaccactttcaccgtacacgaccgggggtatactacggtcaatgctctgaaatctgtggagcaaaccacagtttcatgccatcgtcctagaattaattcccctaaaaatctttgaatagggccgtatttacctataggacccctttaccccctctagagccataaaaggtactaatgtggtggatgctggctcgggaagtactgccgcatgcgtgggagcatttaaccagttgtaaccaccgagggccaggtcatggcctgatctgtacttcttatggaagatgcgtgcccacatggggagccgataaacaggctactgatgtggacggctttgaccaagcccgattttgcggatgacttggcctgggccgtcctggaagcacgcctattcggggggagcactagggacaacaccggcacagttcccctgcgagaataaactaggtaagggtgcacaccgcatgtctggtgatcagcacgat

SEQ ID NO: 655721 - DNA, 814 bp, Homo sapiens
gcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctggcaacagagtgagattccgtctcaaaaaaaaaacggaaagggacaaaaacaattagcatttatacctcttcctgttgtctcaaccgccatgaaactttctgaacactccaaattcagtggaataatccaaaacaaactttatacagtattcacactaatttaaccttcttatacgtaatagtatactttaaaaaggcctcagggtcatataatcttctaaacaggctacaacttcaggtggcagttacatttaaccaactatgtcctctagttgacgaccaacttacggcctattttcaacctggcttttgttagccctcaggtgccatacacattgggtgccaaaattaaactatccgtaagaactcacactgcaattggtcaaaaaacccattccgttataaggtttacaactggcccaaaaatctcaaaagaggcccggctatttcatgctaatccttggcaacatcattactttaagttggaattttctccagtaatggacgtggctgggtgtgactttagtacatacgtactccaatattatgaacacctcaaataatggattggattacaaccacaatcctctcctttgcacacgtaatcc

SEQ ID NO: 655722 - DNA, 298 bp, Homo sapiens
ctgggtattctacaggatctctggtatggaggtggcttggaaggtggctattgaggtggccttgtgagttggatttggtgggtgttttgctggtggctttgtagactttggtgcttgtggtggcggccatcctcactggcaatgagaagatcaccatgcagaacctcaacgaccgcctggcttcctacctggagaaggtgcgcgcctctggaggaggccatgctgacctgtaggtgaagatccgtgactggcacttgaaacagagcccaggtagccctgagcgggactacagccccag

SEQ ID NO: 655723 - DNA, 828 bp, Homo sapiens
aattcgcggccgcgtcgacagagacagaagggatggcacatgcagcgcaagtaggtctacaagacgctacttcccctatcatagaagagcttatcacctttcatgatcacgccctcataatcattttccttatctgcttcctagtcctgtatgcccttttcctaacactcacaacaaaactaactaatactaacatctcagacgctcaggaaatagaaaccgtctgaactatcctgcccgccatcatcctagtcctcatcgccctcccatccctacgcatcctttacataacagaagaattcatactggggagaaaccctacaaatgtgaagaatgtggcaaagcttttagccgatcctcaaaacttactgaacatagataattcatactggagagaaaccctataaatgtgagagatgtgacaaagcttttaaccaatctgcaaaccttactaaacataaaaaaatacatactggagagaaactacagaactggaatgtgtgataatgattttgacaacacctcaaatttttctaaatataaaggaaatcatactggtgaaaaattctagaaatgtaaagaatgtgtcaaagactttaaatggttttcacacttcattgtatgtaagataattcatactggagaaaactacaagtgtgaagaatttggcaatactgttaattaaggctcaaaccttattgcacaggaaagcgtttatacttaagaaaaattgtacaaatataaagagtgtaaaatagccattaatatctgttgacatcttaatatcagaatgttggtacttaataaaagcattataaatgcaaaaaa

SEQ ID NO: 655724 - DNA, 221 bp, Homo sapiens
cggtcctcgcgaacgtgtttccaatcatgacttcccgggtgattcttgttcttcgaactgtggatgctcaatgctgccaggttgtccgggcatcagtactggtctggtgccaggcagctgccctgtgaattgtcaagcgttacctcatcacccagtcatcaacgtgattcgggcacgtagatgagaagattgggcatcttgtgcgcttcattgaaacaacg

SEQ ID NO: 655725 - DNA, 309 bp, Homo sapiens
  misc_feature (298)..(298): n is a, c, g, or t
tgcagcgtgccttctgtcgagaatctgttccgacgtcaggccgaggcaaccgtccagaaggatgcagatgctgtggacaaggtaatgaaggaactggatgaaaacggagatggggaagtggacttcaaggagtatgttgtgcctggtggctgctctcacagtggcttgtaacaacttcttctgggagaccagttgagcacagtcctgtgagcagtgccttcctctcccacttgtcaagatttccctttagcgtgcttgctcctcaccccacctgtacctccctatgtcccaatctttncccagtctcga

SEQ ID NO: 655726 - DNA, 140 bp, Homo sapiens
cgaacaggacacgcgcgagatagaaccttccagaagtggtcagctgtggtggcgccttctggagaagagccaagatacacatgccttgtacagcatgagggtctgccaacgcccctcaccctgagatggaagccatattg

SEQ ID NO: 655727 - DNA, 1195 bp, Homo sapiens
  misc_feature (919)..(919): n is a, c, g, or t
agcggagtgctcatgttcgctgtgatgtgtctgacggccaggggctcgcgtctctgatgccgtagtgaggacatgatggcggtggatgtcccgtcgtttactccatggacgtccacattgctgaaggagccagagaaaccgatcgatccgccagatagacatgcccactgtctgctagcgggatctttacccactatactggccgtcaacatactgcaatggaggacgttctcccgagcgacatttgtacctgctccatcctgacattgcaagaatctagctcattgcgactggcatcgctccgttccgtactagatacttggccctggcatttagttaaagaggattgtctacctccagtaatgcttacgaataagatagtggccacattcacctttcactctcatgcataatccgatagtacgatcaggactagttatacacaataccatgtgccgtagtacgggtatcgattcactgggagactttgtgctagacaaacgcttgtgatttttgggccacgattccaggggaggggcaactcgaggtgaattatcccaggtgaaccccatatgtatgttcggccggtaaatgcttccccgagatatttggcgaagaattgacgtttgggtaccaatttatggccatcatttttaactatcctctttctccaaaatattcggtgggactaccccattcacgatacccctgtcccaatgtggccagccactggaaagaacccgagttattttttacaacttttccttgacttccataaccatgacatatctgtgtttggaaaatctttattttttgtcttacgccggattccacaggttttatagttgtgttcaaccttggatctattcgtcctgttcccacttcccttattccttttctctatccccctcacttggantttagtgttggaccgcgagtttaatagtccgcgtttttcaaagcttttttgccttgaacaggcgagaaaattttagatcatattgcccaattcagagttccttaattgcccagagccacgttttagagcactgtgtggtggaattggttgccgtaagtgtgggacaattgcaattttggacgaaacaatcgaggtgtctgagatggtggtttcaccaagagggtccacttttctggtgcgaacattatcgcacatgggaaaatgattgactacatg

SEQ ID NO: 655728 - DNA, 207 bp, Homo sapiens
cttggcgtgggcgtattcgtctctacgtggtgcacacctgctggtcatgtacggcatcgtctacacccgcccgtgctccgggacgcccactgcatccagccctacctggcgcggcggcccaagctgcagctgagcgtgtacaccacgaacgagttcccaccatggttgctgagaaacaacattcgacctggtaagaggatggctgtc

SEQ ID NO: 655729 - DNA, 571 bp, Homo sapiens
cgcgtgattagccagtatatgcgtaccccgacttgaccagaagtcaaagagaaaacgcaggttcggttaaaatcttgggagacagctttttggaaaagttcttttcctacccaagcagaactggatcggctaagggtggagaacaagctgagcaggagagagaacgattcctggttctcgggagaggcggaagcttcgggacagcattggaacaaggtgtcttggattccctgggggtctggcaaaaaagggcaagatttggtgagccccaatggtggtctttctcgactcgagcatctctccggtcgccagttaacaaggtctctgaccaagccttcgccaacaatttgaaaagttcaagaacaggttcatctcctgaggagcacgtttggaaggacccagtgggctactccccaggagtacgaccagttagcggccaagactggcctggtccgaactgagattgtgcgttggttcgaggagaacagatggttgctgaaaacgggaaccgtgaagtggatggggcagtacagcaccagccattggaggttcatcgacttaagtcgataaa

SEQ ID NO: 655730 - DNA, 171 bp, Homo sapiens
gtcagccaaaatatgttgtcatagagacagaacatctatttcccagcggacttcagtaacaaaggctacgttgcaggggctgcgatctaccatcagagacatgtcagcgtcccttgttatgtcattacagaaggaaccttaagggaatgaccgattgtaagcgctgcaatt

SEQ ID NO: 655731 - DNA, 1060 bp, Homo sapiens
tcaagggttcagtttccttaaaggacccccatctccctgaaggggcagtgggcagggcagctaggtggatgggcaaagagatggttcatctggaaagattctggcccggattggaagggcttggcccacatggctgggaagggccccctcccaggaaaatgtactctcgaaccaggcgttcgtgggctcttcctctgcgcgtgccgaggattccagtttctccggccaagtgtgtgtttgtgactctcgtatagctccacctgtgccaattctgggacttcaggggaaaaggcaagcttcctgggccctcggagaaacccaagaacctccaagaaaagagggggagcgtgcttagtgggtggggtcccaaaaagagagggagtgcaccaggggcggaagaggcgatatcttcccctcaaggcgtggcgtccgagctcgcggggacaacactatcccaagtgtgacagggaacaagtgtggcgagccctcaagtgaagaggctccgtgaaaggggggagattccctctcgaggggaagcaggcgaaaattaccctcgtgggagtatacccagcgagggcacaccaaggcgcggcccctataactcaaaggaggggggcttccccagaacaatctcgtgggccagggggcccaccaagtacagacggtggtgtgttccctcaagtgggagcggcataccgtgtggcgcgcatataaaaatttttcaatccccaaaacacaaaaggggtcacctctttgggggcccaggtttgaaccagaaacgggggggcccctattgggcgccattggggggccctacaagcaacgcccaagcgcccgtgcgctcaacattttccataccaaaattcatcccctcccttcaagaaaagccaggggcgtgccaacgccccgccttttatattctcctcaatcaatcaccggcctacaagcactgggggggcatactgtgagtctcttatataccccggtagaaaccccatatcattctttaccgggaaggtaggtgcccattactaaacgggtgggggatcattatgagaca

SEQ ID NO: 655732 - DNA, 355 bp, Homo sapiens
ggtccacatgtgcattacacagctagaaacccagaatttagtcctcaaggcataatataagagaaccatacgtgcttaagaggttcttaagtctaatgaaccattagaccagcatttcccagccacagctttgtgacactcaatacgtgtccaatttcttctaagggcttcacagaattctccaaaaagttaatccaaattcagattcatttaaaaatatatcttgtgttgcccaatccctttgtgaaagggaatgtgttacaaccgtggaggggaaaaaaatgtgtataggcacaggcgcgtatggctagggggtctgtgtattagacatagtggatcatatgtgctcgcgtgc

SEQ ID NO: 655733 - DNA, 256 bp, Homo sapiens
gtttgggcttcccagggtcctttgaaaccgttttttgttttgtttgggaattattgtggaaacctttcaagtgacccaaagggtggggtccccctgtggatgagggatgacccaggggatggctttgatcccatggggcctggggggggggccccaaaagcttgtctgtagcgggttttgggggggggacccccttcccctttttgcccccctttcctgggggaggggtcccgggtttgggttttgtttttcccaa

SEQ ID NO: 655734 - DNA, 850 bp, Homo sapiens
gatacgggagttcctccttgctctcgcccctactctttctggtgttagatcgagctaccctctaaaagcagtttagagtggtaaaaaaaaaaaaaaaacacaccaaaggctcgagccacaaaagggatgaaatttcttctgggacatcctccggcttctcccgttactggatcgtctggctccctagagtccttcgtgaagctttttatccctaagagggagaaaatcagtcaccgggcgaaatcggtgctggattacagggagctgggcatgggaattggggagactggactggcctatgaatttggctaaaccttaaaagcaagctgggtcctcctgggatataaataagcattgggactggtgggaaacagctgccaaattgcaagggactgggtgccagggttcataccttgtgtggggtagacgtgcagcaacccgagaagatttttacagtctgcaaagaagggtgaagggcgaaatgtgggatgtcagatttaggaaataaatgggggggaggctatacatcaagatcgttggtaccaagatcccagattggaagcctttgagtattggtcttgacatttgtgggattaaagggggttttttcctggaggggaagaaaaaccctgggcattttggcagtggtggtccggaaaggggattttttcgggccttttagtgggtatgtgcagcaatttgcggttgcgggtcacaccttggcagagagagggggcccaaaaatggcggacccacgttggcgtttgaaagggtcgcaacaccagtgggccgcggagagaagaacggtgtgggaaggagattcttaaaagagaggcggggaaaagaattg

SEQ ID NO: 655735 - DNA, 161 bp, Homo sapiens
ctgagatcttgatcttcttcaccgtcttgttgcgtgttgttcggtgacgtgtacgttgacgctgatcggttctccactggtaatagatctccttatccatagaggcttctacggtgcaaagggcttaatccgactgacagtggctaccgatgctcgaactt

SEQ ID NO: 655736 - DNA, 808 bp, Homo sapiens
  misc_feature (760)..(760): n is a, c, g, or t
tccttccaccctcatgctggtgggggcatgccaggagaagctggacaatgacagcagagacggactctttggtgtctgcccagcgagatgcggccacgccggagggatggcccagagcatgcaagcccggctaaagggaactgcgagggggaacggtggggagaaccatgggggtgagtgatagctcatccaaaccttatgagcagtgagctggagaccagccagcttcgtttgactcagatgaggatgactccaccagcaggttcagcagctccacagaacagagcagtgcctcacgccgtgatgagaagacacaagcggcggcggcggaaaggcagaaggttcctcggcattgagcggtcctcgtccttcagcagcatcacggactccagcatgtcactcaacatcatcacggtcactctcaagcatggaacaaatataacttctgtgggcatctccattgtgggccaaagcaaacgagcgtggtgacggcggcatctacatggggctctatcatgaaggggtgggcgccgtggctgctgatggacgcatcgagcccaggagatatgtgtcacaggtacaccgagatcaacttttgagacccttgagttaatgacgcatgccagtccgggtactgcggccagattggtgcacaaagccgggccatcgccctgacgtgtagccaggtgctggggcccaggtccaagtgggttgctccacattgccatggggcgaggccctccggcccttgcccctgggnctgggttccacatgggctgaccggccttcctggtaggggggcctctgg

SEQ ID NO: 655737 - DNA, 735 bp, Homo sapiens
ccaggacgagctctcgtggaaccggagggagctagtctcacgactgcctataatgcgggtggctcaggtgtctgtatgtgtctctcatcgtcttgcctcctctcttcgacacgcgtagtctgtggtgcagggcactggagaatgtccctggatgtacattgcaccgacctcctcctatgtgtactttctcagcagcctcatggccattctgcttttcatgtccttcgtgtcatcatgtaatgatggtcatgcagttcctcgtgtgggcctttgagatggtgctaaggcagtgatgtggcccactaacaaggttcctcgcgctgcgcctgtgcatctggtggttctctgctgccctatgctgaccattgtgcttttcctcgtcctccttgatcttccttcctctgccttcactccgtgagcgtcgggcgagcttggcatagttacgttcgcgaatgcgtcctggtacgtccaagggatatctaagtggtttgcaactaggatccttagccctctctcctttaactatgcgccataattagttccccattccactagatcatgcctccatataaataccgtatacccatcctactcattttgccttccgagaaggttgtacgcgcatctaatctaaatgagtcaacttcctggatacactgacgagtatgctcaaattaataagacctcggacgataggctatcacgcacaaataaccaaaaacagccacccgtcgt

SEQ ID NO: 655738 - DNA, 1285 bp, Homo sapiens
aggtgctcggcagatgaactgccacgccaagtggggaaagctacgatatgggcatgtgtgctgttcgacgtgcaccgatgtgcgctgggagtagtggccgcgtgatggttggaggtcctgtgatgggcgtcatccttagcgtgggcctaggctctctgctaatgtctcctacggtagtcagtcgtctcaagacgtccagtgggggcagggagtctgtacagcaccgagggagacgagagagacagtcattgcgtcgcagcggtctgcttaacatgtgtactaccccagaaggtagaatatgcacacggctgtcggctcgccagcgacgaggcctctgtgaacgcggcatctcccctcgaagttgggcgtgaattgtcgtcacaagtgactataacatacgaataggcctggtatctagcgaatgcgtcgagatgctcgatcgaccaagctcgcacgtctatccgggggtcttcgcccatctacaaacaggctcgcgaagtcgacatcaaccgggagggcgcagggcaatgcgcgaccagtgtcgatttaagcatggaatccgtttcacaaggcgaagaggaacgggagtgaggcgcgcacgagaaggaattgcgacgagtctggttgcccgaggtaaggccagcgcgattatagaatgtgaccggagagggcacagagagattcctggaggaagagcaccaaacgtaggtaacacgggaaactactgggtcccatgggtcctccgagtgagggtcggttaccgagttaagttaactactctacttagggtctctgtaaagtaactacgagcgttgagccgcgaggagcacaagtctgtctgtaaggcgacgtggtacgtgggccctttcgtcaagtgttcggggcccgcggagacggcaattttagcgtgccaggtgtaaccccttgaggttaatccccgttcgtggtacacaatgggggctgggccaattctccctttgaatgagacatgagaggctccgtgttacattgtcacgttcacccgtgccgttagggcgccaaatcctcgagaggcacaagacccgcattctagtaacccaaacgcgggttcggaaggcaaacctgtggagcgcatgcacatgcgagggctttcatttcctctgtagcgaaaagttctactcccggtgtggcaagaggcgagaaaaactcctttataaatttttccatgagtgtgcctgctatgtacccatttagagatattgggcaacatcaaacttttaatcccctaattaaaggcaatttacta

SEQ ID NO: 655739 - DNA, 791 bp, Homo sapiens
aaattcgaagggtatggttaccaaagaaatttgggacacttttgaaagcagacattttaaaatataattattgtttaaaactacatttataaacttttatttcagttacatctatttaattcactcattcttaacaattatgcttggaacactcatgaaaattacatgagacatgagacaaagctgccatcacctcaagttattttcctattatccatcttgacagcacatgcatgtcaggcagtcatgacaatgcaagagccctaaagttaagtacatgagtattgttgacaactcagaagacacaaatgttctcattaaactgacaatattaaacgagtcttattacagatttactcaagtcatgtaaacctgaaaagcatttagactagttcctatatttctaggaattttaggtatactcatttatctctaagccaatttgaataaagcctttaatatttgtagaaaagacctttacaatttttcatttgctcaatattcaaatagtcaaaaatcatgccaacaagggaagaaagtggacagaggggcagagcatataaagttagcaggggcttttagaaaaggaatttcagttgactaagacgttcccatgggagaagcaagatttaatagaacagaggggcttaaaaaatgtatggataagctgaatattaggttccagtgaattctggcatagtgttccttaaaaaattcctctcgggctgggcagaggattagcgggtaatccaagatttggggggtgaagtgggaggatcacgaggtaagag

SEQ ID NO: 655740 - DNA, 218 bp, Homo sapiens
cccgacaaaaaaaaaaaaccccccccgcgggggggggggggggcccccccccccctttttttttttgggaaaaaaaaaccccccccgggggccccccctttttttttagggggggggggggggggggttttttttccccctaaaaattttgtgcccccccccttttttttttttttgtgggcccgcggctttttttttttggggggggccccccccca

SEQ ID NO: 655741 - DNA, 180 bp, Homo sapiens
ttctttctttctttctccttccttcctttctttctctctttctttctttttcttttgagacagagtctggctctgtcgggccagcgtggagtgcagtggtgcgatctcggctcactgcaacctccggctcccaggttcaagtcattctcctgcctcagacccaatgagcggctgggatta

SEQ ID NO: 655742 - DNA, 993 bp, Homo sapiens
tgtcttggggacgtgcaattgtgtggtccggagtggcacgctgccctctctgtatgggggcattctacatggactagccgatatataggggccccccatgtgcgcttgtcagcggcggtatgcagtagcctccgggacacggtggacgtttgttgtaagaataccaattggcgtccgcctcagttttaatagtgagcgtttgctttcgctatttagtggttgagcctgttgcgccccgcgagttagtcatgtcgtacctcctcctaagccgacacctgtggcgtgtggtttataccccacgcccgcgtgttgcccctgaattctctcgtcagctgtcccctggcttgtcccccacctaaaggggtgaataaaatgacgcgtttgtttggccgttacgccctatgtgaaaggatacccgacttgttgggtaatatgactgatgattagttgtggcgtagatgttggtcaaccgccgaggtccgtatgccacggcacgctatgtgtcctgcacgccgctcgccgttcgcccgtatacccttctttgggtcgcgcccgacttggtgaaaagaggggacccaagtgcgcgtaaccccccccgtgtggtgtgctccgcccccccctcgtcgtttcttcccttgagtggagctcctttgccctcgcctaaataccgggctttttggctcccaagtgcgcaataatgaatagtttccccgattacctaattcctttggtatttccccccgcgttttgcaccgccccgacgacccactcacttgaatcgtcatcttcctactccaacgcgtattttatttcccccccccttatccaaacatggtaatccccagcttatgcaaccacattgtaataagaaattacgctcccgttttcaaaacacctacccccgcccccgctcctcctcgcacccacacatgctttgccccctccccgattccttcctttttccccctttaaaaaaaaaaagcccacaaaaca

SEQ ID NO: 655743 - DNA, 665 bp, Homo sapiens
cgtttcccatagggtcggacctccgtttgttcgggggaacatgaagctaagcctgggtgggctcatttcctgatcacactcacaagaggctgtcataggaaccacgatgggagcgtcactttgcagggcactgagaccctcgcgatcgtcatcaccgggcaaagtggagcaacacgagacccaatgacgcgtggttgaggtcccgaggatccatctcaggagcctcaggatagactaggctgcatggggccctagaccctgaggagggcgtcctatgatggcgtagcactgaccctgcgtgaatttaggtcagccagcgctctagggactcaccagtcaatcagcgttcctaatattcagcctgcagggctaaggtgccatggcgcactcacccacagaagccatgccccactaggggctcggaggcagaatacgaggaatgaaccgcgaaagcaaccctaatagccgaattgctgaggaccacgaattcggattctccgggagtgcgtattcagccatgagcaccgaaccccagagcagtatccagctaggaacgccggaaggttcctagaccggactgccggaagtccctacggccttgcgctcgctcagattcctctcatcatcctcacggcagaaggacgagaaagcttgcttctggaccc

SEQ ID NO: 655744 - DNA, 279 bp, Homo sapiens
gctcgacggcactgcaccgcgacgaaagccaggaagacctggccgcccacaccagcgcctgcgccgcgcgttcttcaatttgccgggcctcgactgaagcggcattgacccatatcaacaattgcctccctgagtagcggcacaataatggcaccttgccaaaactgtttccgccctatcagggaagacccaccatgcgtgcctggcttagcaatatctcgctgaaatacaagttctgggccgtgaacgcggtcgcttgtgtcaccaccctgttgtcga

SEQ ID NO: 655745 - DNA, 100 bp, Homo sapiens
gctcactatgtttgtgcccgcttgcatcttttctcagtagatgttggattccacttcatggccaaggcctatagcatagccttgttgctgtggctctggt

SEQ ID NO: 655746 - DNA, 865 bp, Homo sapiens
ggcccgagaagctggggagcatggaccagaccccgcagcgctggcaccatgacgctcgcccgcttcgtgctagccctgatgttaggggcgctccccgaagtggtcggctttgattctgtcctcaatgattccctccaccacagccaccgccattcgccccctgcgggtccgcactacccctattaccttcccacccagcagcggcccccgacgacgcgtccgccgccgcctctcccgcgcttcccgcgccccccgcgggcgctccctgcccagcgcccgcacgccctccaggccgggcacacgccccggccgcacccctggggctgccccgccggcgagccatgggtcagcgtgacggacttcggcgccccgtgtctgcggtgggcggaggtgccacccttcctggagcggtcgcccccagcgagctgggctcagctgcgaggacagcgccacaactttgtcggagccccgacggcgcgggcagaccctggtgtctctacggagacgccctggcacggtggactgcggctactgcgactgcagacacggatcagtacgacttcgtggcggccaaaaatgacgcttcgaacggccccagcgcaagccatatgcaagctggcaccccacgggcgcccctgcactggcaccagcccactgcgaactacacccggacgacacaaccaatcagcccccacccacccgcctcggaccgcaacccgaccaccccccaaacccggatctcgccccgccctcatccccttaccggccccctccctcccagccaccacacccaacacgccccgcacaccaactccaccgcgagcccaccccaacccgccccgccaccaccccacacagcaccccc

SEQ ID NO: 655747 - DNA, 494 bp, Homo sapiens
ggcttgtcccatgtgttattgttctcttttctttgtttcctgctgccttttcaattgagtagtttttatctccctgcttgtcttattggttatgaccagtccttgcccctcagaagatatgatatggattataaggatctagtatggattctttatagatccaattggaacatggataatggtcaggtaacttcaattatagctatgtgcttggcaagtattgactctttattcattcccatcttaaaggtataggatatattcttgcagttaaaatatttaaagtattaatgttttgtcatgggttcaaattaaaggtccgagattatttttattatattttattttgatgtagattgttatagttaggtaatatttcaaaatcgaagaggtttatccttcacatgaaatgaaactgttttgatgtaattgattaatatatttaaattacgtgtatgttctagaaaggtaacatattaatttcttaggctatg

SEQ ID NO: 655748 - DNA, 175 bp, Homo sapiens
atttgcgaccaaaatcatctgggtttatatttgaaaaaaccttgttttccaatttaaaaatgccaagaaagttgtgaataccgttcattatcactaggatcaagaaaaagcaaatggtttaagtttttacataggaaatctaagaactactcatcaataaaacgcaacactatca

SEQ ID NO: 655749 - DNA, 358 bp, Homo sapiens
gttatgtgttcatatgtcctcagccaggagctatcactattaggaaagctctgccataaactactagcgggtgccaatggtcacctgccacactcgaaccaggatgtacgagcagccagcagacagagactgaccatcagcagaccagtccagggaggtgcactgatgtggaactgccttgactgctggactgttgatgcaggagcctgtgacagcacacagccagtagcgatgagggctgaaccacagggcgttgatgatgtccccaccatataccgtgtgatgttaggctatgtagagagcccataacatgatctgaccatacttgcctacaggcacagagggatccatccggagg

SEQ ID NO: 655750 - DNA, 374 bp, Homo sapiens
tggttcaggctgattatagaagttgcacacttgtatgccttggagtccctgcctccccttttgacgtgtagggactcattgtaatgcttttaaatgtgaagcctccaccccaaagtgaacatgggacgcatgtaacgtgcatgttcagtgggcacggctcaggactctctttgtgaatattcatagctcctcctggaacctgaatatgtatgtttggccagctcaattcagcatgaggctcatgctgcaacaccgcctccttccaggtgcctgccagctgtttctgccagaggctgcgtctcccggcctgtcagaatggccaccctgcaggctgtaatcctttagaagaaataaagatcccctttccagatgta

SEQ ID NO: 655751 - DNA, 494 bp, Homo sapiens
  misc_feature (483)..(483): n is a, c, g, or t
ttggctcatgcctgtaaccccagcattttgggaggccaaggtgggaggattgcttgagcccaggtgttcaagatactgagaccttgtctgtacaaaaaatcaaacaattagctgagtgtggtggcatgcacctgtggtcccagctacttgggaggcagaggcgggaggatggcctgagtctgagaggtcgaagctgcagtgagctgtgattgagccactgcaatccagcctaagcgacagagtgagaccctgtctcatttaaaaacaaacaaacaaatgaacaacaacaacaaaatacccaagagttttaattagcttttctctcaggagtgttatgaggcttagatgatgtgatgaatatgaaagtgctttaaaaagtagaaagtgcaaggtgactgtaaaaggctgatggtattgtctcatgccaagcagcttgaaggctgtgctgccttctgccatcgtaatgcccttggcaggatgtangccagtcattc

SEQ ID NO: 655752 - DNA, 394 bp, Homo sapiens
ggaaggcccaaaccaactttttattgagcttatgcagttaacaaacttgtaaacagggccagtcgacaaagttttgttgaatattacagcttgggcccactaaacacacctttttttgagattaaaaacaaaaaaaccaaagtaaacaaattctgggagagaatgaagagacattttttgagttttccaaaaaggcaaaataaaaaacgccacatggtttggtcccaggcgttcaccatgcctaaaggggtgttgttataaccactgtttcccctccttgccagtggttaggtaaaggtaggggaaaagggtcattttggacatgctgcaaatacagcatttgctggtgttgacaccctcctggggctgtggtggcaaactgctgtgtcaggag

SEQ ID NO: 655753 - DNA, 105 bp, Homo sapiens
gcaagattgtattctataggggcctagcggtgtagcagccgaacgaccgagcgccagggaggtcttgagcgaggaagcggcgcataacttcgtattgcatacatt

SEQ ID NO: 655754 - DNA, 153 bp, Homo sapiens
ggcgagtaggacatacttctaggtgggcactgtgcggaaacttgaggatgaaatcagtgagctgcatgcacttaaaaaggcatggcctgtctacctcactatgagatgcaaggtcccactcgcccaaaagccctgattctgcatcaatactcc

SEQ ID NO: 655755 - DNA, 141 bp, Homo sapiens
cggagcccggggcattgagttgactggaagtacatccagagtagcatagactccaacatcagtctggtccattacatcgtcgcgtctgctcaggtcctggatgataacacgctatgatctgtaccacacccatcggcgttg

SEQ ID NO: 655756 - DNA, 506 bp, Homo sapiens
  misc_feature (5)..(5): n is a, c, g, or t
  misc_feature (453)..(453): n is a, c, g, or t
cctgngactgactgcagctcaggatgtttgccatcacaacggcagagccgcagttcacacccaggcacgttctccccaagacctgtggctgcaaccactgctatgcatggaatgtgagacggacggtgctcgcctagccaacagttgatgctgaatacatcttcatctgtgtattgaccatctacccttttcccatgatttgtttgtcaaaattccttgctaatttccttattaaaaatggtcagtattttaattctcctgattcatgataatttctttgacaaggaaattaatactttgttaaatgagtacaaatatttttaaacaatctgttttacttttaatctttgtttatggtgatattttgggcatacaaaggtctttaatatccatgttattaaattcacaaatatttccctttgtggattttgggtttcagtttataattctaancatattctccactccatgattacaaaataaaaataaaacaacactggtatttt

SEQ ID NO: 655757 - DNA, 591 bp, Homo sapiens
cctcagcctccgctgggactacaggcgtatgccaccaagcccggctaatttttttgtatttctagtagagacggggtttcactgtgttagccaggatggtcttgatctcctgaccttgtgctccacccacctcggcctcccaaagtgctgggattacaggcatgagccaccgtgcctggccttaaattctttaaacttagatataatatctgttcatcaagtcaaacaaacaaaactctaaataccagtgcacatagccattctaagttaacacatctatgatcttatcagatcggcgttaactgtgaagggccagaaaccaaacacggttttaacaggggggcacaggagcatcaggacaaacgcctatgaaccacacagtcacactcccccaattggaccaaaactgagcaacactgagcgggacactgtacagacacatacccatggacaccgtaacaacaaaacgaaaccagatcccagaaatggaaatcgccaaatcgtgacaccacaggtcggggggtacaaacaacgggcccgaaatacaactgcacgcggatgaacacggtaatagcccaacaccacatatgg

SEQ ID NO: 655758 - DNA, 958 bp, Homo sapiens
  misc_feature (5)..(5): n is a, c, g, or t
  misc_feature (453)..(453): n is a, c, g, or t
cctgngactgactgcagctcaggatgtttgccatcacaacggcagagccgcagttcacacccaggcacgttctccccaagacctgtggctgcaaccactgctatgcatggaatgtgagacggacggtgctcgcctagccaacagttgatgctgaatacatcttcatctgtgtattgaccatctacccttttcccatgatttgtttgtcaaaattccttgctaatttccttattaaaaatggtcagtattttaattctcctgattcatgataatttctttgacaaggaaattaatactttgttaaatgagtacaaatatttttaaacaatctgttttacttttaatctttgtttatggtgatattttgggcatacaaaggtctttaatatccatgttattaaattcacaaatatttccctttgtggattttgggtttcagtttataattctaancatattctccactccatgattacaaaataaaaataaaacaacactggtattttaaaacaaaaacacccatatttaacaccctccccccacccaacacccatttatcaattccgctcctttttttcccctcccgctcctcctccccacctaacaccgaaataatggggtctctttgggtcttcggggcgggatcctcggacgcttttcctttatgggaggataatccacacccttcccatttctccggtcccttgggcctgtcgtgggggagacggtcccctttttcacggggtaccgctttacccaaaaacgggaatcctgaacaaatttcgttcaacgcccaagccccaaccctaaagtcccttgtggcgtttcctatccccccctggaattaacaatccttattgagggcgaacccagactaaaaccggcgttccctagcttttcccttccttcccccccataaaactcccttttcctgaaagggcttcatacagcaatttag

SEQ ID NO: 655759 - DNA, 640 bp, Homo sapiens
cgtactgattacctaaatgatgaaaaaatctgtacaccaaaacactgaaacacccaatttacctatttaacaaacctatacttggacccataaagctaaaataaaagtgaaaaaaatggcaagcaacaggcatatgaaaaggtgctcaacatgattgatcaccagagaaatacaaatcaaaactacagtaagatatcatctcgccctggttaaaatatatccaaaagacaggcaataacaaacactggcaaggatgtgtagaaaagagaatccttgtacactgttggtgggaatgtaagctagtgcatccactatggagaacactttggaggtttctcagaaacctaaaaatagagcaccatatactacagcaatcctactgctgggtatatacccaaagaatggaaatcagtatattgaagagtatctgcatccctgcatccgtatgttttacacagcactattacaatggccaagattgggaagcaacctaagagttcatcagcaaatgaacgaataaagaaagctggtcatatacacagtggaatattatcagctattaaagagatgagatccagtcatttgcctaaagtcaatggactggagatcatctgtcagtgaaatagccaagccaaaaagg

SEQ ID NO: 655760 - DNA, 446 bp, Homo sapiens
aggaacagagagggagcagagggttcggacttcaggaacttaactattctggaataaggaatgaatcagctgacctgggccagcaggttttgaacgtagaatagtatacttgcctttctcacccagattaatcagtctctgtacttgtttcccttttggacactagtgtctaggttaactaattctgttttatggttgtgctaaattcatagcaggtgccttaattcttggcttttagtcaaaccattccatatcagaattttccttggtttactatagatatttggctttaagtagtagtaggtgttttttaatgtacaaggttcataatatttgagtggtaaattggtataggtaggaatcattttacatttgtagaattggattccctttggatttcatgtgtaattcaacaattaagtggcggttatattcaggttggatta

SEQ ID NO: 655761 - DNA, 262 bp, Homo sapiens
cacctaaccaggcagcatcaggagtatatgccattccataagtcaagactcagttatccagtgagactagtaaattaaaaaaataaaatattccagccaggcacagtggctcatgcctgtaatcccagcattttgggaggccaaggtgggcggatcacctgagttcaggagttcgataccagcctgcccaacatagtgaagccccatctctactaaaaatacaaaattagctgggcgtggtggcacatgaccgtaattccag

SEQ ID NO: 655762 - DNA, 647 bp, Homo sapiens
  misc_feature (598)..(598): n is a, c, g, or t
  misc_feature (614)..(614): n is a, c, g, or t
  misc_feature (625)..(625): n is a, c, g, or t
  misc_feature (643)..(643): n is a, c, g, or t
ctcctgccaagggactggggcctcaggtctcaggcaaggagagtggccccgaggactgtccggagaggggtggccagccctgctgcccagagggactgagccactggcagggaaggaggcggtgttccccctggcctgactttcctccaaaggacgtccccctgaggcttaggggctgagcatgcccttgtgctccctggaggacgcggccagagcccccacaccatgaacagcacccccaggaatgcccaggccccgagccaccgtgagtgcttcctgccctctgtggctcgcaccccctcggtcaccaaggtcacgccagccaagaagatcaccttcctcaagcgaggggatccacggtttgctggggtccgcctggccgttcaccagcgcgcctttaagaccttcagcgccctcatggacgagctctcccagcgcgtgcctctctcctttggggtgcgctctgtcaccacaccccggggcctgcatagcctcagcgccctggagcagtggaagatggaggctgtactctgcctgataagaagcccccaagacccccagtggaccaggccggcacaggagagaaacccactgtcanagttggggatgtgaangcaacgtgaanccaagaactcttcttccngaaa

SEQ ID NO: 655763 - DNA, 323 bp, Homo sapiens
gtgaaacttcacaaaatgctcaaataaattataacattcagcttccttcagtaaacactgttcattttaacagatgacccgattcttctccgcttttcctcctttataagtgtcatgccaacagagagtaacattcctcagtctgaaggtatcacataaggaggatcagatacaggagattttagaaggcttacagagattagcttagagaatgacctatccactccagcatcccaatgtgtactgataaatacatcagtgacactgactcccacgcctgtgagttcaactgcggatatcacagttattcagccagtttctga

SEQ ID NO: 655764 - DNA, 925 bp, Homo sapiens
gtatgggcttcctccaaatccatgagtgggcccgcgtgagaatgtaaggtgccacaaggaatctgcctgatgatatatcgtacacatgatatatgccccgtggccaagagagagtctgatgccatggatgtacaccctgatgtattccttgatggactgtcaggtctacaacctgctggagatgtaaatttgtcattgagcttcctggaggacagcagcatggagaaagatcctagaagaggcctctgacttccctcactcccaaccatcattacaggaaacgactgtgaactcctgagtacagcttggtttctgactacatcccagaaagctctggcgatcgtgtggattaaaatcccgtggatctcctctcagcggtgtagtggagtcacatcttgcgagtatgctggcagggagccacacctattaatacagatatctcagaagccctcaccccttggccgggagcctgggaaccttggttttgacacaccagggttgtgcaggatggggagggggttctggccttgggccttccttatgatgcagacatggtgaattctacattccaagggagggagggcgaatgtttacggcagggtggttatatgtgggcaggattattttcatccatggctccacatgttggtgaggtcctctcttgtggctagggtctgcggcgaccagaattatacacgtgagctcatctgctggttaggatgtccgccagtggtccttctggatctttttgggcctttttaaacattttcgaaccggtgtcgcagtccactttatttcttcaccgctccagatgggttgtgcccacagggtgtgtgggcctggccctggtggcctggttccctctgttggcgtgggaggagcctggcgccttaaggccacatgtgtttgtggtccaaaggagtgg

SEQ ID NO: 655765 - DNA, 172 bp, Homo sapiens
gcttgggctgctcaggctctgtgctgtgtcatggcccgtcatttctccaggctgccgcttgtacatgtggctatttttctgttgtgtctcgtttctatcctttctttttccactggctttgcgtaccgttttttttttttttttttttttttttttttttctttttctattt

SEQ ID NO: 655766 - DNA, 775 bp, Homo sapiens
aagatggcggacattcagactgagctgtgccgtaccgagataaggcatgcctgaccgatctttcaaacacgaatgaagacgggtcctgctgggtagacactgtgggacggagaagctcccgcgggtacttacaagaacatcggtctggtgcttcagagacacgcctaagggaggctattgatgggcaccctacgagttgtacgagaggacaatgccccgtatcactggttgagtgtgtccattcagaggagcggatcctcatcatggacgtggtgacctgagatgcaagtatgcgagtaggacctagttgtcaatccggacctgtagcactcatcttgcaacgttacaatcgcagtcgagaagatacaaacacgtcgtatcagagcaaagacgggccagctgaagaaacaagtagttcttcgatacgacccgtgtcccccgcatgtgttccagggtgaacgagttctcgaggactctggggtgtactaattctgtctgccatgtggcggagacgaatgttgcccaagtgcttcttgaggccaaagaacattgtggccggcctttcgatacggttagcgtcctagagggtcaagcccagcagggggatgctctgggccaacccgagaggaaacggcaagtatcccgaagagaaggtaacttggatcggcttggggaacccattcagtggccaccgacgtctcccggcaacaaattcgcaacattgacacaggtaaattgttgcgtaccaattctttgaaacaacaacatgctagta

SEQ ID NO: 655767 - DNA, 203 bp, Homo sapiens
atgaagccctccccgggtactcactaatctattcttcatctttacagtttgtgtcactttgagaatgtcatataaatggaactatataatatgtgacctcttgagataagcttttccactaagcacattacccttgtagtctattcaaggtgttgcaggttatctatagcttgcttgttcctttggattactcagtagtattc

SEQ ID NO: 655768 - DNA, 1125 bp, Homo sapiens
tgagacgtggtctctgtcgccagggctgggattggcatgggtgtgagaaatcttgggctcactggcaccctctggcctcctgtgttgtccaggcagattctcctggcctcagcctccggagtacgctgggagattgcgcaggcatccgccatcacacccggctaaaattccagaatttttccaggtaagaagacaggggttttggcgcgccagggctgggtctcaaatctccctggaccttaaggtggatccacctggcctcagcctcccaaatgtcgctgggagattcacagcgctgtagaagccgcctggcccgggccatcagataaatttgtctaacaaatgtgctccactttcacaatacaatgtggctttgaccatgcgtggccatataagagaacacaaaaacaattcttgggcgtggtggcgccatacgaaggaacgaaccgggggagtgaatcgcaaggcccttgtggccctttccccctttaagcctcctctcaactctctgcatgaggctataaacacagctgtggagagcccgtagagtagtggctccactcagttgaggaactctccgcgaagaccccacagctgttgggaccacatattctcccctgttaggattatataagccctgttggggagcgaacaacgcacgacttgtgtgataaccaatcacaatatgcctagttgaggggagctccccccacaagaggcgcactcatccatgttggagccccaaatgtggatcacaagcgttgtgtgccccaccactgcctggtggcgccccacctcttacgagggacaacgctcgttgggccaccagttgtatctgcacttctaattaaatggattcctaccgacatttagtcaataattctaacgacaacctgtgtgggaaggtggtcatcccccagggatcaccaaaagaaagatttctctgcccggggacgttgcttgcaaacacacgttgtgtgttcttacacaaacagtttgactccacctcattgtgtgttaggggggaggaaaaagccgatcccaatgtgggggggcactttataccacaaacgaccatccaccattactcgggggtgaagaaaaacacttccgaggaataaaaag

SEQ ID NO: 655769 - DNA, 119 bp, Homo sapiens
gtttcctgccccagttttaggccccataaagattttttagaaggcttgccaatcatcatcttccggtaagttcttacacggctacgccctaaactaattgcctttccccctcaacccta

SEQ ID NO: 655770 - DNA, 258 bp, Homo sapiens
tctatttgacagattgtgtaaagacagagcgagagcggtttgttgagtttcgtggataacgaaccgtggatgggaatgatgtgacaaggaagagacctaaagactggatccttccctcagaactatgtatcatgcagtaggcaggaagccaggcacctgggcgtatgaagtctgaccacaaacaaggattggcaattcttaccaagtgaggacgatcgttgacacagtatgatctctatttgtttggcatgcctaggc

SEQ ID NO: 655771 - DNA, 583 bp, Homo sapiens
  misc_feature (307)..(307): n is a, c, g, or t
atatcctggatgcgagctgcgtgggaggtgctagctccgccgtcgccttattcgagaggtgtcagtgcctgggagactaggatgtcggacacgtggagctctatccaggcccacgagaagcagcatggactctcggcgggagaggctgcatgtggaggcggaagcaggactcggggcgcttggatcgtacggaatccagaggcagcatggtctccaaccttccgtagtgacagcccagtgcctactgcacccaccgtctggtggcgcttaagcccagcacagcgttcaggcacgcttccgtgatatngaggctaccagatcctgatgttatgaggaagaaggttgctactagcactctctctgactctgggccttaaccagttggcccagctggactggcttgtgtccagtctggtcttgcccagtgcatccagggccatgatgctcctgccattcaagatggcggtagaaagcctcctgcagaagttagcagctcaggagctggatagacggtaaagcgaggtctcctacagagatgatgcgacatcctactcttgtaacctatgctgaccattccaagctc

SEQ ID NO: 655772 - DNA, 742 bp, Homo sapiens
  misc_feature (235)..(235): n is a, c, g, or t
gccgccttttttttgtttttttggacttccctacatcagttttattataaaacacaaacaagtattctctctttctgtaagggcaatgggtctcaaatcaatgcggaacacgaaacattgactaatcaccaagtgcttctaaattatgcaacaccaacaatttattttttcaaaacaagcacaaagcaatcaaccgcaattattatcaccaacagagggcaccgtggaatcgtgntagagggtgattcccaaacacacgacaataagtcagaaaaatcccagtgggtgaacaccgtgaactattcctcaccatcgtagtcttgcggacagacagaggggcgcttcactccaactcacccacacactttctcgagtctcccagactgtgacacagacagtggacatgctggctagacagggtggtgcttctaatcacctatcacacacctctcgagctccatattgtgtgcctgtgtgtggccagacacatcctatcccccaaatctttccgcaaagacacgtgaatatggcgcagagatccctctagtgggatccttttctttccctctttttcccctatataattgcacccacaaacccagaggctcttaccgtttgaaaatgtttcccacatcttcttgtgatattgaaagccccggtctttaacacaaaccgagacagagttttcccctttgagggggagcccccaaacctagtgacacgaggggggggggcgtcccaa

SEQ ID NO: 655773 - DNA, 179 bp, Homo sapiens
agggccagcatccacgcaggtccaggcagcatcccagcaccatcctggctcaaccacggtgcacaacccggtactctcactcaaaccaatcaccacacacacatattcagcttgggccatggtgggccagtgtgcctgtcagtccgccagctcctcaaggaaggcatgcaggccaggca

SEQ ID NO: 655774 - DNA, 106 bp, Homo sapiens
tactgactaccccgttttcagtggaccctgtgtgcaggtgcgttttccctatccacaggggtgttcgtgtgtgtgcgcgtgtgcgtttcaataaagttagtacact

SEQ ID NO: 655775 - DNA, 803 bp, Homo sapiens
gcgtgtggggacggcggtactgctttcggacagagttgttcgtagaacttgtgctgttccccgtctccgtaactatctcgtgtcggttagatagagcctggagtacacaacatgtagttggtcacgtctacgcttgaacactagcaggtgggctagtagtcgtaggatctggatgcgctcgggcgttagggcgggatccagagccgcctcgaccgtgagagctagaggtctgggtgacggcggccttactaattatatgccaacgcgcgcgaagtgccaagcgtgagcccatgtgaatctcggagtaggcgccacataggtcaggtcgatagtatctcgcacgtttgcactcccagacagatgttacttgcactcggtggacggcagtgttgagattgcctgcatatggaatcaagatccttgccctgaagtacacacgtgggttcacaggcgataagcgtatcaagggaatccggctgtgcctaaaatttgcaggtgccttcagttgggcaagtccgttctagattcaaggctgggcacggccctggccaccaagagcgaggggccaaaggcccaaactggccctgtgtgcctagccctatttgaagggacattggacgcgtccagcaggttacttgcgcaagtacacccgtcacgaactcgaattgtttgctaatctccgggaacccccgtccatggagacattactgcacgattaaacttactagatccactgtattctgtgcaagggttaccgtccgtggctctttacaagcttggcagcgaagggatagagtcgtcca

SEQ ID NO: 655776 - DNA, 684 bp, Homo sapiens
gagattttggtttatccataatagaatgtatttcattagattctctgattctatataagaatgtgaaaagattgatatattgttgttagaaataatgttatttctttccaatttttttttttttttttttttggaaatggagttcgtcgcttcgtgttcacccaggcttggagttgcaggtggtgtgactcctcggctcacgtgcagcctcttaactcccaggttgcaggctattctccgtgcctcagcctcccaagttagcgtggatttacaggcattacaccaccacgccgtggctagtgtttggatattttctcgtagagattagggtttcaccagtgtttggccaggcgtggtctcaaactcctgtgacctcaagttgattccacccactttcagctttcccaaagcacgtgggattacaggtgtgagccacgtgtgcccggcaaatttttttacctttacagaaggtttggctatatttaatggtgagctcaatttttcttggtacactttggtccccccagattggggggcacaaatataaatattaatcttttaaatatgttgtcagccatattgtaatggggctcccattgggggtgatgagaaagttctggaactagataggggtcagggttatacaacatcataaatgcaattactggccactgaatggtatgc

SEQ ID NO: 655777 - DNA, 151 bp, Homo sapiens
aaaaccccccccccccccccccccaaatttttttttaaaaaaccccccccccccctttgggggggggggggggggtttttgttttttttgggcccaaattttaaccccccccccgggggggaaaggggtttttttttttttggggggggta

SEQ ID NO: 655778 - DNA, 356 bp, Homo sapiens
cacgaggtggaaaatggggatcatgctgccgacctcgcagagctggtgtgaaagtaaacaaggtcacagggacatgcatgtgtccacaaaaaagtgcatgacagcactttgtaaaccatcactccatgggtagagatgtttatccgtggccaggcacggtggctcatgcctgtaatcccagcactttgggaggccaaggcggacggatcacctgaggttgggagtttgagaccagcctggccaacatggtgaaaccccgtctttcctaaaagtacaaaaaaattatcctgccatggtggcgggcacctgtaatcccatctactcaagaggctgaggcaagagaatctcttgaaccc

SEQ ID NO: 655779 - DNA, 126 bp, Homo sapiens
atagagtgttatcaagacggaccctgcataacccaatacaaacgcccttcttcgtctgatccgtcctaattacagcgagtccgtacttactcactatcatctcccagtttccctacggtcttggat

SEQ ID NO: 655780 - DNA, 1447 bp, Homo sapiens
  misc_feature (326)..(326): n is a, c, g, or t
  misc_feature (443)..(443): n is a, c, g, or t
  misc_feature (1447)..(1447): n is a, c, g, or t
gcctcgttgtcgcgcactctgttcattccgctcgacttcgagccgctcgcagttctcatctgccggttcgcaatggaagaagagatcgcctggccagctggtgattgactagatgtgcatccggccatgatgcaaaagcatggatttatgctgtgaggacagtacgctcacctcgaagcacgatggttttccattccgatctggttctgggtcgcctccgagcaacaacacctagaggtcgtagatggttaggagtcaatggggctcgagaatagggtactccttaacgttggagcgacgaagggccgcagtagacatagtctgtnggcaatctcggcacctcttgcaagtaacctcccgatgcggaacgatcgtgcatatttgtcgagcatacacattggcgtactgactatgggaggacacgtatcataggcataccgacnatcttaatcttacaatcggagcgtgcagctgattgggccccccgagagggtagcaaccgcgagttagtcgttgccttgaccggtaggcgcccccttgatacctcccataggggccagccagcaggatgacatgtatcggacatcctatgacttatcgttgtcggatgcaccttatcaaactagcgcgcaggacgcaatgtaactgttggatcgatactcaagggagcggatggctttgatctccatcttaaacggccgttcttggagcgctacaccaactgagtctacttgtaccacttgggtacatcttgcggatcatctgggcggtctacactctaactatcggcgatggccccctaattcctaaccgaaagtgcgccatacctgccctcattctcctccgacagcgcaattacccgtgtggagtcatagagcaacctcgcgccttgaggcgcagagtgtaacccttgcacccagtatctaggcaccttcaatgtacaagcaattcttcttcaaacctcgtatgaccgaaagggcctaactacgggatttgcaagcggcaccccctacggggggtccgaacgtctggtgcaaaaatcctgtcggtcgtccagaattaatctaggaagcgaattgaaaagcactttgtatgcgtcattcgatgccggagccaaccttgtcaactttatcgggaggaccacgcgaagaactagggtccattaaccgcccctggaagattacattccccttctttaacatactagggcacacattacgaagcgcattaaatgaaagcgttgccccagatttggagtacccaatgggctaattgtcacgcgattttggggcaaatttgtccgccgcggattcccgggtgcgccacagagcaaggggccgccgtggattggccgggtccctgtgcgcctctcttcatgggaggtattgcgcaaaactcttcgagtcgcgtaagtcaaatgaaaataccccaacttctctacatcttn

SEQ ID NO: 655781 - DNA, 459 bp, Homo sapiens
tgtgtctgcaagaagctttcttctaggagatagaatcaacttttgtagtactagatattctatatggtttttgatatttcttcaccctacagaaactaatgtagtcagagctactacacaatctataaaaggcaggtgctttatttttggatagatatttctttcttatactaggggtaaggctaagtaatgaccttaacttctgagacccctttttcaaaaaacttggggaaccctataactacctatactattgaagcaagttctattgttagatacctactttatacacatacaagtaaaagcagcaatggaaactgatttggtagtagtagccactatggagagtatctactaggtaactatcctacctacatacctacctaccaagtaatgagtcacatatgtgcatagcttttagaactatttcagcaaatcttctttgggcttttctggttg

SEQ ID NO: 655782 - DNA, 197 bp, Homo sapiens
cggaccggtgctgggtacctcggtatcagaagtgaaagggggctatatcctagttttattgctatagcccttatgatgataactgatgagtattgatggtagtatcggttatggttcattgtccggagagtatatcgttgacgaggatagctattagaaggatcatggatgcggatgtttgcgtgaggaaatacttg

SEQ ID NO: 655783 - DNA, 250 bp, Homo sapiens
ggggcgagcagaggctcttactggtgagtgcaaagagctggaaaagaagaacgaggctctaaaagagagggcgattccctgccaagaagatcaggtaccctgaaagatttgatagaagagggtccgacaagggcaagggggaaaggaaaaggggtcccctaggttgaggatagtcaggagcgtcaattgtgcttgtacatagagtgctgtagctgtgtgttccaataaattattttgataggggaaaagg

SEQ ID NO: 655784 - DNA, 346 bp, Homo sapiens
  misc_feature (27)..(27): n is a, c, g, or t
  misc_feature (38)..(38): n is a, c, g, or t
  misc_feature (130)..(130): n is a, c, g, or t
  misc_feature (135)..(135): n is a, c, g, or t
  misc_feature (188)..(188): n is a, c, g, or t
  misc_feature (196)..(196): n is a, c, g, or t
  misc_feature (326)..(326): n is a, c, g, or t
atggtcaccgtttggctttccaagagncgaaaaacggntggcagagaggaatcagaaagttatcctaggctgggcgcggtggctcatgcctgtaatcccagcactttgggagactgaggcgggtggatcncctgnggtcaagagttcaagaccagcccgggcaacatggtgaaaccccatctctactnaaaatacnaaaattagctggccgcggtggcgcatgcctgtaatcccagctacttgggaggccgaggcagaattgcttgagcctgggaggcggaggttgcagtaggccgagatagcaccattacactccagcctgggtnacagagcgagactccatctc

SEQ ID NO: 655785 - DNA, 891 bp, Homo sapiens
tgccgcctccttcttctggcgctcctggtgctgcttgtgtgactcgttcggtagcggtggcactctggctacctcttttgtgaagcggatgctgctgagactccggcgctctctgtggccgacgaaaacttccacggactgagtcgacgactgaggaacagctgatcatattagatttgagacgcgtggcggaggccaggagtggtttctgtggtgcactttagatcattatgaggcatacaccgacttagatagacactaatgaaaaggcctaatggtgaaccggaactagggatatgtacagatgaggcagaatcactattccgaatcatgagggggcaagcaattcacctgagaccagagacacctggctgcatgttggagacctggatggaatgacagactgcatacttgatgtgttccacatcgaggcatgaacgggcatgtgcgtctacgtgaggcttaggggaacccgtgctatcgtattactccagaagcatcatgtatcttgtatcgagccaacgattaacattctcggctgtgagaatactgcgagttctgagttccgaccaatggttcctggacctcgatccggtaatagattgacatctattttccgtgtcatttctcgccttcctccaatgcctttgttggtccagtccggtacactggggttcttctggtgcgcgagcatgttgcctttcttttggtttattgtaactggatagcccgccggagggttcgtgctttgctgggacgtcccggggtggcacccggcttgggggccgcatcttgccttcggtgaaaaatccccgtccttcccgggcggggcgcccctccggcgttttgctatgtcccgcggtcgtcttgtctcctgtgtgtagcacacga

SEQ ID NO: 655786 - DNA, 307 bp, Homo sapiens
  misc_feature (10)..(10): n is a, c, g, or t
  misc_feature (37)..(37): n is a, c, g, or t
  misc_feature (63)..(63): n is a, c, g, or t
  misc_feature (270)..(270): n is a, c, g, or t
  misc_feature (282)..(282): n is a, c, g, or t
gggaggccgncagtcgcggcgatcttctcctcgcttntggagtgttatcgtcaccatgtccanaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccacctncgagctgccatngctgctcgtccggacccgcggccgc

SEQ ID NO: 655787 - DNA, 660 bp, Homo sapiens
  misc_feature (10)..(10): n is a, c, g, or t
  misc_feature (37)..(37): n is a, c, g, or t
  misc_feature (63)..(63): n is a, c, g, or t
gggaggccgncagtcgcggcgatcttctcctcgcttntggagtgttatcgtcaccatgtccanaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagcaatggcgcgctacgcctgtggcgcgcccgtgttggcggcgaaggaggcccaccttcgagctgccatcgctggtgtcctccggaccccgtggccgcctgccaccctgcgggtcaccgtgttgcaccgggcggcttgtcggccttcgaacaagttccctggaaccgcgccgagggtggaccctggcgggaatcgtggcaccggcggaccccagggcccgccaagggcaagaacggcagggccactaggtgggaaaatcccacacccgggacaagcaaggtgcacacagtgaggctgacgcgcccacacttggagggttggacaattccagcttaactgacgacaacaagcttgactgcccaggcattgttggcacctttcaatgcaccgcaaacagttctcggcacatcccattggaaacagctgacggatcaaagaaccaagggggcagcct

SEQ ID NO: 655788 - DNA, 119 bp, Homo sapiens
agtgagcagggtatcctgttgggtaagattcataagaggggatgcagagtgagaaggtcgtccacatattgaataaggtgagaaacagatggacagaaagaaagtaaatcatgagaaag

SEQ ID NO: 655789 - DNA, 82 bp, Homo sapiens
catggatttgctggtgcagtacaactaggcttaatagggactgcactccaacctgggtgacagagccagactccgtctaaaa

SEQ ID NO: 655790 - DNA, 570 bp, Homo sapiens
  misc_feature (12)..(12): n is a, c, g, or t
  misc_feature (92)..(92): n is a, c, g, or t
  misc_feature (96)..(97): n is a, c, g, or t
  misc_feature (133)..(133): n is a, c, g, or t
  misc_feature (136)..(136): n is a, c, g, or t
  misc_feature (139)..(139): n is a, c, g, or t
  misc_feature (141)..(141): n is a, c, g, or t
  misc_feature (143)..(143): n is a, c, g, or t
  misc_feature (153)..(153): n is a, c, g, or t
  misc_feature (161)..(161): n is a, c, g, or t
  misc_feature (171)..(171): n is a, c, g, or t
  misc_feature (225)..(225): n is a, c, g, or t
  misc_feature (255)..(255): n is a, c, g, or t
  misc_feature (258)..(259): n is a, c, g, or t
  misc_feature (271)..(271): n is a, c, g, or t
  misc_feature (276)..(277): n is a, c, g, or t
  misc_feature (284)..(284): n is a, c, g, or t
  misc_feature (298)..(298): n is a, c, g, or t
  misc_feature (323)..(323): n is a, c, g, or t
  misc_feature (332)..(332): n is a, c, g, or t
  misc_feature (364)..(364): n is a, c, g, or t
  misc_feature (388)..(388): n is a, c, g, or t
  misc_feature (392)..(392): n is a, c, g, or t
  misc_feature (447)..(447): n is a, c, g, or t
  misc_feature (469)..(469): n is a, c, g, or t
  misc_feature (480)..(481): n is a, c, g, or t
  misc_feature (483)..(483): n is a, c, g, or t
  misc_feature (495)..(496): n is a, c, g, or t
  misc_feature (504)..(504): n is a, c, g, or t
  misc_feature (542)..(542): n is a, c, g, or t
aattaaattgangacatagctttactctcttctttgatcataactaaaataatattttagacaaaagctaaaacaaaaagggggtattatangggnnggggcttcttttccaaacacttctcaatatcatcangcnccngngngggggccttngggattcnagtcccaggnccaaatacattgggaacaccaacttcaaacagaaattcataatcctgggggggnatcacccctccacacatgacaagaatatcnggnnggccaggggggngaggnncttggangggttcggggactngggttttatggccagcggcgagggngcttatgcncacagcatgcacatccgcatccacagcctgcngggccacttcacgaggagtctggnaaanacggcctatgtccacatcaaaaccaagatcagcaaatcctgtagcaataactttngcccctctgtcatggccatctngtcccatttcnncnacaagaagacgnngcctgccnccttcacgttccatgaatttatgaaccctcttgatagnagatgttatctctttactttctccaaat

SEQ ID NO: 655791 - DNA, 688 bp, Homo sapiens
gagaagaagaaggaggttcctgctgtgccagaacacccttcaagcaaaacagcgaacgtgaatttctgcagcagctgacagatcaagcgcctgagaaagaagttttgcccaaaatgatgcttcgaacagtgcaaggagtgaacgcttatctatcaacacaagcaaatgcactatcacacatggcaactataacggcacgatgctacaagaactgaacattcgacatggcgaggattgtgcacagaaaagctggcaacttctatgtacctgcagaacccaaatttggcgttttgtcatcagaatcagaggtatcaactggatgtgatgcccaaaggttcgaaaggtgttgcaagcttcttctgccttcgcacaaatcttcaactggaacctttgttgaagctcaacaatggcttcgattaacattgctagacggattagtaagcagccatataatttgcatgggggtaccccaatctgaaggtcaggtatacattgaacttaatctaacaagcgtggctctatgcgcaaacactcaaattacaggaagccgaaatttgcttagacagagattaactgcttagatatgctcgatcctcttgcgtcaatacggcattcatcttgcctggaacgatttagcctcatcgagatctatacctgtaggcaaacacgctatcaaataagcaaaata

SEQ ID NO: 655792 - DNA, 482 bp, Homo sapiens
  misc_feature (13)..(13): n is a, c, g, or t
agaggatccccgnccgacttgggactgaccaccgcaaggtacctatccatgaacgatacgtaatgacgcggaggccccatccggcgaaatcgtcgcggttttctaagaatgattctcgactaggcgcgcgggtcttgggcaggcgggcaatcgcgggccacgcgcgcggtctcagcggcttggcaaccgctggcgatgcgcgtatgcagccgatggaccaacatgcggacgggctggcgccgacgcgcgactcatttcgaggcgcgtcgatcgcaagggggccgatcgtgtgtcgtaataagcaagtcggcgcggcgagaccttgagagaggtcaaatccgccgaaacgggccgtgagggaaatgaaggcgcaattttcggggattcggcggatcttgacgggcgcgtcggcgctcgccgccacgatgatgttcgcgggacatgctctcgccgaggatctgctgggccagccgacgccgggt

SEQ ID NO: 655793 - DNA, 422 bp, Homo sapiens
  misc_feature (376)..(376): n is a, c, g, or t
gtatcctaaaatccccacccccaggaacccataggcatcaccgttgaccgtccccatttacccaagtccttcccccctggcaaagattcctcctgaattgtgcctgcccttggcccaaaagaggtatgggaggggctgggccgcagtggcttgtgccctgtaatccccaacattttgggaaacccaattcaggtggatcgttagaggtcaggggttcaagaccatccctggccaacatggtgacatcccatctctactaaaaatacaataagttagctgggtttggtgttgggtgcctgtaatcccagctactcgagaggctgaggcgggataatcgcttgaacctgggaggaggaggtggcagtgagctgagaangtgccattgcactccagcgtgggcaacaagagtgaaacgtcgtctc

SEQ ID NO: 655794 - DNA, 404 bp, Homo sapiens
  misc_feature (356)..(356): n is a, c, g, or t
  misc_feature (368)..(368): n is a, c, g, or t
  misc_feature (399)..(399): n is a, c, g, or t
tgagactgcatagggctcggcgcgggggttggggggaatctgtgcagggggaagcatattacagaagcaagaaagacagttattcaattaactgagacatgcattacatcatttcttacttttcaaggaaaatcatgttttacgacttgagtttatctgtctagttaccttgcagctgcacagctaggagaaacagggtatttacaatgcctggggaaaggaggagagataaggctcactagccacagaaaaacagggcagttaatttttaaaggactccagctctttctctttctcacgggggaattgggattttcttacatggcaactggaatttctggctttacacatttttnaaatttcttttnaatttgctttttccaatggcattggctgganttatt

SEQ ID NO: 655795 - DNA, 859 bp, Homo sapiens
gcagttcgcaatgctgcttttcttaacacgctgtaaatttctgggtggggttaggctgaggggcggcaggatgaattatgatgttatgttatggtatcgtcttttaatcaggcatgtttcaggtttggatttcgtccttttacttccagcacaagcggttccttgccagtttaggatattgagatgtgcagtgccgcatgcatctcgagggaactgagataatggcaggaaaagttccttcagctgttggaaaacggagtcaggaggttgagggaggcctccattaaggcatgtcttagaatctaagactcagatctaatgatgggctaaatgtgtacaggatcacagagtggagcatcttagagtcttccgtctctcccagtacaattcactgcgtcgtctacatttacttgttgcgtatagaagggcatctggtcccaagtcgagaagtgacatgagaatttttgctaagtgaccgggtgacttaagttgcatgatgccctgttcgtcatgcgcttcccagagggaggaagaggcctaacttgctgctgagatactgtctcttgtgtccagtgtatctaaccggactcaagtggagcagacagcttctacagtccagagcttggcggatgagtaggcttgcaggttgggttcggatttgctaagtctttgctgtagccatacttgtatttaacatgtaagggaagtgatagggaaagtatttattgagaattattgatactacagaagttgtcaaattagttccttgtgattcctggaataatttatagttatttaagatttgaatgggggtaataggctggatttattcataaaggatcttggggagagttactaa

SEQ ID NO: 655796 - DNA, 439 bp, Homo sapiens
tccttcagacccagaatcgtaatagctatgtaaggacacttaaataaactcaagctaacacagagaaggaatacagaattctatcagataaatttaacaaagagattgagataatacaaaagaacctagcagaaattctggagttgaaaatgcagttgaaagactgaagaatgtgtgttttttaatagctgaattgatcaagaagaagaaagaattggtgagcttcaagacaagctatttataagagacaaaataataaagaatgaaacatgcctagaagactctagaaaaatgcctcaaaagggcaaatctaagagttattgaccataaagaagtggtagagagaagtagaggtagaaagttttttcaaaaggaaagtaacagagaacttctgagacctagagagagatatcaatatctatcactttctaagaaagtt

SEQ ID NO: 655797 - DNA, 739 bp, Homo sapiens
tacgggggaaggcgcttggtgaagtaggccttatttctctgtgttcctattcgtacaggggaggaatttgaagtaaataaaaaccgacctggattactccggtctgaactcagaatcacgtaggactttacatcgttgacacaaacgaaccttaaatagcggctgccaccattggggatgtcctgatccaacatcgaggtcgtaaaccctatggtagattatggactctagaataggattgcgctgtaatccctagggtaactggtcccgatgtggctcaagtctatgggactcaatgtgagtaatagatagtctcgcatatgagaacggggtgaaagctctatagcactgatacgggcctcggagagataggggatacgtgcctccgaggttcgccccaaaccggagaacttctttaatgacacggttgtgggaaacgattcacggaccccctgtgtgcgagattcggacaaaggataacgggaaatggacaatatacactacaaaatttaaaagccccccataggggggatcaaaaacaacagaaattagagagtaggtgacttcaattgcacacgggcattactatccacagatgggccaaagggttcaaacatttcaccgagtgggtgttaaaagaagtcttcatagaaagcactaaggcttggtaaccacttcgtgtgtgaagccatttacatattaaaggggtttcccctataatatatggtggcacccacgg

SEQ ID NO: 655798 - DNA, 90 bp, Homo sapiens
gacccaagtgcagaataaattgcctaagtagaaaatggaggaaccgaactccttcggacttgtgatgtgtgtggctcgagaggacacaca

SEQ ID NO: 655799 - DNA, 135 bp, Homo sapiens
atctagagatcccggctcagtgatctctcactcagctctgagtacagggttgaggatgatcacacacctggttatttttaaaacttttttgtggagacagggtcttactatgttgccatggtggtctagaacttc

SEQ ID NO: 655800 - DNA, 385 bp, Homo sapiens
cctcactggctttcgccaatacactgtcctcccacagagacaagctgttccctgcatttggatttggggcccaggttccccctgactggcaggtgagctacctctctttctgccattcctgttaacagttccagggtcctgatttagagggatgtgtagattactagctacttggcactcaggctttaacaggagatgcatggggttggattcctgcaggcacgtagacagcaagtgctcaggactccatagctcctataggaatcttggcacacgccagtgtcctttttcattcttagcagaggtcatggggaaagaacctcattttcattcttgtctccaggtctcgcatgaatttgccttgaatttcaaccaagcaacccct

SEQ ID NO: 655801 - DNA, 339 bp, Homo sapiens
tagtaacgcaggtttggtagtttagcactctgtgggtttgttaggccgtgtttcgcattaataatttaaagctccatagggtcttctggtcttggtgtgtcatgccggcctcttcacggccaggtcaatttcactggttaaaagtaagagccagttgaaccctcgtgaagccattcatacaggtccctaattaaggaccaagtgattatgctacctttgcacggttagggtaccgcgcccgttacacatgtgtcactggacaggcggtgcctctaaccgtggttatgctagaggttatgtttgtggtacacaggcggtgtaatatttgccgagctccct

SEQ ID NO: 655802 - DNA, 662 bp, Homo sapiens
cagttatctcaagtactttttgtccttgctttattactacataatgttttaaaggaaattcagggagcttttttggcatagtgtgggaaagatagagtcaatttcatttcaactctgaacatttatctagtggcttctggtagtcagggtttgaattttcatgattatttaattgttactttttgcattttgaagaatttcacaataaattaagctatcccttctaataaatcctgtttcttaccttaggaacgaatatgacttctgacttgcactggacaaactttttcttgttgagtgcttgtagtcctcacacaggccctgggtatgtcaccatacttcgtaagcacctgtccatgctacttatcattgttgaatccagggcctttctgagccttcccagagttgacctagtgctatgcatttgggcccaaggactgaaagctgcactaagaagagcttaaaaagaaagctcatggcatgagggtgtgtggaggggaattatatatacatgtatatgtatagatctggtttgtttggttttccccaagggtttagactcccttttatgctttttggaagcttcaaagccattctttggactatttgggaaactgttaaaaagcaacaaggttcaaaaacaaaaaacatgggattcaagg

SEQ ID NO: 655803 - DNA, 577 bp, Homo sapiens
agcaccggatcttttccatctaattccgcaaaaatgatcatttgcaaagtcaaaactatagccatatccaaatcttttccccctcccaagagttctcagtgtctacatgtagacgtattccttttctgtataaagttcactgttaggatttcaagtcaccgacgttattttacgattttgagtcgatgcaaagattcaagtagtttgcgaataagtacttatctttattgtaatgaatttagtctggtgatcaaaagcatagtcttaatttttgagaacgtggttttagcatttgacaaagctaaattccagttaattaattaatagctttatattgctttcctgctacatttggttttttccccgtgtcccttggattacgggctaaggtagggtagagtgggtgtagtgagtgtatataatgtggattgtggccctgtgtattatgatatttggtagtttgtgttatattatttacatttcagtagtggttgttgtgtttccattttagtggataaaattggtattttgaactatgaatggagactaacgcccagcattagtttcacatgagata

SEQ ID NO: 655804 - DNA, 712 bp, Homo sapiens
  misc_feature (163)..(163): n is a, c, g, or t
  misc_feature (254)..(254): n is a, c, g, or t
  misc_feature (262)..(262): n is a, c, g, or t
  misc_feature (485)..(485): n is a, c, g, or t
  misc_feature (497)..(497): n is a, c, g, or t
  misc_feature (513)..(513): n is a, c, g, or t
  misc_feature (544)..(544): n is a, c, g, or t
gcttacccaatcagattgacgcggcgttagtatggccgtgtacccgaaaaactgattgactgggctggcgttaactgtgcggaggcaggatttccctggggaaagtcttcactcagagcttcgctgacagccaaggatggcaagcaaggggccctcggcctcntgcatctcctgagaactccagtgcaggggggcccaggtgggagcagcaagtggcgcgtggcgagagcggagggcaggacagcactttcgangtgcaacnatctgcttggacacagccaaggatgccgtcatcagcctgtgtggccacctcttctgtggccgtgtctacatcagtggttggagaccagacctaacagacaggtgtgtcctgtttgcaaagctggcatcagccgagacaaggtcatccccctctatggaaggggcagacactgggcaacaggaccccagagagaagacccctcctcgtcctcaaggacagaggngcagagccggangaatagagggggattncaaggattggatttggagatggtggcttccnagatgtcttttgaatggggcattcccttgagatatttgcacagcatttaatatacatgatgggcggctcctccagctgtccctggaaacccagtatgtgacgagcagtcctgtcacgctcttctatttgtggcctgtgatcatgtctggctctgatgctaaaggtggc

SEQ ID NO: 655805 - DNA, 561 bp, Homo sapiens
  misc_feature (206)..(206): n is a, c, g, or t
  misc_feature (414)..(414): n is a, c, g, or t
  misc_feature (492)..(492): n is a, c, g, or t
  misc_feature (502)..(502): n is a, c, g, or t
  misc_feature (511)..(511): n is a, c, g, or t
  misc_feature (541)..(541): n is a, c, g, or t
ttttcttcaagactaggcaagtgaagcagtgggaatggagaaggaacaaagaaatctacaaactggttgtgatcaattagttgtaaataccactgcacttggatcagccaggaacaagttctttgaaatacgccagagaattaacattatcagtgggccaaatgtgtggaagatgtattatcctagtctcttttcctgttctctanaagtatgttactggctcttaaaagatttcacaaaaatacgctttgaggagaatcacagctttcttgattagtatctacaaggcacttaatgcacattttcatgaagaactgatggaaaaaaaaagattacatgaacatcctcttattctgaacgccaaaattcctggatgttaaataacattccattgttctgcctcctgtttaacanggccaattccacatcattccacagcgttggccatgttcaataggttccactgcaagttttccaaaaaccaaatcccanattcaccatnctcccacanacacaatcctccactgttgaataatttccnattgtcacacggccgtccct

SEQ ID NO: 655806 - DNA, 513 bp, Homo sapiens
aaatggagtagcctcagcctaaaagatcaggcatcctgggtcggccctacgcagcttgtggtcagaacatcgtgagatcatgcagcctcacggcggggaacatacgggatcaggtccaacagcaggttggagttagggtacatgatttcaaagtcaggatcgtgagggcacccaagatgattaccgagaaggcaaaagcacgtgccaggtaatggccatgtgaaggtctgggaaacagccaaaacgtagcgtgtcaggaatgtgggacagagtccctagggcagtcgtttcccaaagacatgttccaagatatactagctctatgggatgtggagttacaataatatgtggtgaaaaggtttgccagacaaacactgagttcagagtaaagcaggtcagatactatagcagacgctgtcatagctgctgataggcgcaatagaatagtaagtgtacaagatgaaggtttcaaaatgggcaaataacaaatatgtcatacagaatcctggatgt

SEQ ID NO: 655807 - DNA, 402 bp, Homo sapiens
tcacgccatgtcacaacagtataggacggccaggcgcagtggctcacgcctgtaatcccagcatcctgggaggccgaggcaggcggatcatgaggtcaagagacagagaccatcctggccaacatggtgaaaccccgtctccactaaaaatacaaaaattagctgggcgtggtggcgtgcgcttttagtcccagctactgatggtgggtgaggcaggagaatcgcttgaacctgggaggcggaggttgcagtgagccaagattgcaccactgcactccaacatggatgacggagcaagactctgtctcaaaataataataatagttattaccattacctggtcccgaatattaatagtgcaaggacaagaaatcctggtttaaagtgatgggcaccaaagca

SEQ ID NO: 655808 - DNA, 276 bp, Homo sapiens
tcaggactgcaaattttttatcaaaacaattgttttttctaatagtaaaactttgacccctccaatctaaaaaataatcaccccccataatcataccaaatttttttcctaaccagcctcttaagcgttttaactccaattttttcaatctaaaaatacagggaaaactcgataaataccaggtaagagaaagctctttttaggtacttattaggctccttcgaaaaaagtgagtactgcgaacatttaaaatatcataataccaagataatgttt

SEQ ID NO: 655809 - DNA, 964 bp, Homo sapiens
acagagcatagcaaccccagattctggtgtcctccgtgcccacggatccacctggggcccagagaggagaggagaggagtcttcaggtcatttcctggtctgctgccacaggtacatgtggctggtggggatggctgtggggcacttgatcatatgtgccatgatccccaacgcttgtgtggatgcaagccccaatttacgctcccacggaaaaaattcgagcacatccaacaattagcacacgataggagcaatacatcacacaaacaaacaacgaaatgacccaccgagagaaagagcgacagaaggacaaataccacacacaaaagaacaatgaaaacacgcaccggcacgcgacaccacacacaaacagactagacagtgacaacgacaccagaacagcagagcacgaggagcccacgagcaacgagggcgcagcgagcgagcagcgagggcgcgagtaggtaccgacaaacgcagcgcgacgagcacagcgaaaggcagccagggggagcaacacaaccaagcggaccacaagaaagtggaagggagctgcaaacagcagggtcaaagagaacaaccaatgacgagaccagcacaacacccaaatgagacgacccagatagaacaacttgcacacccaaacaaaaagcgaacacacacaaaaaacagcagacgaaaaaaacaacaccataccaaaaccacacgggacgaaacccaataacaacaagacgagaggttggacacaactaacatagacaagaaaacagaaaaaaaggaacgcaaagcacaaagcatacaaaccggaggcaaccacaagaccgacaacgaacaactcaaccctggctcccacaaaccacagggtaagcagacacgaacaacgagactaccaaaataccagacaagaggccacaacaagaaagaaggaagagaacaaaaacagaaaacagaaacacaacacaaa

SEQ ID NO: 655810 - DNA, 309 bp, Homo sapiens
  misc_feature (31)..(31): n is a, c, g, or t
  misc_feature (81)..(81): n is a, c, g, or t
cgttatacatctccgcttacgggttctagcnattctcctgcctcagcctcccgagtagctgggattacaggcgtgcgccancacgcccagctaatttttgtatttttagtagagacggggtttcactgtgttgctcaggctggtcttgaactcctgagttcaagcgaccttcctgcctcgatcttccaaactgctgggattacaggcatgagccaccgctcccagcccaggattgaagtctttaaagtggactgtgtttgccagtggattccagggatacaggcagggcacaagcagaagtgtccacgt

SEQ ID NO: 655811 - DNA, 562 bp, Homo sapiens
agccacgactagccagatctgtctgctgctagatatgataggcattttaagactcaactggaaatctcaacagtgctggtaaaccattaaccataaaaacgtgcttttgaacaccagtgctgaaaaaaatatttttttttttattttggagggtgaaaggggctgggatttaaaataggacaaggtggagaagggggggaagatggcaaaaggatttagtactcccttagtggtgtgtactgtgtgcaacggggaacctcttacttcatataccctcgtgcagaaatcattcaggggagaaagaaaacccgtggaactggattgagggcgtgactctgtggtttgggtgcacgggggcccgatgccgggcatatagtgaaggtgattgtcttctccctcagaaaaaattgggtccctggcggtcccagtagggctatagcttttccagccctaatttaaaaactcagtgaggccttagtaggggaaagatggaggtaaatacaagggtatggcgggacaccaactacagcgtggtgtcccggggggtaggagggggggaccc

SEQ ID NO: 655812 - DNA, 127 bp, Homo sapiens
  misc_feature (74)..(74): n is a, c, g, or t
tgtctcctctcgtgcgtgagtggacacaactacctggtaaggggaaggagacgctgcttcacctggagcccccnaagacacacgtgaatcccacccctttaacctaaacttcatgtacctatatctt

SEQ ID NO: 655813 - DNA, 204 bp, Homo sapiens
ttaaaacctaaggtaattgaagattagagaaccatgttaacactaccgtttgatgagtctgctatgtaatgccagagtcccagatgtgcagcaagttttctagagattgcgaggaccagaagcaaattaagaagccagaaagctttaccaaacagattgtccttcgaggaaagagcatcaaagggcccctggggaagaaaccca

SEQ ID NO: 655814 - DNA, 216 bp, Homo sapiens
cgtgctgctggaaatctatggctgccttttcaggtgcattaatctcctcctcagaaggaatgctctgaaattcttctgtatgatcaccacacaataaaggacctttctgtattgttttcgtgctaagcagcccaagacatgggcccgaatcaccatggccgcgtgggtcacttcctcttcccgtccgattctccacggattctcatccttgggaag

SEQ ID NO: 655815 - DNA, 178 bp, Homo sapiens
gatagtgagtaaaacagaggttatggagggagagaagggtagaatggggagttactatttaatgggtacagagtatctagtttcgggtgatagaaaaccttctgtgaaatggataatagctggtggttacacaacattgggcaatgtaactaatagccactagaactgtccactataa

SEQ ID NO: 655816 - DNA, 251 bp, Homo sapiens
gagctcggtaccccccttactgagtagctgggattcaggtgcacacaccatgcctggctaattttttttgtatttttattagagaggggctcgtgccctctgtggtccaggctgaagtgcagtggcatgatcacagctcatggcagcctcaacctcccagccaggctcaagcaatccttctacttcagcctgtcaagtagctgggactacaggcacatgccaccacagccagctaatttttaaattttttg

SEQ ID NO: 655817 - DNA, 352 bp, Homo sapiens
acgactttacaccaaattagttaggtgtggtggtgtgtgcctgtagtcccagctactggggaggctgaggcaggagaatcgcttgaacctggaaggtgaaggttgcagcgagccgtgatcgtgccatcgcgctccagcctgggtgacagagtgatattctgtctaaaaaaaaaaaggagaatcctgtccatctttcacagtcaaattcaaatactgccccctgacattgggccttttaaatttaactggtattccaagtgtccacaaaatgttcgttgaatgactaactgatagaatccttctaattgtgatacatttcccgtgcttcctgagaactttgttagtgccactt

SEQ ID NO: 655818 - DNA, 778 bp, Homo sapiens
acaaatataattatactattatataaatcaaaacatttatcctactaaaagtattggagaaagaaattcgtacatctaggagctatagaactagtaccgcaaggacaagatgaaagactaattaaaagtaagaacaagcaaagattaaaccttgtaccttttgcataatgaactaactagaaaacttctaactaaaagaattacagctagaaaccccgaaaccaaacgagctacctaaaaacaattttatgaatcaactcgtctatgtggcaaaatagtgagaagatttttaggtagaggtgaaaagcctaacgagcttggtgatagctggttacccaaaaaatgaatttaagttcaattttaaacttgctaaaaaaacaacaaaatcaaaaagtaagtttagattatagccaaaagagggacagctcttctggaacggaaaaaacctttaatagtgaataattaacaaaacagcttttaaccattgtaggcctaaaagcagccaccaataaagaaagcgttcaagctcaacataaaatttcaattaattccataatttacaccaacttcctaaacttaaaattgggttaatctataactttatagatgcaacactgttagtatgagtaacaagaattccaattctccaggcatacgcgtataacaactcggataaccattgttagttaatcagactataggcaataatcacactataaataatccacctataacttctctgttaacccaacaccggaatgcctaaaggaaagatcca

SEQ ID NO: 655819 - DNA, 353 bp, Homo sapiens
  misc_feature (61)..(61): n is a, c, g, or t
  misc_feature (278)..(278): n is a, c, g, or t
tcccttaggaccctttaaccgatttttccagtgatgcagtgatgatatgtaatatataatnaataaaatcaggcccaggtgccagtggttcacacctgtaatccccagcattttggcaggcgaaggtgggagaattgcttgagctcaggagttcaagactggcctgggcaacatggtgaaacctcgtccctactgaaaatagaagaaatagtcgggcgtggtggtgcatgcctgtagtcccagctactcaggaggctgaggtgggaggatggtttgancctgaaaggcagagattgtagtgagctgagatcgtaccactgcattccatccaccctgggcaacagagcgagacc

SEQ ID NO: 655820 - DNA, 410 bp, Homo sapiens
gggttaaattaaaatccatctgatgagaatttatggtttgtagggcaggactcctcaggccccttaggaatttgggcaagagagagaaaagtcagagtttagtcctcacaagtacagaggaataatctgaaactattcatgagattttaccttggatttttaaattaagacgttgtttgttaccctgtgtgagagacattttaaattaaaggtaaatgagattaccaagagttgaggaagggtctgtaggctttttttctttttaatcttgtgaacagtataggaggaatattcatatttatttggataatttatgattctgacttttagaaagtttgtttgttttttgttttttgagatggagtttcactccagcctgggcaagagagcgagagtctgtcaaaaaaaaa

SEQ ID NO: 655821 - DNA, 196 bp, Homo sapiens
aacacggtaaacgtcacgttctgcggcgttaccgtgaccacatcaaaaaggcggtagaataggccgtcagccgtcgctccatcaccgatatggagcatggcgaacaatatcatgcattcccggacgggacatctacgaaccgtgtgcttcaccatggtccgcggtcggcaaacagtaccgtgtgtgcatcccgtgc

SEQ ID NO: 655822 - DNA, 238 bp, Homo sapiens
ctgttgtagtgtaacttagtctatgcagtaggggaagggagcctactagtgtgtgtatgaatacggaagtatgtgcctgcgttcagagcgttctggctggttgcctcaatctgggtgatgatagccacatgtggggcataagtgtggtttcgcagcatgatataaaatattgattagttcttgtggctgtgactgttatacttaatgcgatttgtagggagattagtctagagagtgt

SEQ ID NO: 655823 - DNA, 185 bp, Homo sapiens
tgcaggacgtctgaggactttacatgatacttcatggattgggaggtttttttactctaccctattggaatacaaactatcatagccttgtgtgagagtttcagaaattatttggcctttgtttttttttttttttttttggttggcaatccctttcccaacccccaggggtttccctcccaaac

SEQ ID NO: 655824 - DNA, 818 bp, Homo sapiens
gactcgactgcgacctccacctcctgggttcaggccattctcccgcctcggctccagagtagctgggactgcgggcgctgccaccacgcctggctaattttttgcacttttagtagagacggggtccactgtgtcggcaggatggtctcgatctcctgaccttgtgatccgccgcctcggtctcccaaagtgctgggattacaggcgtgagccaacgcgcccacgcccacttacaaattctttatagagatgaggtcatgcttgttatgttgcccaggttggcctcatgagatcctgtgcttagccctcccaaagttgcgtgggattaccagatgtgagacactgtgcaccaaaaagcccacccagttttttggaccctatatcttctctcgtgggaggacagtcttactccgtcggcccaggcttggagtgtatctgtcgtgatctcggctcacttgcaacctccgcctcccgggtccagggcaattctccgtgcttcagcctcccgagtagctgggatggcaggcgcctcgcaaccacaccggagtagtctaccgtcattccaaccgtagcacgcaaggggttctcccattgttggccagggcatgtccttgacctcactggaccttcagggtgctcccactctggggtctggttcccacacaagtggctggcgatactcgcggtcgtgcagccacttgcgctggttgactccaagccactttctcaaatgatgcccgtccacccagcgtctgcgcctacttggacaccacatgtctctggtgtgccactgaggcgcctccatgcacgtcacccgg

SEQ ID NO: 655825 - DNA, 633 bp, Homo sapiens
  misc_feature (104)..(104): n is a, c, g, or t
  misc_feature (111)..(111): n is a, c, g, or t
  misc_feature (125)..(125): n is a, c, g, or t
taaacggaatgagtgtcactctgtcatccaggctggagtgcagtggtgcagtctcggctcactgcaagctccgcctcccgggttcacaccattctcctgcctcngcctctngagtagctgggacnacaggcccccaccaccatgcctggctaattttttatatttttagtattcttatatatttataatttatatattatttttgtatatttagtaattttttgtattttcaccatgtcggtcaggctggtctcgaactcttgaccttgtgatccgcccacctcggcctcccaaagtgctgggattacaggcgtgagccaccgcacccggcctcctgaattaacattttctaaagatgcttctggcgtgctatcctgaaagctgccagaggtgtcttggctgcattggtggtaataaaattcatactcatatttgactttaaaaaaaaaacaaaaaaccccgggcaccaaaatgaggggggggagaacaaagcgggtataaaatgagccgtgggacaaaaagtggtgcagggaccccctttttgaaaccagggcaacacgcggacccccaaaggggccgaaaaccgcacaccgggaccgtgaaagagagcaaaagaaaaagagaccgcaagac

SEQ ID NO: 655826 - DNA, 420 bp, Homo sapiens
tatgggatctgcctgagttctaggaataatgggggaagtatgctaggagtcatagattagtccgctcgtagtcaggctgtactcgttaggttcagtaccattggtggccaattgatttgatggtaagggatagcgatcgtggagctcgtctgttatgtaaaggatgcgtatggatgggagggcgatgaggactaggagtgatggcgggcaagatagttcagacggtttctatttcctgagcgtcctgagatgttaggtattacgtctagattttgcttgtgcacatgttaggaaaagggcatacaggactaggaaacagataaggaacctgattatgagggcgtgatcatgaaaggtgataagctcttctatgataggggaagtagcgtcttgtagacctacttgcgctgcctgtgccat

SEQ ID NO: 655827 - DNA, 112 bp, Homo sapiens
gtttcaacagtatccagttagtggagcatctgacatgtgaagggtcgggcttgaggagcaaagaaggcttggtttgttcccaaccttttaagaacatagtcagtgatcggga

SEQ ID NO: 655828 - DNA, 570 bp, Homo sapiens
gctcgaggagagagagagagagagagagatagagagagagagagagagagagagagagagagagagagagagagagagaggcctggctaattttttatatttttagtattcttatatatttataatttatatattatttttgtatatttagtaattttttgtattttcaccatgtcggtcaggctggtctcgaactcttgaccttgtgatccgcccacctcggcctcccaaagtgctgggattacaggcgtgagccaccgcacccggcctcctgaattaacattttctaaagatgcttctggcgtgctatcctgaaagctgccagaggtgtcttggctgcattggtggtaataaaattcatactcatatttgactttaaaaaaaaaacaaaaaaccccgggcaccaaaatgaggggggggagaacaaagcgggtataaaatgagccgtgggacaaaaagtggtgcagggaccccctttttgaaaccagggcaacacgcggacccccaaaggggccgaaaaccgcacaccgggaccgtgaaagagagcaaaagaaaaagagaccgcaagac

SEQ ID NO: 655829 - DNA, 371 bp, Homo sapiens
  misc_feature (36)..(36): n is a, c, g, or t
  misc_feature (38)..(38): n is a, c, g, or t
  misc_feature (97)..(97): n is a, c, g, or t
  misc_feature (270)..(270): n is a, c, g, or t
ccacctctgtgtctaccatgaccccccttcctcaanantgacctgtgttcccttccctgttctcttttctattaaaaataagaacctgggcaaagtncggcagctcatgcctgtaatccccagcacttagggagaccgaggagggcagatcacgaggtcaggagatcgaaaccatcctggctaacacggtgaaaccccgtctctactaaaaaatacaaaaaattagctgggcgcagaggcacgggcctgtagtcccagctactcaggagncggaggcaggagaatggcgtcaacccgggaggcggaggttgcagtgagccaggattgtgcgactgcactccagcctgggtgacagggtgaaacgccatctc

SEQ ID NO: 655830 - DNA, 1976 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttactt

SEQ ID NO: 655831 - DNA, 2524 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttccgtgagcagcatttccagttcctcctgcacctgccgtgagccgtggccctggtgggcaccgacggcccctccgcccggctgtctgtgttcacagatggtctcgtttcccatggtggtgtcggggaaatgacgaaaaatcaggtttcccggcagcacagagaacccttccacaaaagtagaagggaaagcaaatagttttactaaagaagcagcttcaaaccagaccgtgagccaccgcacccggcctcctgaattaacattttctaaagatgcttctggcgtgctatcctgaaagctgccagaggtgtcttggctgcattggtggtaataaaattcatactcatatttgactttaaaaaaaaaacaaaaaaccccgggcaccaaaatgaggggggggagaacaaagcgggtataaaatgagccgtgggacaaaaagtggtgcagggaccccctttttgaaaccagggcaacacgcggacccccaaaggggccgaaaaccgcacaccgggaccgtgaaagagagcaaaagaaaaagagaccgcaagac

SEQ ID NO: 655832 - DNA, 2298 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttcgtgagccaccgcacccggcctcctgaattaacattttctaaagatgcttctggcgtgctatcctgaaagctgccagaggtgtcttggctgcattggtggtaataaaattcatactcatatttgactttaaaaaaaaaacaaaaaaccccgggcaccaaaatgaggggggggagaacaaagcgggtataaaatgagccgtgggacaaaaagtggtgcagggaccccctttttgaaaccagggcaacacgcggacccccaaaggggccgaaaaccgcacaccgggaccgtgaaagagagcaaaagaaaaagagaccgcaagac

SEQ ID NO: 655833 - DNA, 735 bp, Homo sapiens
  misc_feature (146)..(146): n is a, c, g, or t
  misc_feature (181)..(181): n is a, c, g, or t
  misc_feature (222)..(222): n is a, c, g, or t
  misc_feature (235)..(235): n is a, c, g, or t
  misc_feature (255)..(255): n is a, c, g, or t
  misc_feature (259)..(259): n is a, c, g, or t
  misc_feature (267)..(267): n is a, c, g, or t
  misc_feature (271)..(271): n is a, c, g, or t
  misc_feature (275)..(275): n is a, c, g, or t
  misc_feature (280)..(281): n is a, c, g, or t
  misc_feature (297)..(297): n is a, c, g, or t
  misc_feature (311)..(311): n is a, c, g, or t
  misc_feature (314)..(314): n is a, c, g, or t
  misc_feature (316)..(316): n is a, c, g, or t
  misc_feature (368)..(368): n is a, c, g, or t
  misc_feature (383)..(383): n is a, c, g, or t
  misc_feature (448)..(448): n is a, c, g, or t
  misc_feature (467)..(467): n is a, c, g, or t
  misc_feature (630)..(630): n is a, c, g, or t
  misc_feature (634)..(634): n is a, c, g, or t
  misc_feature (653)..(653): n is a, c, g, or t
ttaccagcgtatcataggacactttagaatggtttcccctgagtttttgtttgttaaaattctggtgtgtgtgtgtgtaaaatgcccaattaagaacactgggttcactccacgtagagcccttacaccagtgtatgtaggtttcnagagattgtgatgattcttaaattttaactacctncacttaatatgcttgaactgtcgccttaattatgttaagcntctagactaaagnccaaaatataattattgctncttnctaaaaancccnaaangtagnnctctattaacgaaaantgtacactagcccngancngtttaatggaacttactgagctatagcatagctgcttagttgtttttgaganttttttagtcaacancataatggaaacttctttcttctaaaagttgccagtgccacttttaagaagtgaatcactatatngtgatgtaaaagttattancactaaaacaggataaacttttgactccccttttgttcatttgtggattaagtggtataatacttaattttggcatttgactcttaagattatgtaacctagctactttgggatggtcttagaatatttttctgataacttgttccttttcctgactcctccntgcnaaccaaatgatagttgacnctttatcctgatttttttcttctttttggtttatgtctattctaattaaatatgtataaataaagttacattttagtctgtc

SEQ ID NO: 655834 - DNA, 2050 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcaagccaggcctggatagctcaggtctaactaagccaatcgaacaactacaacctccctggttatcgcaatggttaacagctggacacgtgaaccaagccaactcacagtgagcttcagaatatctgcagaaagtaccacaagacaacaagaactcactctctcttaat

SEQ ID NO: 655835 - DNA, 2759 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggtgagcacgcgcccaggggaggggccttccgcggtctccgtgtcaccggtgaggactcgcccgggggagggcagggggtccctgtcgtctcagtggtgccgtacgacagctgcggtgagcacgtgcccaggagagggggttcccatggtcgccgtgtggggtacaccagctgctgtgagagctcacccaggagacgggtttcctgtggtctctgtgtggggtacagcagccaaggtaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttccgtgagcagcatttccagttcctcctgcacctgccgtgagccgtggccctggtgggcaccgacggcccctccgcccggctgtctgtgttcacagatggtctcgtttcccatggtggtgtcggggaaatgacgaaaaatcaggtttcccggcagcacagagaacccttccacaaaagtagaagggaaagcaaatagttttactaaagaagcagcttcaaaccagaccgtgagccaccgcacccggcctcctgaattaacattttctaaagatgcttctggcgtgctatcctgaaagctgccagaggtgtcttggctgcattggtggtaataaaattcatactcatatttgactttaaaaaaaaaacaaaaaaccccgggcaccaaaatgaggggggggagaacaaagcgggtataaaatgagccgtgggacaaaaagtggtgcagggaccccctttttgaaaccagggcaacacgcggacccccaaaggggccgaaaaccgcacaccgggaccgtgaaagagagcaaaagaaaaagagaccgcaagac

SEQ ID NO: 655836 - DNA, 361 bp, Homo sapiens
  misc_feature (84)..(84): n is a, c, g, or t
  misc_feature (93)..(94): n is a, c, g, or t
  misc_feature (97)..(97): n is a, c, g, or t
  misc_feature (146)..(148): n is a, c, g, or t
  misc_feature (160)..(160): n is a, c, g, or t
  misc_feature (178)..(178): n is a, c, g, or t
  misc_feature (180)..(180): n is a, c, g, or t
  misc_feature (300)..(300): n is a, c, g, or t
  misc_feature (338)..(339): n is a, c, g, or t
agacaagtcggcctaacttcctggcttaacattaaaaaatcctagaaaagcgatagatatcaacttttattctttctaaccttnttctatganngangaactgagcaggaattaccagttcttccgttattttatgggtaattaannncccatgctcttnggagaatcttcgaataantncctaacttcaggctttgctaagtgaatagaataaacaacatcactcacttcaaacgccttcgcttagaaatggtctatctgcatgctttctctggctgccaaagggaggattcataacancagtatcaacattctcagagaattgagaaacatctgannctttgacttctacaacatttct

SEQ ID NO: 655837 - DNA, 178 bp, Homo sapiens
caccgccgatggtcagtggctcagtggttaacaaatccaactaggaaccatgaggttgggggttcgatccctggcctcgctcagcgggttaaggatccggcgttgctgtgagctgtggtgtaggttgcagacgtggctcggatcccactttgctgtggctctggtgtaggctggcagc

SEQ ID NO: 655838 - DNA, 1859 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttactt

SEQ ID NO: 655839 - DNA, 2064 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatcagggggggttttgggggaggaaaaaaaaccccggggtttgggtaatttaccccccccctggagaaaaggggggggaaaaaacccccggcctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttactt

SEQ ID NO: 655840 - DNA, 2658 bp, Homo sapiens
  misc_feature (96)..(96): n is a, c, g, or t
ggggagaggcgctggtgagccagccccggccgcacgccaatcacgagcacgtgatgaggagcggcctgtgggcagcccccgccccaacgttcagcntcagacgcgccatgtgggccctgcgggccgccgtacgcccggggctgcggctctcccgcgtgggccgcggccgctcggctccgcgggcagccgcgccgtcctgccccgcgcgcgcgctagccgctgtcggccgcaggagccccgggaatctggaggggccgtggggcggagggcggggcctgcgggcggacggcggccgaagccgcacgggagacgacgaggaggagccggaagatgcggacgagaacgccgaggaggagctgctgcggggagagcctctgctgccggcggggacccagcgcgtgtgtctggttcaccctgacgtcaagtggggcccggggaagtcgcagatgactcgagccgagtggcaggtggcggaggccacagcgctggtgcacacgctggacggctggtccgtggtgcagacaatggtcgtgtccaccaaaacgccggacaggaagctcatctttggcaaagggaactttgagcacctgacaggtgggtccgtccagacctgctccttccccaaacctccttttctgtccgccgctaccgaaaacatccaaccgagacatgctgaagtacgggggtcttgcggggccagaggggaagcggcctctcggattgcccagaaaagatccgagggtctccagacgtcacgtgcgtcttcctgaacgtggagaggatggctgccccgaccaagaaagaactggaagccgcctggggcgtggaggtgtttgaccgcttcacggtcgtcctgcacatcttccgctgtaacgcccgcacgaaggaggcccggcttcaggtggccctggcggagatgccgctgcacaggtcgaacttgaaaagggacgtcgcccacctgtaccgaggagtcggctcgcgctacatcatggggtcaggagaatccttcatgcagctgcagcagcgtctcctgagagagaaggaggccaagatcaggaaggccttggacaggcttcgcaagaagaggcacctgctccgccggcagcggacgaggcgggagttccccgtgatctccgtggtggggtacaccaactgcggaaagaccacgctgatcaaggcactgacgggcgatgccgccatccagccacgggaccagctgtttgccacgctggacgtcacggcccacgcgggcacgctgccctcacgcatgaccgtcctgtacgtggacaccatcggcttcctctcccagctgccgcacggcctcatcgagtccttctccgccaccctggaagacgtggcccactcggatctcatcttgcacgtgagggacgtcagccaccccgaggcggagctccagaaatgcagcgttctgtccacgctgcgtggcctgcagctgcccgccccgctcctggactccatggtggaggttcacaacaaggtggacctcgtgcccgggtacagccccacggaaccgaacgtcgtgcccgtgtctgccctgcggggccacgggctccaggagctgaaagctgagctcgatgcggcggttttgaaggcgacggggagacagatcctcactctccgtgtgaggctcgcaggggcgcagctcagctggctgtataaggaggccacagttcaggaggtggacgtgatccctgaggacggggcggccgacgtgagggtcatcatcagcaactcagcctacggcaaattccggaagctctttccaggatgaacggacgcccacagaggcctgcggggtgggggcatcgctgcctggggagctgaggcgttaccgctgtgttgggggcagcttggtgtcaggtgcagcagggtcctccttgtctggttctgcacccgtctcgctcccagccatttgctgggatgaccgtgcaggccggtgacacggccgcacctgccccaaagcgggccgcccgagcgtccactccaagcctgagcatccacacaattccagtgggccctcggtgcctgctgtgaactgctttccctcggaatgtttccgtaacaggacattaaacctttgattttacttccgtgagcagcatttccagttcctcctgcacctgccgtgagccgtggccctggtgggcaccgacggcccctccgcccggctgtctgtgttcacagatggtctcgtttcccatggtggtgtcggggaaatgacgaaaaatcaggtttcccggcagcacagagaacccttccacaaaagtagaagggaaagcaaatagttttactaaagaagcagcttcaaaccagaccgtgagccaccgcacccggcctcctgaattaacattttctaaagatgcttctggcgtgctatcctgaaagctgccagaggtgtcttggctgcattggtggtaataaaattcatactcatatttgactttaaaaaaaaaacaaaaaaccccgggcaccaaaatgaggggggggagaacaaagcgggtataaaatgagccgtgggacaaaaagtggtgcagggaccccctttttgaaaccagggcaacacgcggacccccaaaggggccgaaaaccgcacaccgggaccgtgaaagagagcaaaagaaaaagagaccgcaagac

SEQ ID NO: 655841 - DNA, 160 bp, Homo sapiens
  misc_feature (57)..(57): n is a, c, g, or t
  misc_feature (130)..(130): n is a, c, g, or t
gagaagatccgagccgccggagcacgccagtccagataaatgttgaggcctcaggcntgcgtgctccgccggctcgggatcttctgcacccgcaaggggaggcctaggagacagctcaaggcctgaggcntcaacatttatctggactggaaatgattcg

SEQ ID NO: 655842 - DNA, 837 bp, Homo sapiens
aaatcccgcggtggttgtccaacagggtaacaatgtcccgatattggcggcgcaacagcacacgaagtgtcccaacacggtgtactctcgcggcgggcaaattccctcccccgtgaaatggtacggctcccccttggtcgacaaaagcggttgtggtgccccaggtctgtttaccccggcgcgccgaggaactgtgtgtcttcctgcgaaataacaggggcgagacatattattttctgtatgacaaataatgggcggtggctatcacacgatcttttctctgggaccacgaccattttacaaagacaagatccttttcgaccaccgatcatttgataaaaggcactatatgttataggacccttccttcaggctggcaccacccccacccaatataatatcaagaagagggtgaccaccacttatatcgccgctttcacaagcctccaccattcgcttttcggggcaattctatcccctcctatccctcacccagttcgttgcagtaaataatatcacccttccaaatattctgtgtgccccaccaggagtataaagtttcgagagtctcccgcctcccagcaccttgttggatacaatttatacgtcctctgctactcatcgcctgggccgtttcttatgtcggggcgccacaattgtagatttctcataggcccgctattctttaggcacgcccagtaattactactggagactgttctacctacggtgatttatgaggtatctcaggtgaacagccggagaagtggttgcgccgccctgggagctaacttgtggcggttcaaaaaaaaaggtacatcttcccgcaacataaca

SEQ ID NO: 655843 - DNA, 914 bp, Homo sapiens
  misc_feature (128)..(128): n is a, c, g, or t
  misc_feature (198)..(198): n is a, c, g, or t
  misc_feature (260)..(260): n is a, c, g, or t
  misc_feature (295)..(295): n is a, c, g, or t
gtgcaggccacactcagagcagacccacctttgtatcagcgcactctgcgattcatctgtgaattcatctgtgacagccgcttccccaactgcacagggcaggtgttgtggggaaagggcaaccaggntgttactttgcagtccccgctggaagcatgtttcctccagggtgaaggcagatggctgcccaggggcacntcacccaggacatctgttctcacaatgcttctctctcaattactctcaagtctaacttgccnaaaacctctgcctgctgggtggaagcatgaggctngctgagggtctcgaggctgctctgaagacagcaggccctacaaactcatgggtgttcaccccacagttgtctctccactgccactcatgtcaacaaaaccaaactttggattccatttggagtatccttctgccttctcttgttcctgactttgctgtcttgtaaaaagttgttagaaacaaccaccttctaataggcctcactggttctaggtgttgacactgtggctattgttgcctgggatggttgaaatggagtcatttcccagagcagggcaaggccactgaagcactcagtaagcagttgcttccaccttgaagcagaggcgcttggtaaggcagagcacctgaatgctctgtattgcagggaggatttgcaagtggagtgtgcattttttgttctttcctgtagtggcagttaacttaatggtctctaaaacgttctgtgcaatcttaagatgttaatatttctgccaaaaaaagtattctttggtcaaatacatttgggaaagccagcacatcctaggcccctcctaaagatttgctgggcacaaagtattctgaaggctctacaaagtcctgtggaaaataaaccctttaagctttgtcaaaaaaaaaaa

SEQ ID NO: 655844 - DNA, 183 bp, Homo sapiens
ttttctccatgttggtcaggctggtctcgaactcctgatctcaggtaattcgcccgccttggccttcaagtgcttgggattacaggcgtgacacccacttccagccagcagtatttcttttaagtgagcatgaagtgcgccaatatatgggtctgtatatctatgtatataggtcatatgtgg

SEQ ID NO: 655845 - DNA, 185 bp, Homo sapiens
acaaaagaggagaaaaggggcaaacattgcaggaactagtttcaatcttgaaggggctcatggcaaaactctgaaagtgactggttcaccttgaactgtcaagattcaattttctcacatctgtgtcatggggaacgtgagagttggtaaagttcattatagagcataaaggaacagagttctga

SEQ ID NO: 655846 - DNA, 183 bp, Homo sapiens
  misc_feature (22)..(22): n is a, c, g, or t
  misc_feature (183)..(183): n is a, c, g, or t
caaaaatgtggcactcaagtcngtttatttaagcgcagactgccgcgaacagagtggtgatggcgcctaagcatagtgttagagttgggattagtgggctattttctgctagggggtggaagcagactgagtaagaagattccgtgcatacaactattagcgcttgacgtccactattttggn

SEQ ID NO: 655847 - DNA, 425 bp, Homo sapiens
agttagcaggtggtattcaaatgaatgaagtatgaaaaacacctcaggctgtgcgtggtggcttacacctgtaatccttgcactttgggaggccgaggtgggcggatcacgaggtcaggaattcgagatcagcctggcgaacattgtgaaaccccgtctctgctcaagataccaaaaaaaaattagctgggtgtggtggcatgcacctataatcccagtactttgggaggccgaggcgggtggatcacgaggtcaggagtttgagaccagcctggccaacacggtgaaaccccatctctattgaaaatgcaaaaattagctgggcatgatggcatgtgcatgtaatcctaggtactcaggaggctgaggcaggagaatcgcttggacccggtgggtggaggttacagtgagccgagatcgcgcca

SEQ ID NO: 655848 - DNA, 398 bp, Homo sapiens
ggcttgcctaccccgttttttgtgtcaaaacagtcccgcaaaaattaacagtggcagccctgtgatgagaaaaacgaaaaaaccacttatttccactttttgacttttgttgtggccccagcccttttgtttgtgcttaacctttaaaacagtgaggcagggtaaactgtgaaatgggatttttcctttgggaagggccaattttagttccttcatgaaacccatttttaagatctttaaaataaaatttagtcgcccctaaaaattgtttattgttttccactaaagacccaaaatcccaaaaaataaagcgttgcccccgtgggagggggttgtagttgcctaaattggaccctttacaaatgtttccttttttttaaactccctagtccctggga

SEQ ID NO: 655849 - DNA, 482 bp, Homo sapiens
ataacctacgaatccaatccaaggcttcccaaatcagcccgcacatcctgggggggggagttaggcttagtagcttgaatttacgttagtcttttttcccccttgggcgtggtatgctgtatgttggcgtctgggaagggcctactcgtctccctaggacgagctactagaaggttgcgtttactcggaggttttttccatcgggttataggcttttggttcttacgttatggttaactatatccgtggagggtcgtttgttcttcgaacttgagcgttcgtaagtgtacttttctttcgttgaaggcgttttactaatagtagaaggacgtttgactaggtggatttgggaccctttgtgcgagaggttctgcggatttacgggtgttttggcggtgttgggtatacggtgaggcttttgtggggtggttgaggcgagagttttgcgattggaatttcgggttataacgaataatgctatt

SEQ ID NO: 655850 - DNA, 847 bp, Homo sapiens
cctctccataaagcatgcaacatgctcctgagccagccagtgacatatcaggcatttcgggaatgtacacgtggagaccacagtatcatgccagcggcgtggaattaagattttggtgcctctgggtttcgctacgactaaagtgctcttgggaagttgacaagacggtggatcatggaaccgtgttgagcgcactgcttgcgaggtttggctgtgacattaccatggcaggactagttcggctagagttacagtccagcttcacgtcaacggtggactggagctatgaagcctgttagtactacttaacgaacatactttctcgttgcaacacagaacacacttatgcgttgtctgtctgtccctccttctctcaaggaatgcactgcgcgtttctctcgtctgtcgtttcaactccggcgtccggcaagatgcagggcagctcgatacagttcgcctcgtgacgaacgtcactcatactcgagacacacgtggcgtttccagtgctacattcacacgaactcctcgtcggcagcttctaaaggctagcgatcgcctggactcctccagggggctctccgttgggccacattaggagcttctaggagcgaaggagctaccctattgggggccgtcagagtagaaccctaaactaaacgcggattggccccttcataacccctaaggcaattggagtggacccttggtttggcctttgccggattaatctaccccggccgggactatccggttcattacacacccgggacgtgcagttcgactcatacaatacatgaaatctcctaactttgcacgttttggaattctcctcacccggctaatcggg

SEQ ID NO: 655851 - DNA, 444 bp, Homo sapiens
gactatgtctactctacaatctctctgtctctgttgcctccctgatcagataggagatgatcttccttgcctgaattctcaggctgtagcggtgtagccaccatgaatgaaaaaaggctttagaaagaaacgcagggttctgcggacatatcagacaggacatgactattgcagcacattatcaaacccaattcttcacccctccctgcacccacactgcatgatgtgtgataatgcagttcctcccactaaaggggcaagtactacctacatccctgctcctggctctgggctcggccaataggatgaggctgtgtgagggcgtcccatgttccagcctaagccttacgaggccttgctcacttctacttgctcttctgccttcatgagaacattccaggctagccaggcggatcgcaagcgccctggacagccacaggggcc

SEQ ID NO: 655852 - DNA, 428 bp, Homo sapiens
agcgggcggcggcatttctcctcgcagctcgctgcctcctactatccctgcctccctctaccccctctgttatctcccttccttccctctccgaccctcttcctactccctcccgaaacatatatcccatccatcctctcaatctagtcccctatgtcatctccggattccagcacaatcagccccattatcgaagatgacaataataaaacaaaagtatcatcgcgaacgagggagcacgcgcgacgtgagcacggttcgcagcgtggggcccaaggtccatgctgacgtaccgcgcgaccacagagaggcgtggagaccccatgcaggggaacggacggaagggaaagcgcagagctcgagtagaacgagcagccgaaagagaccaagcgcaactaacagaggcggcggtagaaggaaagacagca

SEQ ID NO: 655853 - DNA, 303 bp, Homo sapiens
  misc_feature (294)..(294): n is a, c, g, or t
gacagtcagacctggtctgactggaaatatctttctttgttatttttggcaggatgcttaaccactgcaaacatctatattcaattctgtttaacagagatatgaagtgatgacgcctacacatctcaaacttaacatgttcaaaacagaagtcctgctcttcctccacaaatctgttcttcctgtaggcttccccattttaatcggtggcaactccatcctttcacttgtccagtccataaaacgggagtcattgtgacccctttctgactcttgcaccccatagtcagccgngtaccgagc

SEQ ID NO: 655854 - DNA, 116 bp, Homo sapiens
gacaggctctacctggcccaggctaatctcaaactcctcacttcaaatggccttccacctcaccctcccaaagtgctgggattacaggtgtgagccaccatggcgctacgtaggag

SEQ ID NO: 655855 - DNA, 338 bp, Homo sapiens
tttatattaagggagacgcgcacaaaacctgatgccaaaccgttttgtcatcctcacagcaaggaccggacggatgggacccacccaggagcactgctctccttttagtaatgtattcatatattttaaattccccgcgacgacttttgcatatttatgaagaaaccttgagaccgaagctacagcattcatcttaaccgtgtgggtggttttggggtttcgattggtgttgggttcggtgacgtcgtttgcagctgtttcctggccctggcgagtgtctgttttggtgcccagtgcttctaacaaatttgtttttaataaaacctgtggaagtgtga

SEQ ID NO: 655856 - DNA, 759 bp, Homo sapiens
tccgtgaggagctcctttgggcagggtgtagtgtttggtgtccctgtcttgcgtgatattgacaaactgaagcttatcctgcaccactggacttaaggaagagtgtactcgttaggcggacagctttagatggacggaccgggcagtctcatcccccgataaggagcagagtcctttgtactgaccaagatgagcaaaatcatacatccaggagcctcccacgaatggagaaggtatttatagaaaactacaagctggagatattgacctagagttgtggtccaaagaagctccataaagacttgcagaaataaatccaacttagtatggaaagcttattatgacaataccattatttcatagagtagtgcctggtttcatagtccaaggcggagatactactggcacagtgagattggtggagaagtctatctatggagacgccatatcacaagatgcactaacataacaaagagatgcgattcaaaatccgagagcacggactggtttgcccattgggcaaaatgcatggatcctaccatgaataaatgggacaatcagataaatcttatcaacagcgtggggtacgagcaagaatgaaaattaaccacaaatcagcattaccaaacattaggaacagggttaaagggagaatacgaagatataatacacagtgtttgcgagcattgtacgacagtaaacaatattgaagatagaaggacaggaccaaataaacaacagaaaataacaaggtggaag

SEQ ID NO: 655857 - DNA, 205 bp, Homo sapiens
  misc_feature (19)..(19): n is a, c, g, or t
gggtccgctcggacgacanagaaaatctgccacacaccttctacaatgagctgcgtgtggctcccgaggagcacccgtggctgctgacgaggccccctgaaacccaagggccacgggagaagatgaccagattatgtttgagaacttcacaacccagacattgtacgttgctatccaggctgtgctaatccttgtacgccttggt

SEQ ID NO: 655858 - DNA, 943 bp, Homo sapiens
aatcccagcactttgggagaccaaggtgggcggatcacttgaggccaggggttccagaccagcctagccaatatggcaaaacccagtctccactaaaaatacaaaaattagttgggcgggttggtgcatgcctgtaatccaagctactcaggaggctgagacatgagaatcatttgcaccctgaaggcagaagttccagtgagccgagatcacaccactgcactccagcctcagcgacagagcgagactatgtctcaaaaaaaaaaaaaaaaaaagtttgggggacacaccggggattttccctcctttcaaggcccccctttgaaatttggtttttccaggggggaaacagtactcttcaacagggggggaacgtggggcacatttggcctaaactccaacgggcatcgacggtggaacatcccctcaatggaagagacccacattgcactttggtttcccatcccggactgaggctggaggtacccccctccggtgaagtaatcccggctcaagattttttactctcacatcggagcgactgagaaccaattcccaacttgggggggacttcctataaaaaaccgcctgctgggtaatttccacaaatccccctagtgaggtgggagggtccaacctggccaccttcaatctttcgaatggggaggcacctgacggctaacacgttctctggtaaccggcccaaattccctggccttatacgacattctgggaagaccaggcaacccggacagtaagggctgagctaaagcaattgctccaggtcaattcctactaaagagggttggtttacgacaggctatataatttggggtacacagcaccaggcccaaaatcgagctccgtggatgaataaatatgccaggcactgacgtctgacgtgttttccttcgttacaccccgtatgtcttcataatctgaa

SEQ ID NO: 655859 - DNA, 266 bp, Homo sapiens
tcagcaccatggaggatgacagtgctttgtactgttaggtgctattctccatatgtgcaatcaaaatccacccaattgggtggcgctcaggctcatgcctgtaatcccagcactttgtgagcccaaggtgggtggatcgcttgagcccaggagtttaagaccagcctgggcaacatggcaaaatcctgtttctacaaaaggtacaaaaattagctgggtgtggtggtgtgtgcctgttgtcccaggtacttgggaggctgaggtgg

SEQ ID NO: 655860 - DNA, 338 bp, Homo sapiens
tacattggggaaaggcttcagcttacatgtcacccaaatataggaaaatgcacactcatgttcactcctatgctacaatacatttatgcgtcttttttctgtatttctagaatggtatttgcattaactgctcatccacgctgttagccactatagtatttatattgaagcttgtactttttaactctcgctctgttctctctaaaagctatcaatctacctctttttggtagtggaaacaaaacaagacaggccgccccagtatatttttctaatttggcaggatcatatagtgcaaattatctgtatgcttccaaaacaacaaacaaagagagaaa

SEQ ID NO: 655861 - DNA, 242 bp, Homo sapiens
attttaaaaaaaatacttttttctatttttaatttgttgtagagatgtggtctggctttgatgaccaggttggtcttgaactcctggcctcaagtgaacctcctgccttggtctcccaaagcactagggctgctagtgtgagccaccacacccagctaacttttacattttaataattacagttgcaaatggaccaaaagaatctgtaaagacaacttatgagcaaatgtattcaagttttt

SEQ ID NO: 655862 - DNA, 716 bp, Homo sapiens
gaggaatggtcggtgtgcgccgtccagcaggtgttcggtggcgctccgggtgggatgtccgaggtcgtggctgcctcgccgtaggtatacccgatgacgtgcacacctcacgagagcgtgcgggaggcattggcagagcactccacatggtccgcctctagcgccccgaggcgtcttgttgggccggacatcttgtttcctgtcggggcgtgcgggcatgctcgagggactagatcagatgttgactggtgcaggggctgctctgcagcacttcgtggccggtgtggctagccagctttgggacagtgcgcaccgtgtacgtggctgcccctgcactctgtcgatggatgctagcttgctgacatgtgagtggacccctggcccgatgcgctgcagcttctcgccctggactggagcaccgccgcgtgctctgccagctgtggcttgctggactgctcatctgctggaatggctgaatgaatggcaaaaggctccagcagtctcctggccccgctcctcctccggcctcaagcggccgccctgctacgccggaaccctgaacaacgtagtctgcgaccttgtgcggcgtctgaggcgccagcggggacgtggcacggggccgccctgccctggttcgggacgtggcgggtggaatcttacaagttcggactggaaggcatcgccgcggttctgctcggctcgcgcttgggctgctg

SEQ ID NO: 655863 - DNA, 386 bp, Homo sapiens
ggtctgggaacgccaaccgctccgctgtgcgcagactgtgctgtagactctctggtgtagcgctgtgtggatctagagatccgcggtttcaacacgtgggagatctgggcctccctctggtggctggtggtgtgggccaaaggccggagcaaggcctcttttcataccgtgtcggatgagctggtcaactatgtgaaccgggataccacgtgggagggcgggcacacactttacaacgcggacatgagctacttgaagagggtatgtggtaccctcctgggtgggcccaaggcaccccagagagtgttgtttaccgaggacctgaagctgtctggaagcttcgatgcacgggaacacagggcacagagtgccaccatttgagatcg

SEQ ID NO: 655864 - DNA, 83 bp, Homo sapiens
ggagggaatgtcagtccacccttattgggcgaataccccgcagtgtaactgttttaaataactcgtgccctgccccacccagt

SEQ ID NO: 655865 - DNA, 800 bp, Homo sapiens
tggagacagagtctcattgttgcccaggttggagtgcaggggtgcaatctcggttcactgcaaggctcggtttcccaggttcacgccattctccgggttcagcctcccaagtagctggggactacaggcaccggccacagtgccgtggctaattattgggtatttacagtagagaaaggtttcaccatgtgagccaggatggtctcaatctctgtgacctgtgtgaaccaccggtcttcggcctcccaaaggtgctggggatacacaggtgtgagccacaagcgcctggccccatgaaaccaagggggtttttaagggaaacaaaactatttttttgaatcatcagatttatactagcctatatggatataagcatatctggtattattgaatctagaattttttacattatttttataatactgtaagctacagtatatggatgacgtgaaagatatcatgtgcttaataggggtcactttgtcaataaaatttaactttaactcttactttataaattggccatagccacactttacttataccattaataagggaagacaggctcattctcgggaaataggcttgcgtgtccttcaaagatattttttgatcatgatgtggtttcgtaacagcctcaatgtttggctggtaaggccttggcccttgtaaaaactggcgtgggtttggcaaactccgtattcggccccatgtaaagttttcaccgggaatagcgttctcccatatggcgcacttttgcacaactgttggtactctgtgttagcacagttcatagactt

SEQ ID NO: 655866 - DNA, 1136 bp, Homo sapiens
attcacgtgatatccgctatactcaggctacacccgtagagcagagcggacgccaaaatccatctcactatcatattcatcggcgtacaatctaactctatcttcccacagcagtttctcggccgatccggaagtgccccgaggttactcggactaccccgagtgcatacaccacactagaagagcatcctatcagtctgtaggctcattcatttgctctaacagcagtcagtattaataatgttcatgatttgcgaagccttcgctgtcgaagcgaacatagtcctaatagtaccgaagaaccctccgataaacgctggagtgactatatggatgccccccactcctatcacacattcgaagaacccagtatacgataagaatctagacagaagaagaggacgcgaagtcgaaccgcgcccaaaggctggtattcaagccaagccccatggacctccatgaacttttcaaacgaaaaaacaacacaacaaagacaagaacagatacaacgaagaaacagaccccaacacgcgggcagccgaccgcccaagcaacacaaccaccaccacgccacgtggcgactccaccaacacggcccacccccgcacgccgcagcgcacgacaccagcgtggagcacgccatgtggcggtgccaaccatgacatgggaccactatacacctcgctatcatcctacatccgtcacaataagggctccagcacacgtccgttccaagacgaccttcaccatacacatcacacccgcctacccactatagccttccgtgacgtcccaccgtctccctgctcgtgatctacacatacgaggtccggaacaacccacgcgtctagcgggtgtacaatcgcgcacacctggctctcctgatatatctctcttctcttagtctatcttctatacattggcatcttgtttcgatgcaataccccactaaacattccgctgctgccgcccacacacacatacatcaaccgactcacggactaactaccacataagaaccaaatcatatgcacaccgaaacgcccatcactccacacccagtcagcgtgactaacgactattatacaccgcggacaacccatactctacattcaccatgctcatagtgactactc

SEQ ID NO: 655867 - DNA, 568 bp, Homo sapiens
tactgaaaataacagaaaaagtaaagggtactacgtaaacatatcactattataaatccctgtccatgaatataagatgtctgttcaacggagctttatatatacttattcacatataccacagattactcagccttagaaaggaaattctgatacatgctacaatatggatatactttaaggacatcatgcttcagatgaaataaactagtcacaaaaagacaaatcctgtatgattccacttaacatgatgttcctaatcaaatttataaatacataaatggtggttgtgtaatgggtatagagcgtcagttctgcatggtaaagagttctggaggatggtagtacaacaatgtaaatgtactaaatgctactgaactgtacacttaaaatggttaaaggctgggcacagaagctcaagcctgacatcccagcactttgggaggccaaggtaggagaatcacttgaacccaggaggtggaggttgtagtaagctgagatcacgccaatgaagtccagactgggtgatagagtgggactccatctcaaaaaaaaaaacagttcatgg

SEQ ID NO: 655868 - DNA, 286 bp, Homo sapiens
gaggtatagaatagaagtgaagtctaaagatgaacttaatagactatacgtacttttatatccactgggaaaccaagaaattagtgtgacatgctttgtgaagacacttgctctacttgtgttgatttagaaccaagcctgcatatctccaagcatgcatacagctccctctccctgagtgtgggctggacttaatgacctgcttctgatgagcagaatagggcaagaactggagtgtggtcacttctgtaattcaattccccaggggaaccggataccgagcatc

SEQ ID NO: 655869 - DNA, 204 bp, Homo sapiens
  misc_feature (169)..(169): n is a, c, g, or t
gtgtaatgtactaatatgtggttttatacctgccccctcttacctccccactttgagtctctagtgtccattatgtcactctgtatacctttttgtacccataagttagctctcacttataagtgagaacacacagtatttggttttccattcctgcagttgcttcacnttagaataataatcctcgcagctccatccaacaat

SEQ ID NO: 655870 - DNA, 145 bp, Homo sapiens
agaggagtgatacaagaagctcatatagagcgcacccccagagtatgaggacatagtccactccaactacagccagtgccatatcctacgagtgcctgtggtcaccaccatcaaatgaagctgctaagcttcattttgactctaa

SEQ ID NO: 655871 - DNA, 277 bp, Homo sapiens
gatctagaccatccttatcacgtgcatgtgtcttcacgaagttctcaaacagtgagtacttcaagattacctctagggagaacaagagctgattcggaactaaaggagaattattcggttcttcaaatttctggggctcctgaaaaacaaattgtcttccctggtccaatcggacagtgtatcgacgggtgagtgcacagggtggcggcaggttgcggaacaagccgaaaaacattgagggagctgggagacccttcccaaaatgggacgtggatcg

SEQ ID NO: 655872 - DNA, 339 bp, Homo sapiens
ctcaacctgtgttcattggacctactgggcctaagggacttgctaaactctctctgcagcaggtagccatcgctcagactagtccctgtactgacactgttatggataccgtgaataccaccttgcagtaccttagccctgctacactgaagcatcacttcctgcctggactcgtgtcatcaggcagactctgactcacgagcgatcctatttcagccctgtaccctttacctcgacgagctactatagttcccacattatcgcctatcatacttcttccacttgtgtcctttgatctgatgactaccatcactgttatctagcacttgtgctcccgct

SEQ ID NO: 655873 - DNA, 522 bp, Homo sapiens
ctgtcggctgaccaccgcgttctgggtcgtagctgatgcggaggatcaagcggagcagagtttacaggcttggctgggagatactgtaactgcgagacttcatgagcacacgagtattcactgtaatctcgttaataaatgtttacatacaaggagggggctattaagcaccacagtacagacatatccacaaggtcgtcaatgcatgcaagaaaaatagggctggatcttatcacggccctgtctccccttgttactctgtgccagatcttcagtgcccctttccatagagggatttttttctcatagagtaattatatgaacagttataatgacctccttagggtctgaaatactttggaacagaatttctttattttaaaaaaaaacagagatggggtcttactatgttgcccaggctggtgtcgaactcctgggctcaagcgatccttctgccttggcatcccgaagtgctgggattgcaggcataagctaccatgctgggcctgaacatatttacaa

SEQ ID NO: 655874 - DNA, 278 bp, Homo sapiens
cccgcatcggcgtaagatggggctggacgccaccaacaaatggcccggcgagaccagccgtgaatggggccgcaccatcaccatgactgagcaggtcaacgcccgcgtggacgacatcgtgtcccggattcttcaaaagccgtgacaagcacccagctatccgacaaacgggcttgcgttgcctgaacgcttgatctaatctttaattgcctgctgcgagcaggcacttcaataagacgcagtcactgcgtcttgggatgcggttacgccgatgcggg

SEQ ID NO: 655875 - DNA, 289 bp, Homo sapiens
  misc_feature (2)..(2): n is a, c, g, or t
ancacgaccgatgtcgaatggtcgtgcagctgcgacatcgaacgcgccactgcggaaggcctggaagtattcgaaggctcgaccatgcagtttgtgcgcgacgacgaggatggcgccattgccgccgcctgcgaagaagccgtgcgccagatcgacaacatcatcgccaacccgctggtgcggctggcttagctcctgcatttccagcaaacctgcagccggcgcccgccggctgtttttttatgcgcgcgcccgccgtcccgcccggtggcagtctgctctgtttcat

SEQ ID NO: 655876 - DNA, 248 bp, Homo sapiens
tgaggtcatagtgcccgcaggttgtttgtgattagctgtttctaacaattggttcatacaactagattgttcattattggttctcaacttgcgtgagctctccccaacctggggaccctttccttattgtcgcttacttatcaggtctccacataaaggtgtggaaactacattcattcatatcttcaacacaaattgtaggtggcctgtttgctaaaacatttattcaacaaatatccagtccaagc

SEQ ID NO: 655877 - DNA, 449 bp, Homo sapiens
ttctagcagtatccccggatcggcgaccatttcaaccacttcagccccctattgagggcgacgtgaggcgagtaagtcagtcgctgctgcacgagacggggcttgtgccggtggtacccggaatttgctggacatggggacaagatgcatgaatgtgaatatccatttaactactggccgtagtctgaaaagtcccacggtgtctaccatgattcattatttgggcccagaggattccctgaggcctagtatttggctcggttggctcagtaacggacactatgatgctgtatttgatcactcctaacctaacccagagtacgacaactggtgcaaacaaactcaagtgcaaaggaaacgcgacgaagaacttgccaaatctatggccatatccttgtctaaaatgtatattgaacaaaatgcatgctcttgaaatggtcgccaatccg

SEQ ID NO: 655878 - DNA, 870 bp, Homo sapiens
gacagtggctcatgcctgtgatcccagaactttgggaggctgaggcaggtgttcaagagttcaagaccagagttcaaggcaggtgtcaggagttcaagaccagcctggccaacatggtgataccctgtctctactaaaaatacaaaaattagccaggcatggtggcaggtgccttaatcccagctactcaggagactgaaggaggagaaccgcttgaactgggaggcagaggttgcagtgagctgagaccacaccaagttgcactttcaagccctgtggttgaacaggaggcgaagactcaagtcatcaaaacaaaataaataaaaaaaaaacagggttgttaccggcccaatttcttaaagtgcccatcaaagacttctaaagcggcctacgttcaacacaaccacgtctctccgcggggcggcaccaaaaataggcccctcgggcacatttcggacacaccttctatctttcccacatcacaacatcccctaagggtccacaacacgcaacacccccgcgcactcagtccacggtcccatcccaccacttcgtgcacgcgccaacaacattcccgctcaatttggcgaacatcattgcactttgcgaaaccacttaaacgccttcggtccgcagaattgcgcttacagacgttaacccccaccgtactcgaccctctttattaagctgggcaacgggcgctccattaagccattgagccgaaacgtgctcatcacacggacattagccaaccgaactcaacacgcagattgcgtcaagagtataaacccggtgtcaactattcaacacgtccaacgcggactagcgcgcgaaaacccacacaaattagtgaagtccaacgtagaaaac

SEQ ID NO: 655879 - DNA, 86 bp, Homo sapiens
ggcacattgtgcggctgtgaagtggggggaggaacacatccctggcagcccttttcatgtcacagtgccttaaaacagttttctct

SEQ ID NO: 655880 - DNA, 243 bp, Homo sapiens
cagggctctgatgtaagacgagctcggactgcagtggaggctgttcctgaccactagggtcgtccagtcctttctccgctgatattggtagtaagagagtagagcttacctctctctgtggctgcataatataatagcagaatgaacccttatgaaggttcatcccttcatgcattcactcaacaaataccttgaggccaggcacctgggatataaagaacacacacaccaccaccacctcct

SEQ ID NO: 655881 - DNA, 497 bp, Homo sapiens
tgctgaagaatgtagggaagaaaaagcaatcagagcacaacattttattttattcattattatttagttagtttgttttaagacaggttcttgctttgttgcccaggctggagtgaagtggcatgagcatagcttactgcagcctgaactcctgggctcaagtaatccccctgcctcagcctcctgagttagctaggaccactggtgcaagccacaagacccagctaatttttgcttctcagcacagatgaggtcttactatgttgcccaggttggtctcgaagtcctggcctcatgaatgttttcaatgtcatctggaatggtgaatcctttccagaaggttttcagtttactttgcccatcacaggaatcaatggcagggatagccttacaaactgtatttcttaaataagagaacttgaaagtcaaactactacttgatccagtctgcagaacgatacgtgttagcgggcatgaaaacaacattcttcagcacg

SEQ ID NO: 655882 - DNA, 516 bp, Homo sapiens
  misc_feature (32)..(32): n is a, c, g, or t
  misc_feature (61)..(61): n is a, c, g, or t
  misc_feature (118)..(118): n is a, c, g, or t
  misc_feature (123)..(123): n is a, c, g, or t
  misc_feature (232)..(233): n is a, c, g, or t
  misc_feature (235)..(237): n is a, c, g, or t
  misc_feature (243)..(243): n is a, c, g, or t
  misc_feature (248)..(248): n is a, c, g, or t
  misc_feature (286)..(290): n is a, c, g, or t
  misc_feature (297)..(297): n is a, c, g, or t
  misc_feature (300)..(300): n is a, c, g, or t
  misc_feature (307)..(308): n is a, c, g, or t
  misc_feature (311)..(312): n is a, c, g, or t
  misc_feature (320)..(320): n is a, c, g, or t
  misc_feature (323)..(323): n is a, c, g, or t
  misc_feature (331)..(331): n is a, c, g, or t
  misc_feature (335)..(335): n is a, c, g, or t
  misc_feature (359)..(359): n is a, c, g, or t
  misc_feature (366)..(366): n is a, c, g, or t
  misc_feature (373)..(373): n is a, c, g, or t
  misc_feature (405)..(405): n is a, c, g, or t
  misc_feature (451)..(451): n is a, c, g, or t
  misc_feature (485)..(485): n is a, c, g, or t
ccccccatcgtcagccccgaatggggatggtngttttctctttctgagtgtgaacctggcncggcctgaagcctagagcgggcttgaagaacacacacagaccagaagacagcacggngagtnacaagtgccacggagaccagggtttctgacacaggatgtggaggatgcttctctgcaacctagtgcaaggtttcccctgccattccgagaattcacggatctcacaggnngnnntggggnggggngggggcgagggggggggggggggggggggggggggggnnnnncggcacnggnagggggnnggnncccccccncanggcctgangccncggcatcgggtctcagtcagtccntggcgangcccccncagacgcactcacagacttgcatacgtaattnagtaacatgcatcaactatcccagaacatctacagggcgcaaaggnaccaccactcagagaatcatggagccagtggagncagaagtggaagggacagaacaagacaatgc

SEQ ID NO: 655883 - DNA, 146 bp, Homo sapiens
gatatactcccgtcctgtgtcataccacccttcccccccatttcggtccacggctgaaacttttgcttggtagggtgtcaagctgccgatactgcgccctaacggctacttaaacgggggaaataatagcatcaaccaagaatcag

SEQ ID NO: 655884 - DNA, 123 bp, Homo sapiens
  misc_feature (102)..(102): n is a, c, g, or t
aactataggactcccagaggcacaaggaggcagagagttgggtaaggagcagagttgggccttctctgggcaggaggaagtcacccataccctgtcccatgncggtgggagaggggcagatga

SEQ ID NO: 655885 - DNA, 1020 bp, Homo sapiens
  misc_feature (445)..(445): n is a, c, g, or t
  misc_feature (1009)..(1009): n is a, c, g, or t
ggctggagtagactgcctgcagagtgaaagtagtcttcaccgcgagcgactgatgcaggagtgtctccacaagcattagtctctcctgtgggtccattggcgatagtccgagaggaaaaattcattgagaatgatggttgagtaagaacagagcagcacggcccgctagctacgtcatgattaccttgttacctggtgctgttctggcgacctccttgggacgtcgtcgcgctgggtgatcacccacatgtcgtgggaccaagtacgcgtggcatgagtgaaaggtgtgttgcgtcgttaggcgtgattcagtgcatccagtcagggtccacctaggggccaacattgatcttccatggggcactcctcgctacagtagatgagagacgccgtaggtctagctgtcctatgtcgccagctctatcataccttgtgtgctcggtgncgcagctcagcttcgcactccattgtgtcctagtcacgatcccgagagcgatcgctcgcggctaacgaggaacgcctgtctcagagtgtgtcgactacagtgaatgtccaggggcctagtcctacctggggccccaaactccaacgcaaaatgcgcaagcaccgaaataactctcagagaacttcggtcagatgacggcaggggttgcgtgactcatgttcagcaccagcagaacatagcgtagtcgtcgtatatcggggtgcatactagtcgaagcacgacttggcgcccatgagatagcctaggcactgggatctctgggagtcgcaatgcgtcgctctgccatcttgttggatcagacaacgacccggcagaatctgagctcccaaaccagctcgagttgaagccttgcatcaatcactcacctcaagatcatcgtgacaatcccccattcgatgaaagcggttcttacttggcaggagagccaccaagggacacttgagtgtcaattcgagagttacaagattggtagtcgcacatagggcgagatacaattccgaacancttcacgctgg

SEQ ID NO: 655886 - DNA, 565 bp, Homo sapiens
tgaatcgaactcgtggtgacctattggagtgctggttgatctatgaccttaccccaaccctgtgctctctgaaacatgtgctgtgtccactcagggttaaatggattaagggcagtgcaagatgtgctttgttaaacagatgcttgaaggcagcatgctccttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatcaccctctgtgagaaacacccaagaatgatcaattaaaaaaaaaaatttaaaaataataataggccaggtgcagtggctcacacctgtaatcccagcactttgggaggttgaagtgagtggatcccctgagcccagagaggtcaaggttgtggtgagctgtgatcgcaccactgcacttcagcatgggagacagagtgagaccctgtttcagaaaaaataaataaataaaaccaacaagcactccaacagg

SEQ ID NO: 655887 - DNA, 128 bp, Homo sapiens
acaggatccttgaatcgtggtgctgcttcagcctctttccagtggacacaaactgtgccagccgctgcgtggatctcctctttcccgttggtgttgtcatcggacagcttcttgccagtgtccaggac

SEQ ID NO: 655888 - DNA, 867 bp, Homo sapiens
  misc_feature (2)..(2): n is a, c, g, or t
  misc_feature (69)..(69): n is a, c, g, or t
  misc_feature (82)..(82): n is a, c, g, or t
  misc_feature (85)..(85): n is a, c, g, or t
  misc_feature (89)..(89): n is a, c, g, or t
  misc_feature (93)..(93): n is a, c, g, or t
  misc_feature (95)..(95): n is a, c, g, or t
  misc_feature (129)..(129): n is a, c, g, or t
  misc_feature (152)..(152): n is a, c, g, or t
  misc_feature (170)..(170): n is a, c, g, or t
  misc_feature (174)..(174): n is a, c, g, or t
  misc_feature (220)..(220): n is a, c, g, or t
  misc_feature (229)..(229): n is a, c, g, or t
  misc_feature (232)..(232): n is a, c, g, or t
  misc_feature (236)..(236): n is a, c, g, or t
  misc_feature (248)..(248): n is a, c, g, or t
  misc_feature (250)..(250): n is a, c, g, or t
  misc_feature (264)..(266): n is a, c, g, or t
  misc_feature (271)..(271): n is a, c, g, or t
  misc_feature (279)..(279): n is a, c, g, or t
  misc_feature (281)..(281): n is a, c, g, or t
  misc_feature (291)..(292): n is a, c, g, or t
  misc_feature (294)..(295): n is a, c, g, or t
  misc_feature (326)..(326): n is a, c, g, or t
  misc_feature (346)..(346): n is a, c, g, or t
  misc_feature (362)..(362): n is a, c, g, or t
  misc_feature (386)..(394): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (420)..(420): n is a, c, g, or t
  misc_feature (441)..(441): n is a, c, g, or t
  misc_feature (448)..(449): n is a, c, g, or t
  misc_feature (452)..(452): n is a, c, g, or t
  misc_feature (459)..(459): n is a, c, g, or t
  misc_feature (467)..(467): n is a, c, g, or t
  misc_feature (491)..(491): n is a, c, g, or t
  misc_feature (599)..(599): n is a, c, g, or t
  misc_feature (653)..(653): n is a, c, g, or t
  misc_feature (827)..(827): n is a, c, g, or t
tntccaaacttaaagaactttgtatgaaatatagctacaaatatacataaagaattcagatcacaaaantctctaggaaatnggntggngggngngggccaagcttgtaatcccagcattttgggaggntgaggcaggcggatcacaaggtnaggagatcaagaccatcntggntaacagggtcaaaccccgtctctactaaaaatacaaaaaattagcnggatgtggnggngggngcctgtagtccntnttatttgggttttnnnttttngttttttntntttttttttnntnntagattttggagtgagccgagaccgcgccantgcactccagcctgggcaanagagcaagattctgtntcaaaaaaaaaaaaaacctctcannnnnnnnncgtagtcatcananaanaatggaacnaaagttaaaaaaaaaaaaaancaatctnnaanccccccnaactgtantttaaagtacagatcatttgtacnaactttctatagcaagttgtaataggcaactgtaagcaaacagtatcaatctgtataacttgtaaaaattcatctgaagttgtttggagctgtacgacaatggatgtnattcttccagttctcccagcagctctacaaaatcagtgatataccatttggcgntatccttgacttgttgcctgatcacatttcctccaaatccaatgaaagcatcagcaggaggacaggcttccatatctgtggcaccatctccaatcatgattattttcttaaaatgaaattcttcctttaaaagtttaatcacttttccttttccaccagattcagctgttggcngcgtctcatcaagacgtgcatattcacggttaaagtagaa

SEQ ID NO: 655889 - DNA, 354 bp, Homo sapiens
gtcataaaaacatgtccatatccattattagaacagaagtctgtgacaggatgagctgaggtgccaggtgagccagctgtcatcagggaaaaaagaacgcacatctaggaagcgctggtacagacagccgtagaacccgaagggcaagtaccatggacgtggagagggtcacagatagaagagcacaaacagtgagttcagttttaaacggcccactccctgtgatttttccaaagctgccccaccaaggaccagaatgcagctttcttagcttggggacgtttaccttcctgtgatggtgttaagatagatgggttggaggaaccaaagttttatggccttgaagtgaataga

SEQ ID NO: 655890 - DNA, 176 bp, Homo sapiens
ctgttcatcgttcaggttgtgcatctggacccggcgcacatcgacatgtctggctttgcagacggcgtgggtcagctgtgccggactgctaggtgtggttggttgatgccgattgtactatatgagtcctagttgacttgaagtggagaaggctacgcattttttatgcatgtcat

SEQ ID NO: 655891 - DNA, 209 bp, Homo sapiens
ttggtcgtctgctacaggatccccttcctgttgtcgctatcaggaactgtctataggacagaagtttgtcattgcaagaggagttctcgcgtgatgtgaaggctctggagaggttcctgcaggattactttgatggccatctgaagagatacctgaagtctgatcctatcccagagagcaatgatgggcctgtgaaggtcgtggtagca

SEQ ID NO: 655892 - DNA, 473 bp, Homo sapiens
tgcatctgatatgctatattcatgagtcaagttctcaaatattaatacttattagcttattaaatagttttcaccaagggggtgctctacttctcatcgtcccaagtgctaattaatgttatagccaaggatagaaattcgtattcccattgtctgacttcttcctgaaaagctgaattcttgtccaaagtccagagtctcaacctgagacaaggcaagtctctcccgggctgtgagcttacaaaataaaaaaacagttagttacttccaacatacagtgggggtacaggaatcgggtaaacactcccattccaaaagtgagaaattggccaaaagaaaggggctactggacccatgcaagtctgaaacccagcaggtagtcattaaatcttaaagctccaaaatactctcctttgactccatatctcacatccagggcacactggtgcaaggggtgggctcccaaggccttg

SEQ ID NO: 655893 - DNA, 320 bp, Homo sapiens
ttcctttctggaatgccttgaacttttattgtggcttccttaggcaaatagtctggcaatttaaaggaagaggctgtgttcacagttcatccaggcttggaaattgagctatttccatttttccgaggattattttgaggaggaagagtaccacattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcacca

SEQ ID NO: 655894 - DNA, 311 bp, Homo sapiens; identical to SEQ ID NO: 558540

SEQ ID NO: 655895 - DNA, 356 bp, Homo sapiens
ttataatatactaaaaaagtaatgcacttgattctgatgcacactcccccgtaggtaacaactttatctagtgtaaaaatgaaagaacattctgggccgggcacggtggctcatgcctgtaatcccagcactttgggaggcccaggcgggcggatcacaaggtcaggaaatcgagaccatcctggctaacatggtgaaaccccgtctctactaaaaatacaaaaaaaaaattagctgggcgtggtggccggcgcctgtagtcgcagctactcgggaggctgaggcaggagaatggcgtgaacccgggaggcggagctttcagtgagcggagatagcgccattgcactccagcctgg

SEQ ID NO: 655896 - DNA, 557 bp, Homo sapiens
  misc_feature (398)..(398): n is a, c, g, or t
  misc_feature (451)..(451): n is a, c, g, or t
  misc_feature (468)..(468): n is a, c, g, or t
  misc_feature (474)..(474): n is a, c, g, or t
  misc_feature (479)..(479): n is a, c, g, or t
  misc_feature (486)..(486): n is a, c, g, or t
  misc_feature (501)..(501): n is a, c, g, or t
  misc_feature (509)..(510): n is a, c, g, or t
cgactagtcccaaccatactaaccttctaagaaggttagtatggggagaggatggaaaatggaagagatagccggtaattggactgagcatggtggctcacgcctgtaatcccaacactttgggaggcggaggtaggaggatcacctggggtcgggagtttgagagcagcctgggcaacgaagtgagaccccatctctacaaaatatttgaaaaggctgggtgtgatggctcacacctgtaatcccagcactttgggaggctgagacgggtggatcacttgagtccaggagtttaagaccagcctgggcaacatggtgaaaccccgtctctaccagtaaaaaagaaaaaaaaaaattagccaggcatgggacatgtgtcttgtagtttcagctactcnggaggcttgaaatgggaggattttttgagcttgggaggcattgggtttgcagngagctaaaacattgccnttgcantcaancttgggngaaaaaaaggggaancctttttnnaaaaaaaactccaaaaatttttttgggctttgggggcccattgcccg

SEQ ID NO: 655897 - DNA, 264 bp, Homo sapiens
ggttaggctgcagtgcatagaactaagaattgacggtgcaaactactcctagatatcagaggatctatagaaatgcctggatgtccaggcaagagtttgctacaggggtggggctctcatggagaatctctgctaggcagtgtggagtggaaatgtgggatcagagccccccacacagagtccctactggggcactgtctagtggaactgtgagaagagggccaccgtcttccagactccagaatggtggatccaccaacagcg

SEQ ID NO: 655898 - DNA, 338 bp, Homo sapiens
  misc_feature (20)..(20): n is a, c, g, or t
  misc_feature (154)..(154): n is a, c, g, or t
  misc_feature (210)..(210): n is a, c, g, or t
  misc_feature (233)..(233): n is a, c, g, or t
  misc_feature (237)..(237): n is a, c, g, or t
  misc_feature (244)..(244): n is a, c, g, or t
  misc_feature (257)..(257): n is a, c, g, or t
  misc_feature (268)..(268): n is a, c, g, or t
  misc_feature (283)..(283): n is a, c, g, or t
gccatgatggaggcggccangtgtgcatggggcagatggagcctgatcaggtgtacgaggggatcaccttcgaggacttctgaagatctggcaggggatcgacattgagaccaagatgcacgtccgcttccttaacatggaaaccatggccctntgccactgacccaccgccacctccgcggagaaactgcactttgcaatgggtccgcntcccgcgtactggagcagccagnccgncggacanctcttctgcagcncggtacatagncaaggctcgtctgcncaccttgtgtcttgtagggtatggtatgtgggacttcgctgtttttatctccaat

SEQ ID NO: 655899 - DNA, 187 bp, Homo sapiens
  misc_feature (112)..(112): n is a, c, g, or t
ttgcattgtaccgggcaggggtatccaaggggttggctagggtatcattgtctgggtcgcctaggacggtctggtgacgaactacgtgttaactgtcacttaacggacgacncacggaacgagaacgtaacgccgacgggcgtacttcgacttgtagtagtacacgggtggaacggtgacttttact

SEQ ID NO: 655900 - DNA, 112 bp, Homo sapiens
  misc_feature (100)..(100): n is a, c, g, or t
gccacgtatcctgattttacagaaacgtgggcaggtcagcagtgccactggagagtccagagaagcccactcagaaggaagtgcctcagaccaccctgcngcaccgagagcc

SEQ ID NO: 655901 - DNA, 168 bp, Homo sapiens
cgtggagtgtttagttgtgttcaaatctagcatacgggttttcttctttaaacaggccatattttttgtcgtgatttcatcgatgtcttgtcttcatcatctgctctccgttcctcctcgccgtatcgcgcctctccgtcccgctcacgcagtggccttctccgtcac

SEQ ID NO: 655902 - DNA, 245 bp, Homo sapiens
cttcggggtacggtgtcagcttgtcctcgtcctccatctcttctgaagacatactggctgtgctgcagcggggatgacgtgcgtcagtaccttacgtcagtactttgatgggccctcggggtccgccaaggccacccaggagccagtggacattgggtccctccttgtcttatggacttatgccagacgctgaagtagtccgcattccttcagcttacattgtacgagttctggggatacagcat

SEQ ID NO: 655903 - DNA, 421 bp, Homo sapiens
cgcctgtgtgtgtgggtgcacatttgtgtgtgtgtgcggcctgtgtgtgtgggtgcctgtgtgtgtgtggggcacatttgtgtgtgtgtgtgtgcctgtgtgtgggtgcacattggtgtgtgtgcctgtgtgtgtgtgcctgtgtgtgggggtgcacattgtgtgtgtgtgtgtgcctgagtgtgggggtgactagtgtgtgtgtgtagcgtgagtgtgtgggagcaagtgtgagtgtgatgtgtagacgagaaagtatgggtagcaaataatgtgtgatgagagagagtgttggagagaagagatagttagtgtgatgtagagtgaatagagataatgagtgatagacagaagagatatatgcagcgtgagtaagatagatgtgaaatgagtgtatagagatgcagtagtgtgagtgatg

SEQ ID NO: 655904 - DNA, 247 bp, Homo sapiens
actctgaggatcctttatatgctgtctcaaaaaaacaaaacaagacaaaccaaaaacgtggtaagaggctaggcatagtgtctcacgtctataatccccagcactttggcgaggctaggagaccaggcagatcaccttgaactccagttccaggtcccagcctggggtgaccaggagcgcagaatccttgtctaacaaaaacaaaagaagaacagaagtagggggaaagaacaggggaagttggggc

SEQ ID NO: 655905 - DNA, 381 bp, Homo sapiens
ctcatgacttacctcaggtcttatctctagaactggctttgtactatatccagcaaaactgtaacagaacaggttaagaaagcacatagcaactgctttttcaacagtaaattttgactattcccctaaatatctaccttagtggcttaacactgttactattgtctttggctttataaagaaagtcttaaaattttgacttttaatgactgcactattctaccaaagcccgtgtttacctgggtattccttgtcacctgtattttacatttccctgctactgttctggtaaacagaattctacagtattccattctgtatattgtcttttacggtttttcaatcatactcactactactgcttgaagttatccgtgaggg

SEQ ID NO: 655906 - DNA, 221 bp, Homo sapiens
  misc_feature (3)..(3): n is a, c, g, or t
agnatagtaaagaactacaaactggtaataaaagtcagcccctttgcctgcaaaaaaaaaaaaaaaggggccaagggtttggaagagacatttctcagaagttaaaatccttaaggggccattcaatatttaaaaatgtgctcacctttatcagtcttcaaaaaattacaccttaaaacgtgtttatcagaaaattacccactaaaggggctaagggttaa

SEQ ID NO: 655907 - DNA, 173 bp, Homo sapiens
ccgggacccggacgtgacatgactgcggtcatttacctaccgatggagaagaccacgggaacgacgcccgtggtggggcggctgcgacgtgacggcatttgacgctggggccatgttactgttcacgacggttacttacactgggctgtgggtggccagacctcctgccctcc

SEQ ID NO: 655908 - DNA, 424 bp, Homo sapiens
  misc_feature (12)..(12): n is a, c, g, or t
  misc_feature (65)..(65): n is a, c, g, or t
  misc_feature (129)..(129): n is a, c, g, or t
  misc_feature (398)..(398): n is a, c, g, or t
aggctggggtanagtggcatgatcttgactcaactggaaccgcttcatcctccccaggttcaagnaattctcctgcctcagcctcccaagtagctggaattacaggtgaccttcaccacacctggctanttttttgtatttttagtagagacagggtttcgccattttggccaggctggtctcgaactcctgacctaaggtgatccacccaccttggcctctcaacgtgctgggattacaggcatgagccaccgcgcccggccagcactgtgttttatatttatttactcatacacttcacactacaatttttttttttgagacagaatctcattctgtcgtcccgttcggagtgcagtggcatgatcttggctccctgcaacctccgcctcctcccnccaagtgattctccctgcctcagcct

SEQ ID NO: 655909 - DNA, 497 bp, Homo sapiens
  misc_feature (164)..(164): n is a, c, g, or t
  misc_feature (214)..(214): n is a, c, g, or t
  misc_feature (459)..(459): n is a, c, g, or t
ggcgcctgcatggatcggaagccggttggggtgtgagaggttttctcgctctagggagattcttcaagcaatcactatgtcaacagacacaggtgtttcccttccttcactatgaggaacgatcacgggatcaaaagctcattcgaaaagctaaagaggcaccnattcgtaccccgtgtggaataagcgggttttggcagcaattggttgcatnatggcattactataaactggaagagcaggggcaaataccttaaaaatgggtccaatttcaatctgatccacattgcgttgtgggcaaagcccaaagggcctttggtgtggtcaggaaggcaaatggaactggtttgggctactggggctaatttcccattggttacttcgggggggacattttccgtgggggggccaaaaatatcccctttaaaaggggccctttataacgcaacacccgaaacngcaacggaatttggccttggggttccattgtaggggct

SEQ ID NO: 655910 - DNA, 106 bp, Homo sapiens
ctccctccgtaacacccaaacttattgcttacaaagagtctctacaacccagactctgcagtaccaaggctgcagttctttatgtgctggggggcgctgttacgga

SEQ ID NO: 655911 - DNA, 131 bp, Homo sapiens
ggtcggtaccggccgatggcgggtcgatctggtcaccaaaagagacgatgaggcagggtcgccctggggctggatgcgccaggcggtttcggccggagaagatatgtctgatatagcgttcaacggcacga

SEQ ID NO: 655912 - DNA, 344 bp, Homo sapiens
gtcgacgttgacatcggagcttgtcattcccagaggcccattaaaaagggaagtggagccaggcatggtggctcgtgcctgtaatcacagcactttgggaggctgacacgtgtggatcgcctgaggtcaggagtttgagaccagcttgtccaacatggtgaagccccgtctctgctaaaaatgcaaaagattagccagctgtggtggtgggtgcctgtggtcccagctgctcgggaggctgaggcaggagaatcgcttggacttgggaggtggaggttgcagtgagtcgggatcgcaccactgcactccagcctgggcaacaagagtgaaactccgtgtcgacg

SEQ ID NO: 655913 - DNA, 486 bp, Homo sapiens
  misc_feature (474)..(474): n is a, c, g, or t
taagggtcccattttataccagatcctggatcccaaaaagagggaatcagctcatccccatgggagtgttatctctcagtgggggatggggacatctccatacttcctaggtggctaagagcatgcttctctgatccaaacctgcagagcagagctgagtatttccccataactgccattagctgtcctcaaaagtatatttcctatatagttattacacaccaaagttctctcataatgcaaattaatttctgtcacccccccaaaagtaaaaaatatcagataatggaatgcaaaatggaacagagccttagattttgagaggaatcttatctactttttagtcctgaagtttcatgagtaaaacagaggtttattccaaaacgggatctgtggcacttcctcttttttcctaaggagtcccaggctgttagaactggaatatctgcttttaattaagctgacttttaaccncagtgctcttta

SEQ ID NO: 655914 - DNA, 817 bp, Homo sapiens
  misc_feature (205)..(205): n is a, c, g, or t
caccgggccggggtgccagcgcctgcttcccgtttcctcccgttccgcagcgcgcccacggcctgtgaccccgtgtgaccgctccccagtgacgagagagcggggccgggcgctgctccgtgcctgacctgcgaagggacctcgtgtccagtcccctgttgcgcctgctgcccccgtccgtcctgtgcgctgtggccagtcatgngtgccatgtgtctctgatgctggtcgatggtctgcatgacctagatgtgctgccccacatggcctgtgccctgtgtggctgcttgggagctgcctggcctgctgtgtgccggtgtggggatgcctctgcacgttgaagtggcctgtttcccctgctggtgcctgccgctcacctgtgaccctgtgccagcagcgtcgtcatgggcttggtgggcacctacagctgcttcttggaccaatgtacatgaaccacctgaccgtgcaacaacagggaggtgctgtacgagctcatcgagaagcgaggcccggcacgcccctcgatcaccgtgtccaatcaccagtcctgcactggacgaccctcatctcatgggggatcctgaaactccgccaaatctggaacctgaagttgatgcgttggtgaggaggaatgggcccctcgaagtgggccgggcggcccaactgcctctgcccagatttgccctcctactgctctgcccaggaggtgctgtcagcagtccaggaccctgagtgagacatctgttcacaaggagtacatccacttttcagttggcagttttctttccggaatggttacgaaggtggtctttggaac

SEQ ID NO: 655915 - DNA, 276 bp, Homo sapiens
cagaagagagagctagtctcctccttgtcccagatgatgtgtcacctgttactgacgaaactggtcatatcattcatcaggggtcccctcttgtgtgttctcattcttcccgatacctcaggagtatcctttctaccacccccagcacagggcccgcctcagcctaagcccaggggtaactgagcctcaccaccaagacgtgtctgaggctctgcaagtgggatgaagcactgagccaacaggcgagatggacacacacaagccacagtccttctg

SEQ ID NO: 655916 - DNA, 146 bp, Homo sapiens
ttgactgcctgggagagacacatccatagctgccggcgtttttactatactatggggaccaggcttcgaggacagagtgggagggtaagagtctttctggcaataaatcaaagttcaattttatcgtttatcatacgtaactacaa

SEQ ID NO: 655917 - DNA, 550 bp, Homo sapiens
gagaaatgaacgctgtcgagtgtgcggtatgcacaacctggactctatcatcacctttgctgaagcaagtaagaatgatgatcctgcttactgccgtcacgtgtggattatatgcatatagaagaataacagacaaacgccgggcagaaccttactactggccaagcgatcgctgatgattacgataaaacgaaactagggacggcgagcaaaaaaaaatacgccatgtgaggaactgagattgagcatgcggcatatggagaagtaaaccagctacctagagacccaagaacatatgtccagtacatgaatagattggactgcttaaagacgaacacttcagagttcatgccattcaagagaccacgtggtcattgagctctagtgacgatttccttgaacgagtcaaacttccattaagtgccttgtgacaggtgttacctgacaggtctcataatgtgaccactggtgagcctctattaactgggactagtgtactacgatctgccacatactgctaagtgcctaggaaggcgcatgcctgaacccc

SEQ ID NO: 655918 - DNA, 131 bp, Homo sapiens
ctctttagctgcatgtactttttgcatgcgctaccttcactgcatagcgcatgcactcattgctggacctgagacacagaaaggctttcttggtggcttcggatactatccctcgaggtccaatcttccgg

SEQ ID NO: 655919 - DNA, 399 bp, Homo sapiens
  misc_feature (88)..(88): n is a, c, g, or t
  misc_feature (91)..(91): n is a, c, g, or t
  misc_feature (95)..(95): n is a, c, g, or t
  misc_feature (156)..(156): n is a, c, g, or t
  misc_feature (389)..(389): n is a, c, g, or t
tcgtctcaggcggaggtccccatccccctgaggatgactttccccaaacaagagcggggtcgagagccgcccagtgccgccccccacnccncccnccggcgtagggtgtctgggacccaggaaccacccgcggctgggagacctggggcggcctgnccagagaccgcggggcctggggctgggggaggggagcggtaagtgggggcgggaggaggtccctttgcagagggaaaccaatgtcatccgtctccaacttctgaggagagacccggagcagccagcagattaaaaaccccatcccggccctcaccgaggtgttacaactctgtcccagttgcctggcaaccgcgcaggtgtgtgatagggcgagcggcgctcccgggagccanccagcggccg

SEQ ID NO: 655920 - DNA, 1045 bp, Homo sapiens
  misc_feature (365)..(365): n is a, c, g, or t
  misc_feature (434)..(434): n is a, c, g, or t
  misc_feature (622)..(622): n is a, c, g, or t
  misc_feature (686)..(686): n is a, c, g, or t
  misc_feature (753)..(753): n is a, c, g, or t
  misc_feature (1020)..(1020): n is a, c, g, or t
  misc_feature (1022)..(1022): n is a, c, g, or t
aggatcccggaaaatagccgacgaggtataattaggaatagtgtagtaggatagtatggtaatatatagtttttttcgggtgtggtttcttttgataggtgagatggctagctattagtataagggggaggagtcatgtggttagaactagtaggggtgctgatagtgagtcggagaagaatgttaaggaaaaattaaggctgttttcgcctagttggtttagtagggatagactgatcaggctaatgaggagactatgtactgttgcattgattcagattatgttgtgtttagatattcatgttatgggtagtagtattgttgttgggataataatttttagcattgtaagaggtttaagtttnggacgtaatcggtaccgtatgtgttggataccattactagtactgataggcccagtgcagcttcgcagnctgcaaacactagtaaaataatgggtattatgttagctagggtgaagtgtgtgtttaggacaattagagtcgatatgatgaatagtgataatatcattccttctaggcatagtagtgaagatattaagtgagatcgatatataagtaaccctgcaagggcaatcgtgaatgctataatgatgtttatntatactaatggcacttgataattatgaagtaaatcatagtctaatgagtcgaaatcatttgttntgttttaaactaattatcatattctgctcattctaggcctttttgggttcattcgtatgctaggctngctgctagtaggataagaaggaatagtgctattgtaagtattgtttttagattgtttgtttgggatgctcatggtaggggaaggagaagggcgatttctagatcaaaaaggagaaatgtaatggctactaggaaaaattttattgagaatgggaggcgtgctgatcctatggggtcaaatccacattcatatgggcttgttttttctgaatatgcgtttagttggggtagtcagaatgcgattagtacgagtagggagtctaggttncntttgtgagacggtaacaccacag

SEQ ID NO: 655921 - DNA, 372 bp, Homo sapiens
  misc_feature (29)..(29): n is a, c, g, or t
aaaaaagggggagccctttaccaactggnccccctaagtgtggggctgtcccccctgggggttccccaaatgcaaggggggggggcctcccagcccttttagatccgggtggtccgggaatcccttgcccgggttttccccgttttttccccgcctccgaaagaaaacccccgggaatttttccagggccagaaggcacagcccccgggccttcggccttaaaaaacccgtgccctgggcccccggctcccccagcccgggggggacctttaggcccaaaagcccccccgggagggggggctggtcccccttcgggaggtcccgggccaggccttgggggggccttgtccattaagccccccggggtgggga

SEQ ID NO: 655922 - DNA, 293 bp, Homo sapiens
  misc_feature (231)..(231): n is a, c, g, or t
tttgaagacagggtctggctctgttgcccaggcaggagtacagtggcattatctcagctcactgcaaccactgcctcccaggctcaagtgatctgccctcctcagcctcctaagtagctgagaccacagggacacaccattacacctgggctaattgttgtattttagtaggagatggggatctttctatgttgcctaggctggccttcaagtgatcctcctggccttggngcttcccaaagtgctgttgattacagggtgttgaacccaccatggccccaggccaggaggat

SEQ ID NO: 655923 - DNA, 587 bp, Homo sapiens
  misc_feature (12)..(12): n is a, c, g, or t
  misc_feature (44)..(44): n is a, c, g, or t
ttagaaatattntgtggcaatgaagaaaacactacggaaaatanaaaataagataaagccttatgagctcgtattgaaatttgttgaacttatattgaaatttgttgctctaattcacagtatactcacaaaaaaatttactcagcttaactatatttcacacattgtacataaacacaagatcattaagaagtccactgacagtatcagtactgttttgcacatactcagaataatttggcttcattttgaacaggactgtattgttttaactgctgctaaagaaactattacatagttaaattgtacagaaagtctctcttccttttgatattttaagatgagtagtattgcttggcttttataatgcatgcagctttattctcatatttttcctaaaatttatggccaagtgtttactgttttagagcttaagtcatttctcagtggaaattatggggaattagaaatacagcaactcttaccttcttcctactgtaaaattgaactattttgtaacatctttggtttcatgagccaattctatttcttctagatatttaaaaatatacatctagttgacttta

SEQ ID NO: 655924 - DNA, 533 bp, Homo sapiens
tgggagacgggggctcagtatctggctcttggggctgacaaggggagcaggttatggtgggtctgaaccccaggatttcctctgtcccaggttgtgactggcagctgccatctcttccttctcgctgacatctccatttcattcacagggtcccaccggcccggtgggtcctccgggcttcccgggtgcggtgggtgctaagggtgagaccccccactctcctctaagcatgaccctcagtgggccagggggttcatgtctcccgtgtaccccaaagcaaagggacccagagtggcaagagagcagcccgttcactaacaccttggtcggggggtctccgtctctgatcttagagtcctgatcatggctctccggtccttgtctccctttcctcgtgccatcccgagaggcagggtggggtacccaggggggcttctgatatgtcctttcttctgatgcagggtgaagcttggtccccaagggccccgaggctctgaaggtccccagtgtgtgcgtggtgagccttggccccc

SEQ ID NO: 655925 - DNA, 337 bp, Homo sapiens
  misc_feature (20)..(20): n is a, c, g, or t
  misc_feature (73)..(73): n is a, c, g, or t
  misc_feature (120)..(120): n is a, c, g, or t
gcgcagttaaggggcgagtntaagggggagatcgaggctcgctacagcactggattagctggaaacctcctgngagactacattacaccactgagggaatccctgtgctgatcgtggggncatcatattcctgttatggggacaatcattccacctgtgagaaacctttttgcagtcctttgtcaaacacactccttggggattcaggactgttgatgagctttggtcgccgagactgtgcacccgggtaccctgggtgaacaggcacttcaatacaaagaacaaggatccctctttccaaaaacccgcgccccaaggccccatttatcacccaggc

SEQ ID NO: 655926 - DNA, 927 bp, Homo sapiens
ggtccccttgccagccaggggatgtgcagcaaatgagaacagaaatcatccaagatgtgaccttatcatgacttgtatgtggctaatgcgcggctccaggggggacaggatatcctgtacatgatgggccaactaatgaaaggtcaaagaatacagacatcacagacatagacttgcgagggggagattacacaaaaggtggtgaagcgaagtacatcgagccaggccgatatgacttggagcattggatcccggtatgtggcatggtattgtgtgattgacggtccaccagtgactcgtgacctattggcagtgtcttacaatctaaccatagcgagcggcagccaccttggaaagtgtcttactaatgcaagcatacaccctatgcatgtgccggattccttttagcgatacgctatacgcgaatgggcgtaaacatagtttgtctatttcagatgaagtgcccaccttgaagtggacgatgccatggatcacgactttcaacggggtcatgtccccctgcttttggaccctttatctatgggggaacgcgcaagatggacttgaagtgaacattcccgcgggaacccccacttgcatggttagttaactattcccgaaacacaacgtggataaacgtggcaaaccaagccaggaacttcgaatcttaagagcagcaaggtccccaggtctggcccacaacagagcgcgggcaaacagtggaaaagttccgaaaacacatgtctaagggtgggatgtgggaccggtggcgcagctttgcaaagcacaaagcgccgttggagcgcggaggaaacggaaactagtggtggcacaggccccaaatggaaacgccaaacgaggcgtttgaaaggtgagttagcctccaaggggtgtccaagcgcagtatggccggttggaacgcgtcac

SEQ ID NO: 655927 - DNA, 1091 bp, Homo sapiens
  misc_feature (173)..(173): n is a, c, g, or t
  misc_feature (456)..(456): n is a, c, g, or t
tccctggtgtgattccggtcctgggcgggttggtctctggaagcaagcgtgtcttttatcttccggcccggcttctcttccttaacttaagttgcgcgttggccggcaaccgagtggaagatatccgagttggacattggacattgaagcccccttggaaggccccagaactnatcttttccggtgtggtgtgaactcaaagggcgagccaagattatctcacatttaaggtggcgttcatgggtgcaacatgtagcgacccaggttatctctttaagcaacgggccaggtttaagggcgtggtgcgcaacaggcatgtaggttgcgaccattggttgcaagccagagagcggcatggcattacggaaggcgcagtcccaattaaagtttaaccacattggcgcaacattttgcgcacacattgtgcattgtgtaccagcgccaacaggtgttccnctttgggggcgtttagggaattaaccacaccaccagtgggtgctttacaggtgtcgcacagtgtgtggttccaggggcccagttgcgcattattaggttggacacagcgaacatttagattatagctggtggaagggacgatgtgccgaggtgccgaacgactgaacgaccagagagcgagcgagctgtgtgaagcttctctaacggtacgtattctggggaaagggcgcgtctgggccctgtgatgggtgtgttttgccacagggtttccccagaacaacaaaggtataaaaactttggctcgggctgtgattgaaagactgtagttgacgaatgtatggatggcaacgcagggggttggattgactttggacgaatttagatgtaatggatgtatgcatttttggggatggagatgtagggggaaagggcgtgaaggtacacaaaggtggcccagattgtgaaagaaaaattgttattttgggggatatattccagggccaataatggtgcaccaataggtttgaagtggtccggaatggggaaaagggacttcagaaaacaattaattaagacgcaaggatttacaaggggaaaagaaattcctttcaagaaagagggaaacaaattcttta

SEQ ID NO: 655928 - DNA, 347 bp, Homo sapiens
aaaatttaactggggggttaaagactttgcccctttttttcaagaaatttgcctaaggtggttgccttttttacccccaaaaaaacttttagttttttaagctttttcctgaattttgggaagggaagggatttttatgtcaaaggcccaacctttatgatttcaaggaaaaattttaatccctggggaaaaagaaactgaacccttattaaaaacaaaaattccggatggaaaaccccaaaatgggatttattaatgtgggaaacccccaaaccgtttgttttccttttgggaaaaaaagtgtgttctataatgaattaatataggagtggtttttaaaaaaaaaa

SEQ ID NO: 655929 - DNA, 458 bp, Homo sapiens
  misc_feature (71)..(71): n is a, c, g, or t
  misc_feature (125)..(125): n is a, c, g, or t
  misc_feature (202)..(202): n is a, c, g, or t
cccccccccctccccaagaagggggtgtgtccccccaaaaaaaagatggggggggcggggggaggggcgcncggcgaccccccaaaaaaggcccctatccttcgcgcccggggggcgccccccgnctgtgtctgctgctggcccgcgtgctgtggctgtccagtgagtagtaagtcctgctgtcggccgccgggcacagtgncggcgagtccgagcgcagcgcgtcgtgcgccccacgcaggcccaggaaaggtgtgctctcggccgccagcgccccgtccgcgtcgtccgcgtcgtcgtccgacgccgaggctgagccgccgcccgagccgctgctcagcgacagcgagtccctcgccgcccgtgcgcgctgcgccgccagcccgttgaggcgcgagcggcgccagcgccggggccccgccgacgtcctgcgggacgcaccgcgcgcgcgcggccgc

SEQ ID NO: 655930 - DNA, 273 bp, Homo sapiens
cgtatcgcccaacacacacaatacacacacactatacacacacacaacacattctctacatacacactacacacactacacactacgaggcacaatacacacactacacacacactacacacacgccatacacacacaataggcttggctcacctcccatctgactcgctctgtgtattcattcattcactcgtgtattcagccattcaatcattcaacatattgggcgtccaatgtgaacaagcattgctctaagtgttggggataacatca

SEQ ID NO: 655931 - DNA, 678 bp, Homo sapiens
tgaaaccaaatacacagattttatttatgcacaaatacacttcccagccaaataacagaagtgatttaaaaccccacaactcccgggggcagctagtgcccgtgtacttcggacagtgaaggtggaaagtggtgtcaaggggctgggctcacaggattaaggcacaagaagctccccaacaaggatgctagtgtagcgaaggaaacgcgaggaagagatgggcttaaaagatggaagagaatgggtagagagcactttgagggaaaagcaggaggcagcctcagggaaaggggagcgtggccctcaaactcagtgtgtgcaggggtgaccatgccagagtgctccccaggccctccagtgtggttccagacgtgggccgtgcctccagaaggaagaagtttgcaccggaaggagggggtcatgtgggagtgcaccccggggcctggcacactttgtatgaagcggcggcccatgtttgggtcctggcttctccacagtacgcttcacacaatgggcccccgtgtgtgcccccacagatggggtgtgctgcataggtgccccgccagaacgagacttccagatgtgcggtccgaaactccttactcatcttgggcttctgaagtcttggcctgccccttaaccatctttgggcccatgcctcttcttcaggagtctccg

SEQ ID NO: 655932 - DNA, 294 bp, Homo sapiens
cgaaaaagaggatggttatgggctgagagtggtggctcttgcctgtaatagcaagtgcaggagggtgaggcaggtggatcccttgagcgcaggagttcaagggcagctaagccaacatggtgaaaccgcgtctctgctaaagatacaaaaattagcctagtgtggtggctcatgcctgtaatcgcagctgcttgggaggctgaggcaggagaatcatttgaacccgggaggcagaggttgcagggagctgaggttatgtcactgcgctgcagcctaggtgacagagcaagactc

SEQ ID NO: 655933 - DNA, 1256 bp, Homo sapiens
  misc_feature (465)..(465): n is a, c, g, or t
  misc_feature (468)..(468): n is a, c, g, or t
  misc_feature (485)..(486): n is a, c, g, or t
  misc_feature (492)..(492): n is a, c, g, or t
  misc_feature (501)..(502): n is a, c, g, or t
  misc_feature (513)..(513): n is a, c, g, or t
  misc_feature (522)..(523): n is a, c, g, or t
  misc_feature (558)..(559): n is a, c, g, or t
  misc_feature (561)..(561): n is a, c, g, or t
  misc_feature (563)..(563): n is a, c, g, or t
  misc_feature (565)..(565): n is a, c, g, or t
  misc_feature (577)..(577): n is a, c, g, or t
  misc_feature (584)..(584): n is a, c, g, or t
  misc_feature (593)..(594): n is a, c, g, or t
  misc_feature (603)..(603): n is a, c, g, or t
  misc_feature (613)..(613): n is a, c, g, or t
  misc_feature (623)..(623): n is a, c, g, or t
  misc_feature (629)..(629): n is a, c, g, or t
  misc_feature (632)..(632): n is a, c, g, or t
  misc_feature (638)..(638): n is a, c, g, or t
  misc_feature (652)..(652): n is a, c, g, or t
  misc_feature (750)..(750): n is a, c, g, or t
agtcgggccactcggcgtttgctcaagtagagtggttctctcttttgctaactccactgctgtcttttttgtatactatgtctctattctctgtggtgttttccctcgtgtgatgtgtggactccttgttgctttgcgactcttcacctattgtgaccagtagtcgcgcttgtccgttctttcagggttttccaaatggggtttggtcattctccctttgcgcagatgagatgccggggttcacaaaacgcccgaatggggtggcacaccttgggcgtcaccctgtcaacccgttcctacggagtaaatctgttgaaggcccctgagacttttggagtgaagctctttctctgggggcaaaaatgggcctccaactgtcaaggaaatgtgtctttccaagggatgtttctttcgtggcaacctttgtctgggtgacagcccacaaatgtgaccgcccccatgggnagncagctgggcttcactgnntcaggngattatccnnggaccatccanggcccaatnnagcccccggcttatgccccctgtattggattgccnncncngngtccacattgcnatgccangtttgctgnngctgaaggnaaagattgantcgcccgttnttggtnaanaagctnggaagatggccctnaaatttctctgaaagttctggtggatagctcgccacattgttgaatatatggttcctcggcaaagcccacatgtgtgttgaagagctttctccacganctatatccaccccttgggtcgcctttgctgttttgctgaatatatgagaccacgaccacgtttcgcgtgtgggtgttcacatcacaaagcacgctggaacacaagaaaggctgctggagagctggcaaaggtcacccacaagtctgcccacgaaaggctcacgaaaggctataatgagatattattccctaaatacctgccacccccaccttcttaaatcacgtgggtggagagaaccggttctcacgagaactcgtttggtttcacaattggccacatttaagtttagtagtaaaagagctgggttaatgagtaacacaatgcactcgtaaaaccttcacgaaggaaaaggagaaatgttttgtggagccacctttggttttcttttttgcgtgtggcacgttttaagttaattagtttttaaaatcagtactttttaatgggaaccacttgacccaaaatttgtcacagaattttgagacccccttaaaaaagttaaatgagga

SEQ ID NO: 655934 - DNA, 116 bp, Homo sapiens
  misc_feature (8)..(8): n is a, c, g, or t
  misc_feature (116)..(116): n is a, c, g, or t
cggctggnacacggctaccacaccctggaagaccaggccctttataacaggctgcggcaggaaaacatgcacttcgagatctgcccctggtccagctacctcactggtgcctggan

SEQ ID NO: 655935 - DNA, 194 bp, Homo sapiens
  misc_feature (54)..(54): n is a, c, g, or t
  misc_feature (65)..(65): n is a, c, g, or t
  misc_feature (79)..(79): n is a, c, g, or t
tgagtggtatcggtcgtgcggctgtggtttgttccgccgaggagagttgaattncagaatgcagntctggaatggtgtnggaaccatgggtgagatggggcctcggtgctgagccccctagctggctctggggggatgctggagctgcgcccggaaggcattttcctgccaagtccagcttctccacgaaggag

SEQ ID NO: 655936 - DNA, 552 bp, Homo sapiens
  misc_feature (496)..(496): n is a, c, g, or t
taaaaatacacccaccatattaataccaaatccctctaatcaccggcttactaggtgtttccaataacaatttttcccggtataaaattacggggaaaattggataattaccgggtaagagaaagatattcctaggcaataactaggatcattgggaaaaggtgagtacggtggatattaaaaatatcacagtaccaagatcaggctggtccctacagtatggcgggccagacacttaggtgaaagcagaagggtgggggtgacttccctacttaaaatttgggtcatatcatttcaaaacattggcttctgggtgggcggcatatgctttcctatggatcccaaaccaattcttagattcacttcatttaaattacggagcggtatggattacttcgaagcagaacaggcatggtgcagccctcatttatgagaaacccctcaggaaactcccagggggatggctgggagaagcggtgagtggagcggaggcggnagaacttcctccagagcaaggggcttaagaaagaaagaagactctaagcggggtcg

SEQ ID NO: 655937 - DNA, 1384 bp, Homo sapiens
ttcttgttttgtcaaataagaagtacattgcttccattgttcgttgtgtgcgtgtcgtgtgtgttgctgtgtctttctggttggggctgtagttgtttggttcagctagggtgcaggttgttttgtctagtggggttctctgtgacttgttcggtgttggtatgtggttatgcctgttagttcgcgttgtgtatgatttgatggtcctgtcttattttgtggctctcgcttggatggcgctgtttgcgagttgttccgggtgtagttttctctctctctctgcccttcttctcgtttcgttgtggcccgtttctggtcatggcgttgtggtatgtgtgttcacgcttcttctcgggtgttgtatgttgctggccgttgttttttactggttgtcggattggtggttcggtgtttgttgcactgtgtgccgcgtgtcgccggttcctttgtttgtttccacggttgtttctggccattgtgtttttgtgcgtgtgttctcgtcagttgtgctgttggattgttattgtcatgtgatttcttttagttattggtatctctgattcggctgttgtgagctattgacgtgtagaagtgaggtcaatgattccctgcacttatccttgaatattacttacatggaatgtatctcagtccactgctggcctgctaatatcagttggagtttatcgtcacgtgatctgcaagggtgcactcgttaagggttttccgctgccatgccttggtggggcttgctaccgtttaaggtctgcagtatactctagcttgtatcgatcctcgtcacctcgtcattcttctgtagggtctcacgtatctagggtccctgcggactggagccaatcctgggtattctactactaggcctgacttgatagctaagtgagttagtgtttccaagttgtcccactgctcattcaaagtcagtccctatgagtgtatttgttgctcagtcctaaccctggggccagagagttggtcgcgaggcttgagaattccttccgtgcctcatccttgtgtgttgctttctgccaaagtgagttgttttagacgtagccagaaaatgccgtggcaaagagctcagaaatccaatgttggagtaccagaaggtttctcatgttaatttctcagcccccagagaagcatcttactcctgaaccttagacaggaagtattgtttcagtcacagaaagcttttctgggtacctctggttagcactttctactgctctgatatttcctatgtacatagcttttattgttgtagaatcctttcgttaactggttcaaataggacttgttagcaactatgggtttgcagttttctgagtaggtgagtttttcgaatatcggctaaaggtcagaataa

SEQ ID NO: 655938 - DNA, 192 bp, Homo sapiens
catgtgccgagggagcggtctcaaagagcacctgccccaggtggagatgcccagtttgacgatcccaaagtggacctcaagggcccccaggtggacatcacgggccccaatgctggacctacaaagtctccaaggacggaagtcacagcccactgatgtggaaggtgtctggaggatcctctagtactcgac

SEQ ID NO: 655939 - DNA, 796 bp, Homo sapiens
ctcccatatagtagcttatctactccggaatagaaaagaaccatttggatacataggtatggtctgagctatgatatcaatgggatgcctagggttgatcgtgtgagcacaccatatatttagcagtaggaatagacgtacgacacacgagtcatatttcagcgctccggccaccataattcatcgccttatccgcacctaccggacgtcaaagtatttaggcatgagcatcgccatcactccattggtagagctaccatatgaaagtgatctgcatgcaagttgctcctgagccctaggagttcatctgttcttgttgctccgctatgctggtctgactggcattgtgttatcgaaattcatcgctagacgtcgttctacactgacactgtactaagttgtaacacatcattccacatatgtccgtatcaataggggctgttaattatgctcatcattaggaaggctacattcacgtgtatttcttcacctattctgcatggctagcgagcccatagtacaacagaaccgttacggccacatagatcgcatttcgcatagtcatattcatcggggtatagtcttagctttctaccccacagaataatttctcgggcctatccggtaatgtcgccgattgttcctcgggcacgatcccgatcgcgtagaccgacatgaaatatcctatcatctgtcaggctcattcaggtcctctacagtcgtaatattagtaatctgcaggattttgagaagcttggtactgaagcgagaagtctgatatgagaggaaccctcca

SEQ ID NO: 655940 - DNA, 330 bp, Homo sapiens
tgggcctggtctgggtctgggtctggggaggactggggaggtgcgggtgacggcaccgcaggtaaggctcctgcaaggtggcagccttggggcccgaccctgggtaggagggcaggccagtgatgacaagggaggccccagccagccgaagttgcaggcaggggcagtgcagggtcccagcaggtgaaggccccgggagtggagtctgcagggccctgggccaaaagtgttcagggcacaggtgactaagcccagccaggtcttcagctcaaggcctaggggaagttggggctgggccctggttgagcagatcctgggccttctgaggtt

SEQ ID NO: 655941 - DNA, 358 bp, Homo sapiens
agccgtgagtacattgtgggtatgtccgctggagtacagaacggacaaagctgcccaaagagactctagaacagcagaagcggcatctagtgagatggcagcctatttcacccactccaaacctgcagacctgtgcacattatcctggtgctgcgtacagccctcaatctgtacttcaacgctcaagaacttcaagacagatgccagctttgctacggggcctactataactcgggcccaagcctgaggttggcccacaagacccgaacactccttgtctgcctattagaagaatcccacagaatagctaaccagctcaattattgacatgcactacctctttgacatttgtgctgca

SEQ ID NO: 655942 - DNA, 823 bp, Homo sapiens
ttttctgagccttttaccactccagcctagacccctaccccccaattaggagggcactggccccccaacaggcatcaccccgactaaatcccctacaagtcccaatcctaaacccacatccggtattactcgcatcatggagtatcacatctaccgttgacggctcaaccagtacttctacatacgcaataatcaaccgagacaccaaatcaattcaagcactgcttattacaattttactggagtctctactttatacccatcctacaccagcctcatacagtacttacacagctctctccttcaccatttccgcacggtcatctacgagctcatcatttttagtagccacaggcttccacgggacttcacgtcattattggctcataactttcctacactatctgcttcatccgccaactaatatttcacgtttatcatccaaacatcactttgtccttcgacgtccgccgcactgatactggcatcttgtacatgtggctttgactactttctgctatgtctccactctattggccgacggctcttaacacaccgaaatctccaaatcaattatgatgaaacaccaacaacccaccccccgacccccatcctgtggaggagcagaaaccggctcctacccgccccccatcaccacagcaactcgtgcacacaccgactccttccccgctgggacgcacccgagcaacccctagcgaaccgaaatcaacgcaccccccgcataccccccgcccacccccccccccccccccagacgccccccccgcgccccccgcccccacaccccaccccacataccccc

SEQ ID NO: 655943 - DNA, 156 bp, Homo sapiens
ggatatggagccaagatccagagctggttagatcaggtagtagattccatggtatgcattagataaagttgtcctaggaaagagaatatgccctaaggcttcttcagactggttcaagtaaagagctagacctggctgcttggttgaacgagacat

SEQ ID NO: 655944 - DNA, 259 bp, Homo sapiens
agctcggacccctccgcgacccgtactgaggctgctcgatccggatatcttgtacaggaaatactgggcacagtcattcagctggtactcgttggagcgttcgtagcaggcacccgctccttcatcctcccacagagccttggcatgctcatagaattcgggagggaagtcaaagtcaggcacgtacatcacactcaaaatgccttccactctgaactgcatctcggagggggacaggtccccggggggcacttgtttg

SEQ ID NO: 655945 - DNA, 200 bp, Homo sapiens
  misc_feature (57)..(57): n is a, c, g, or t
  misc_feature (59)..(59): n is a, c, g, or t
  misc_feature (180)..(180): n is a, c, g, or t
ctttttaaagattttagaaatgcagcttctgctgtgggccactaggcggagtacttnanagcagggtttgtgggagtacaaagctaacttctgctgcttttgcttgatgcttctgaagcttccttgactactgtggatgataagtaactattttcttccacttctttcttttttcccctnactctttgaagtgaacttga

SEQ ID NO: 655946 - DNA, 339 bp, Homo sapiens
tcacctcgttcctcctcgttgtcgcctctgcggctgtgcttgcctgcgagccacaccaggctgcggataacaggacgacacaggtgagacgctgcgagttgctgctggactgggtgccccctccattccagcgtagttccctttctgtttgatgtccgtcgaacatcacccacattgccatccaggcctttagagtaggagtgtctctccaggtgaggtcccctaacaccagctggttagagtgacccagcaaagccttgttcgtccccactctggcttaattttccccagctctactccacctgctggctcctggagtagagctgaggaccatcgttg

SEQ ID NO: 655947 - DNA, 868 bp, Homo sapiens
  misc_feature (686)..(686): n is a, c, g, or t
  misc_feature (703)..(703): n is a, c, g, or t
  misc_feature (757)..(757): n is a, c, g, or t
  misc_feature (850)..(850): n is a, c, g, or t
  misc_feature (859)..(859): n is a, c, g, or t
  misc_feature (868)..(868): n is a, c, g, or t
ctaatcctgacatgttgttagcagtttttgaagatgcagtgaaagcttgcacagatgagagccttgctgttgaggaaagaatagaggcctgcctcatggcaagctgttcaagatgtaagaatccactttacacaaacatgattgctctgcaccaactcctggagaggtatgaggctgcaatggagctttgtaaatctttattggaatcatgtcctattaactgccagttgctggaagctcttgttgcattatatttgcaaacaaatcagcatgacaaagccagagcagtgtggcttactgcatttgaaaaaaatcctcagaatgcagaggtttttttatcatatgtgcaaattcttcatcttacagaatcgaggcgataatcttcttccatttttgcggaaatttattgcatccttctttaaaccggggtttgagaagtataataacttggatctgtttcggtatctcttaaatattccaggaccaattgacattccatctcgtttatgtaaagggaattttgatgatgatatgtttaaccaccaagttccttatttgtggctgatttactgcctttgtcatcctcttcaatcaagtattaaagaaacagtggaggcatatgaggcagcattaggggtggctatgagatgtgatatagtacagaagatgtggatggattatcttgnctttgcaaataataganctgctggatccagaaacaaagttcaaggaattcaaattttttactggatttaantggaatagaatggtttgggttaccggtcccctggcccgaatacccccaattccctttttaaccaatgcttgaattacctgggtcccaaccttntgaaatttncattaaatn

SEQ ID NO: 655948 - DNA, 219 bp, Homo sapiens
gcagccgcctactactactaaattccccgccggtcgaccccaggtcatactaatggaagaggtgcgtgtgagacatggggtcaaaggggatcatttcggaattttaaggttaatgactgccctattggattttggacttgaatggggccggtagccctgttgttttggccaatttctcccatttggaatggttccaatgtttgtatccccatgtcgacg

SEQ ID NO: 655949 - DNA, 174 bp, Homo sapiens
acggacgcgagtctggatgtcgactatgattcaaataagcaaagccaggcatgagctggggaagggcatggctgctgggaggaggatcgcttgaacccgggaggtggaggttgccgtgagccgaggtcgcaccaccgttctccagcctgggcaacagagctaactgccgtgcac

SEQ ID NO: 655950 - DNA, 474 bp, Homo sapiens
  misc_feature (92)..(92): n is a, c, g, or t
  misc_feature (138)..(138): n is a, c, g, or t
  misc_feature (149)..(150): n is a, c, g, or t
  misc_feature (155)..(155): n is a, c, g, or t
  misc_feature (181)..(181): n is a, c, g, or t
  misc_feature (233)..(233): n is a, c, g, or t
  misc_feature (246)..(246): n is a, c, g, or t
  misc_feature (264)..(264): n is a, c, g, or t
  misc_feature (269)..(269): n is a, c, g, or t
  misc_feature (318)..(318): n is a, c, g, or t
  misc_feature (420)..(420): n is a, c, g, or t
  misc_feature (441)..(441): n is a, c, g, or t
  misc_feature (452)..(452): n is a, c, g, or t
  misc_feature (468)..(468): n is a, c, g, or t
cagccaaattagcagtgtataaatggcacctaggtaagagcagactgcggctcggttgacttgatacttggggcagcccgatgctgtgtgtngggcaggggaggcatccttactggagaggcagggccagccattggnacctctggganngggangggaccatgaggcagccagcccctgnaggcgagcatgtgccaccgcagcagcgctccagtcgggaatggccaggatgngccctcttgttgnagtttttggttagctttnacgtnttcttctccacccacggcacaggtgataaaataggatccttggtgcggnttaaaaattatgccagaaagccaacagctcccctcgtgggccttgccttaaacttgcctggtttgtacattttttgccggacgcatcaagaagcaatctgtnacaaagtctgagggtcttccnttatgcttgcnctccacactaaagagnagttgg

SEQ ID NO: 655951 - DNA, 145 bp, Homo sapiens
agagtaatccaaggatcggcatcgcaccctagcgagggtgacagaggaagactctatctcaaaaagaaaaactagaactcatcatgcgattttgtattgtggcaaaagaaattttcctttagtgatatccatattcaaccgtaag

SEQ ID NO: 655952 - DNA, 437 bp, Homo sapiens
gctgcgggtcgccatggagcccgacggggcttacgagccgggctttgtgggtattcgcttttgccaggaatgtaacaacatgctgttccccaaggaaggcaaggaggaccgcattttgctttacgcgtgccggaactgtgatttccagcaggaggccggccacagctgcatttatgtcaacaagatcacgcccgaagtgggcgaactgacccagattatcgcccacgtgtcccaggaccccacgttgccgcgggccgagggccacccgtgccaaaagtgcggccccaaggaggctgtgtttttccagtcacccagtgcgcgggccgaggaccccctgggccttttcttcgtgggcacagcccccccctgcggcccccgctggaccgagtgacctcctctctcccccgagtgtaataaacaccagattccatgggtga

SEQ ID NO: 655953 - DNA, 190 bp, Homo sapiens
tgtcacccgagcttcgtgtcctctcttctccggtctagggctgtcacctttctcgtctcgtgtagcaagtcttgcaacgaccagacatctcgacacgagttgagcccgtctgcgcttttcttgctgctgctggtgcttatctccatgtactcccggttagcccagtcctggtgcatctcccgctgctgga

SEQ ID NO: 655954 - DNA, 550 bp, Homo sapiens
  misc_feature (51)..(51): n is a, c, g, or t
tgatctatgaccccaggggtcgttttgctggacttggtattacacctgagnaggccaagtacaagttgtgcaaagtgaaaaagatttttgggggcacaaaaggaatccctcatttggtgactcatgatgcccgcaccatccggtaccccgatcccctcatcaaggtgaatgataccattcagattgatttggagaccggcaaaattcctgatttcatcaagtttgaccctggtaacctgtgtatggtgactggaggggctaacctaggaaaaattggtgtgatcccccccaaaaaaaggccccctggtttttttgacgtggttcccgtgaaaaatgccaatggcaacagttttccccctggactttccaacatttttgttattggcaagggccccaaaccatggattttttttccccgaggaaaggggatccccctcccccttgttgaaaaaaaaaacaaaagactggcggcccaacaaaccagtgggtgaaatgggtccctgggtgacatgtcagatttttggacgtaatttaaaatattggggcagga

SEQ ID NO: 655955 - DNA, 869 bp, Homo sapiens
  misc_feature (850)..(850): n is a, c, g, or t
gcacaggggatcctctgtccaccctccctcgagctcagaggcgccctgcagaaggtggtgccagcactgccaccgaactgagaaaggcacagagtacaagcgcctgcagccacagctcaccgccacagactccagggcggggcctctcctatccaccaccgccctctccagacaccaagggcagacaaagggcaagtcaaaccataaagctgggggcacgccctgcaagccatgcacaatggtggcagcatgtgctaggcatggtgctcttgggtgcaaagcagggtgcaaagtgttgtgtactgggatgttggggcactcggctctagggtctgggataacaggtgacttcagtgggtttctttatgcatctcaacatgttctaatcctcctgtaatgagcagatatttcctgtaaacattttttgtaagttttaaatgctgttcctctgcaacctcatccacctgtccagtcatccattcagcaagcatttattgagcagttgaggtgcccaggcactacattctgcaatggggacccagcccatgaagaggtcataacccctacccttaaaaaactttgcctgtggccgggcacgtctgtcacgcctgtcatcccagcactttgggaggctgaggcaggcggatcacctgaggtcaggagttcgagaccagcctggtcaacatggaggaaccccgtctctactaaaaatggaaaaattagccgggtgtgatggcgcatgcttgtgattccagctacttgggaggctgaggcaggagaatcgcttgaatccgggaggttgaggttgcggtgagccaagattgcaccattgcactccagcctgggcaanaaaaacaaaactccgtctt

SEQ ID NO: 655956 - DNA, 402 bp, Homo sapiens
cagcctcctgggagagcaggacacacactgagggtacctctgaggacccagctggggtacaaatgtctttgactgctctcctgtcgcagtcagaagatgagtcagcacagccactgcagaagccggcaccatctctgcctgatcccgaccactgaaaagccacctggtgctgcaggtcaatgctcagcagaaggtccttctgccacggcctgagggaaacttaaaatgtacattgatcagcttttctagttaccttcagcaaaaggaccattccagctccttagcacatcattactagaagcaggagtccctccatgctgtatccttacccactcctttattttcaaattcccatctccttctgtgcacaaaatacatgtgtttctcttttgatccagcaaa

SEQ ID NO: 655957 - DNA, 198 bp, Homo sapiens
ttggctgctttgtttctccaaagagatgcaatattcagagtgactgagccccggcgcttatgtcgccaaagtacacgatgcatagtcatccccggtctggggtctccaatggccgtgatacactagtgatcatgttcagccctgcttccacctgcatagaatcttttcttctcagacagggacagtgcggcctcaaca

SEQ ID NO: 655958 - DNA, 843 bp, Homo sapiens
gcacaggggatcctctgtccaccctccctcgagctcagaggcgccctgcagaaggtggtgccagcactgccaccgaactgagaaaggcacagagtacaagcgcctgcagccacagctcaccgccacagactccagggcggggcctctcctatccaccaccgccctctccagacaccaagggcagacaaagggcaagtcaaaccataaagctgggggcacgccctgcaagccatgcacaatggtggcagcatgtgctaggcatggtgctcttgggtgcaaagcagggtgcaaagtgttgtgtactgggatgttggggcactcggctctagggtctgggataacaggtgacttcagtgggtttctttatgcatctcaacatgttctaatcctcctgtaatgagcagatatttcctgtaaacattttttgtaagttttaaatgctgttcctctgcaacctcatccacctgtccagtcatccattcagcaagcatttattgagcagttgaggtgcccaggcactacattctgcaatggggacccagcccatgaagaggtcataacccctacccttaaaaaactttgcctgtggccgggcacgtctgtcacgcctgtcatcccagcactttgggaggctgaggcaggcggatcacctgaggtcaggagttcgagtgatctacccgccttggcctcccaaaatgctggaattacaggtttgagccactgcacccagccaagctgcatttactgaacacctgctatgtgcctgaaactgcacccaaggctcaccattcatgacccactcagtcctctgagggcccatcaggggaggggcaggagggatgc

SEQ ID NO: 655959 - DNA, 246 bp, Homo sapiens
ggtactccctcccccatttggttaattttttaaattttttgtaggggcaaggtctccctatgttgctcaagctgggaaacccagtgagcccttgtcccaaaaaaaaaaaaaaaaatagcccggtgttgtggcccatgctcaggagggttaggcaggaaaaccgcctgactcccggagtttgaggctgcagtgagctatgactgcccccctgccctccagcctggatgtcagagtgagcccttgtca

SEQ ID NO: 655960 - DNA, 176 bp, Homo sapiens
ctatattgtcatcatatacatgatatgcattctgcactggtcctcttcaaagaattatttacaattctctcaactctgaatatgtgtggagtaaatgaatataccaatcctttgttgcattgggaggcagagacttgaggatggttatgtgtttgtgtgtgtgtgatagcttggag

SEQ ID NO: 655961 - DNA, 441 bp, Homo sapiens
  misc_feature (163)..(163): n is a, c, g, or t
  misc_feature (217)..(217): n is a, c, g, or t
  misc_feature (365)..(365): n is a, c, g, or t
gccagttggtaccgtcctgccacagtaacttgccactttaaaatgtccaatggaactgtgtagtatttcaaaagcacacacatgccacaattttcctttcccaatggaggagacagatgaatactggttttttcaaaagtgtgatatcgatggatacctggtntcacgcctgcaatctcagtattttgggaggccaaggcgggagaattgcttgagncccaggagttcgaggcctgcctgggcaacatagaaagactgccccccgctacaaaaaaattaaaaaattggccggacgtgatagcaggcacctgtggtcccagctgctgtggaggccaaggtgggaggatcgctggagtgcaggagtncaaggctgcagtgagctatgactgtgccactgcagccttgggtgacagagtgagacccaatctcttaaaaaaaaaa

SEQ ID NO: 655962 - DNA, 203 bp, Homo sapiens
gcttacgctagtatgttgcaatgcctacactatgaaatcaccaggaaattggagcctgaatgtggccacattatgtgcagtgctccaatgtgaggcagggactaataccactgatgcaaatcttgccaaagataattaatggccaatgttcacccttgacagggagccaagccagatctcatccatctagggcactccatggg

SEQ ID NO: 655963 - DNA, 127 bp, Homo sapiens
gcatcacagtcttctggttgcagtgatggcatggactgtggtcatgagtccttcacgataccaaagttgtatagataccttggccaggtgtgctaagcagttggtggtgcaggaggcattgctgatg

SEQ ID NO: 655964 - DNA, 338 bp, Homo sapiens
cggctttggttgagtcccttccccctccgaccctcaggataggaacggccccggcggagcctggcttggttgaggcagcggctgcgccttcttcatggcatacagtgggcccctgaggttccaggtcctttgcggcggcgatctggagggcgtgggtacaggacccgggatgccattcagttactgatcttaaatggtttcgtcctgacccgtctcaactacccttgctcctgcggccgccatgggggttttgcttttacatatgcgggccatgtagcagttaagaaaaatggtgtttcagacaaaatatgaaataaaatgttataaaatgtaaaaaa

SEQ ID NO: 655965 - DNA, 676 bp, Homo sapiens
gctcagcttctcaccacgtgcctgggaatatcctggtgcccatggcagctctcaccagggctgggggagcctccgcccccacaggaggccaactccgtgtatacatgtgttggggacgggtggaccatgtcgagcagctgtgaccgtcacatgggctgacgaggcctagctgagccacgtgctctgaaggtgagactacatgtgctgctgctcctcgaggtcggaaattattgagcctgacagcactaggcggcagggggtggaggtggtgaggatgccccccagaggcaccgggcggaggggacccgcacgagctgacgctgccaaaacgagtgtggcccacaggctgaacggctacgcccgagcttccatgtcgctgtggaccactcgggggaccgtaggtggcatggggcctgcgcgtatggatctcgtccatgaatccctaatggaatagagcgttcgcaaccagccagcgggcggagtacccagcgaaccgccaaggtgcccgagccaggggtagcgacaacaggcaccaatgccgtcgacaccgagcaccggctctaacgcacgacgatgggactccctggatgcggaagaacaccaaggatatgcagacgcggaacttcgagaacgtgatgcacacccggaaacggccatgcaaaactctaacagaact

SEQ ID NO: 655966 - DNA, 283 bp, Homo sapiens
taaatagcagaaaggagcctgacggacaggagcctaaacagccaggaggaagaagaagtcattgtcacggaggtaagccgcccctccaggaactggagggcacacagcacttgcaacaaacttgggacttagcagaaaatactctgtcatactgcctggtgatgaataggtgttaaccagcaaaaacaatcaattggttaacaaaaggaagtatatatctgaccatttggataccccctatacttagaccttgaagtaatgttcccttttactaatctggcac

SEQ ID NO: 655967 - DNA, 378 bp, Homo sapiens
gtggctgcaaagtgttgttctaagtgatttgcatgtataaagtcatttaatcctgacaactccattagatttttattgtaaattaggacttatcattaatttgtaaccataataatcctggtttggaaagtgggggaacctccaccagaatatatataattattggtctagaggactctagatagagagcacagggctctggggtattgatgtgaaagatagcccggcccccagagtctacattctcattcctctgctctcatacactgctatatccctagtgctcagcccagagcccaagagttgggctacactaagtgtgcatagaagtgcatacctaatagccattattatgagatggagtgccaaaatcagtca

SEQ ID NO: 655968 - DNA, 430 bp, Homo sapiens
  misc_feature (100)..(100): n is a, c, g, or t
cgctgtacgaattttcacgaggagagagagagagagagagagagagagagagagagacttttggtgccacacagagactctagtgtgcgcctctccacanatatgtggaaagagactttccagcgtgggcacgtagctcgcctgtgcccgagatttcccaaagctgtgtttgcacaagtttccacagtttatgacagatctttcccacaggcacaccgaatgcttcccttgagaaccgcttgaatgttctgatgaccgggcggaccttgtccaatatatctcgggaaataaagattccatctcccttttaccgtgagaatgctgagaaaaacctctgtgtggaatcccactcgattgcccaatcggtgatgagatgccctccgcctttccctcattaactgctgattttgttgttaagttgtgttttccc

SEQ ID NO: 655969 - DNA, 105 bp, Homo sapiens
  misc_feature (10)..(10): n is a, c, g, or t
ccacctgatngtccaccgctccaatcctggcgacagagcagactctgtctcacaaaaaaaaaaaaggatttttttagatgtccccacttaataccaaattctagg

SEQ ID NO: 655970 - DNA, 1222 bp, Homo sapiens
  misc_feature (317)..(317): n is a, c, g, or t
tcctgggtccacacaaaaatgtttatttggatgataacaaaacaatacagttagtgttagactccacccacaaagagcaaagggaatgtgaaaaatttgtgttacaatgtgctacattagaaaaaacaagactattttacgtggtgacacacttattattattctccataaaatataagtgctctactaaaatttacctcaattatattgtgaacatctcataccatgtagaacaaacaaggatgtgttctaatatagcgcgacacaagagtgtgcccttacacatattacaacaccattgtggtacttttgtgcangcacccacatgtataccacctatagcatgaggacacacattgtgtgcctacaaaaatgtggcatgtgacattttgtctctctgtttctaatctgtgtggttttctcacgacgtctcgtgtggcacttcgagagaaaacaatttctctttactatcttcccccacagccgggggagcataggggcgaagagaaacacatctctcagcgagtttatacaaaaatcatttcaaggttttcaaccaacaaaatatatctataagccactttacacccctttctcccaacaagatttatagccactgcgggggcatagtgagcgtctctcgcactatgtgtgagcctgtgggccaaaaacgggtgaactacattttacggaacagcacgatcatcaacaaacgctacaacttatcccaccaggtgacaatgtgtgaacagcacagttattaaacatcccacacatagttcatatgtggccaccaataatataccctatatccaacgacaactcatatcatctcgacaatataaaattattctcccataaaatactcaacactggcataccaaattgacccattaatacaccccccaatttttaaaacacatattaaacctacaacgcccacatcttcaacagacattttattaaaaaaaaatatccaagtcgaagtacacatagcatgcactccacaccgcacatcagtacacagttgttgaccaacgaggtattacaccacaattttacagtagaagggccccaaaaacaaaacacacaactgcccccttccactctgagaaacaacactatatgttaggtcataactaaacccgccgccacaaacaatatgttcacgccgagatgactatacacacatgtcatgggcatgaatctataatcacaggac

SEQ ID NO: 655971 - DNA, 745 bp, Homo sapiens
ggctgtactggtctggagtttaggatggcgacacggagagaaagctgggacttgaggtgggaaccccggtctggctgtcggtaggggtgaggttccctggggaaacccgcggaaggcgaggtgcctggcctgccatgtaggggctctgttccaagcctgcagagcccaccgacctccctctccccggggcccatggcggtggctgtgcccccgggtcgggccgcaggctcaggctgggcctggaggccatgtggcgcgggacgcgcttttgtgctagagctttccattcatgcaccgaactgcgggtgacgtgttctatctcgtagagtggtctcctagcaggaggagcgagagagcccagcagcgatacggtggttttcgacccagctaggggccatggccgtacgattgggacgccctggggcaggccccccgacgcagtcaccactgacgcggcaccctgtgtgatctggtgctgtttggctctgcgtggtgggctggctggtgactgggtctcgccgcttgtgccacatgtgaccgcactggacacagagcgcggtagtgtgggaggcgtggacagggacccctggtgacttgcccccccgacggtctcagtagtcacacctgcacccgaatctctgaccgatagctgcaggttggcttggcctgggagggcggtatccacactcagcgacagctatggaagcatctacacattaaggctggaccccagtgacccgcacta

SEQ ID NO: 655972 - DNA, 1247 bp, Homo sapiens
  misc_feature (1247)..(1247): n is a, c, g, or t
gcaccgacctcgtaggccaagattgcatcaggctggaggagcagctggacaatcgagaccaaggagcgccaggcagtcctgcgaacaggtgcgtctggaccgagaagaaggctgaaggagtgtgctgtctgcatggtggactgtacgtagcggtaggaatcggcctgtatgcgagtacaacggtaccaaggaccgtacaagggcactctacccgacctgtaagacagctcgatgcggtcagcttggtaggagtgccgatagtaggaggcccaggcgggcgcaacgcgctcccgacgggagaactgtctagtcgctgagctggaggtacgcctactgcagacggccgatgctcgatgtaaccgtgaagtctagcttccctaagagaacaagctcaggcagctggggtacctgccgtctcgtcggtgccccggacgaatggcgccaggaaaggcggccgggcgatggctccgacgtaagagagtagatggcaaaagcgtgatgggggctgaggccgaagctgccgtgataagccttctgctcctgcagacttgagatggatggacagacagataccaacagggctccactttcccaagaagcccgaagtaaggccttctctgcaccgtacttggagggcacatgcctgtagaaccaatgccatcctattctgaggaatacaggacactgttacccaacaaggcccgatgaaacacatactagagctgtcgttagaaaagcgagtcagtgggacccatcatggggacatgacccggtgacgattgcctgggcgagggtcaaaaagaacgagttaccccgcggcgccacaagggggcaaggggcccaaggagacgcggggcacgaggtaagacccgagacaagacacttgtgaggcaacacgcggaggactgtcaagggtccccaatgacacgcccggaggaatgaggcacctgaagaagcagggagaacaagacaccctgaagcatgcgcaccctggaaagggggggcaacagaaaatatagacgccccaacaatggcgccagggccacaacagaacacgggcggtacatagtcgagcaaaaggagacgaacaatcaagcatagtaagcgccaccaaacggtcagaagaccacacatcaccatactacactatagcaaaagggcggtactaaaaacgaacgtaagatcaggaagaagaacagaagaacaacgaagaagaagtacgacagagattgtaacgcggcagaagn

SEQ ID NO: 655973 - DNA, 463 bp, Homo sapiens
agcggggttgctgggtcgaccacggagagaaagccgggacttgaggtggtctcctagcaggaggagcgagagagcccagcagcgatacggtggttttcgacccagctaggggccatggccgtacgattgggacgccctggggcaggccccccgacgcagtcaccactgacgcggcaccctgtgtgatctggtgctgtttggctctgcgtggtgggctggctggtgactgggtctcgccgcttgtgccacatgtgaccgcactggacacagagcgcggtagtgtgggaggcgtggacagggacccctggtgacttgcccccccgacggtctcagtagtcacacctgcacccgaatctctgaccgatagctgcaggttggcttggcctgggagggcggtatccacactcagcgacagctatggaagcatctacacattaaggctggaccccagtgacccgcacta

SEQ ID NO: 655974 - DNA, 154 bp, Homo sapiens
acgcctcgttaacactgcgctctcacacccagatccgccacccctgcgattcgtctaccttatcaaccacgaccccattgacctcatcagggcctgaggcttgcctaagatcacaccactagtgaggagtggtggcaggactcgtgggccctct

SEQ ID NO: 655975 - DNA, 285 bp, Homo sapiens
actgtaccttggtttctacctttattcctagaacctgaacaacaaaaagtgaaatgagttaagacgtgactccccggcagccccagctcccctgcgtggcaaggcccaccgcagtgcccaccttggtgctgaagtgctggcagatgttccggaggatgtctgactctaccttggccagcaccagctcccgggggcccgggccgccagttgccatagcaaggacagagcatcttacttctcaatcgtctcattcacctaaaatttgagatgcatgattttgaaact

SEQ ID NO: 655976 - DNA, 763 bp, Homo sapiens
cccctaggatacctctctctctttcagcgcgtgggcccccccggcctggtttagaccagactgcccccccttggtcctctcgattccgccgccacgggtggtccctgttgcgcccgcgtcgcgcccatgtctccattccacagggccgtctacttgccccccactaatgaggcctcttaatccccaccgagcttctcccaatttttttccgcgtacaccccttttggcctcaactccttacgccccccaagacaccgactgtccacacaatcattaattatctcctcggcgggcaataattgcaaactattgtcttctccaccacaccaacactgttgtcggccgctcacattccgcggataatccccccagcctctatattcctggtgtatcccccgacatgcacaaacacccaccaccagcagaacacaccctcatcatccatctgtagggatcacaatcaatttgtcgtaaacacaccgctgtaaagtttataaaaccttacgctagtattgaaggacagcacttcccttgtcagaagcccaaagtatccttcatatctacaggatgaaaccctccccacgaatctctggtggaactataattggataagcccccccccctcccaccaccctatcgctgatgaaaccccatgaacattcacatatcagcaacccaacaatggaagaaggatcctcaacccccccccaacggggtttcaacccacccccgcggccccccagcaattttttccaaaaaaaaa

SEQ ID NO: 655977 - DNA, 881 bp, Homo sapiens
  misc_feature (537)..(537): n is a, c, g, or t
  misc_feature (816)..(816): n is a, c, g, or t
attcatcctatacccagttggtattccttgtcgaaatagcttctcggaagtcctcgattacaaaccctatccgatcagtttagttatttgaatgcatacatttagagcttagcatgtaatgagggttagagaatggcttgtgagacttgaagtgagcagtgtagattactctattggaatattagctagcttggaaaaaaaaaagaaaacacattatgcttatcattagttctcgcttcggggcaacagcgaaatgctaaatgaatgcttgtcatatatatgcatggaaaaagatgaaacagtatatatatattggcgatgaatggtgtctgtgatggagaacgcaaaataggtgaagtaatggcaagatgagtgccatatgaatagagataagggtacttggaagatgaatagaccatgctttgcaggctaggtgacgcataggcaatgttcgtatcatggtttcgtagtcgcaacgttgactctcctgtacattacatagaggaagatagatacggacaaacattgctattactncatataccctaccatacagacggggaacaagatgaacaacatggacatgaaaaaagactcctactaaggttccgtcgatcctccagaccagtcacctcccctatcaacccggtcgtttccccattccccgtcccgatacgttgaagttttccacggacacggtcaactggaatttccgccaaagccatcgttgtccgagcggctcacagcaaaaggttagggcaaacccatggcaaactatagaccataagcgacagcgcgtcttgacgagaccttganacgccaactcaaaagagagacaacaacacaaagaccaagaggggggcaggcgcccggggttccat

SEQ ID NO: 655978 - DNA, 900 bp, Homo sapiens
cctggccgcatcggcttttatttttttatggaagataattttctctcattataaatttgcttaatgggggaatagtatataatatgtatgtcacctatccttgcatacattgaaaatattttagcttagaagtttgtagcatagaattcaatacttctttataccataccaattatttcttctttgagaccttgacacagtaaggtttatattctaagtgtatttttagcaattaaatatcaaagccaacccaattagtctaatacaggagactcgttcaatcacatgtttatgtttttctctctatgaaaaagaatctaaattggccttttttcactatgcagcagaactgtgtttctggacctctaccagtttgtcagctgagcagttctggctgcagcttgtctgttgatggatagcacagcccctctatctgagtgctcagcagagtgcttgtgaaggcagcaccacagcaacagttgctcagagcgaacggattcaggagcctcaatttagcaatagagtccagggttttcagctcagtgtctttagcctgtctctgctggtcatgtcagttatgttctattcaatccaggaggtgctgtttacgttgtagtacatatatagtcattgcctggttttgggaagctgaggcaagaggatcgcttgagccccagagtttgaaaccagccagagcaatatggtgagacccggtcttgtaattcccaaccacttgggaagctgaaacagggtgaatcaattgaattcaaggagggaaaaggtgcacccagccgaaatccttccttgcacttgggctgtaccgggggtaataaaaaaagtactggaccttagttccaaactgttggtagaaagcttgctgcttaccaattaactggaaag

SEQ ID NO: 655979 - DNA, 242 bp, Homo sapiens
ttcgacggtgacctccagagattatctccagatgaagaagctagccttctgaacctcgcctgacagcagcctctcggccaagtcactcaggtcatgggcatagttcaagcctgagttggcagtcgctcttgcacacctttagaggacgggctgactccaagtgcacggtgtgcggcatctttaactggcctccattcaacaggaaactgactcgcctgcgaacctatgagggtaccgagctc

SEQ ID NO: 655980 - DNA, 1057 bp, Homo sapiens
  misc_feature (30)..(30): n is a, c, g, or t
tcctggtgatattgttgacccactgctgtnctgcccactgctgttctgaaaaatgaaaaaaaaaaaaaataaaatagtggaggtgaaaaataaataaagaaaaatgaaagaagagagataaaagaggatgatgaattagaaataaatataggtgtgaaaataaatgtggtgtacagtatattaggatgtgagcatcgatatatttataagtaggcagaaatggcaaacagtgaaacaggtgttattattagacaaatgcagtggtttatttgttttatcacacggtgctatagatatgtgcggaatttttgtgtgggcaggtgtaacgctgtgggctctctgtgcgtgcgagcgctgtgccccccttccaggtgtgcgcgccctctctctctctctctctcgcggcccgccgcttctccgccccccctctctctttcggcggcctctcgcccttctcccacccgccgcgccccccccccgctgtgtctctctacagcgcgcgcgggtaccaccccccctgcgcccctcggctcatcatgtgcccctctcttgccttgctgccgcgtgcgccgcggcgcgctgtctctcgtgtcgctctttctgccgtgtcgccgcatcctgtgcagcctgctctctcctgcgcgcaccacgcgttctctcttctgctcctcccttgggcgcgcgtcctttctgcgcgcgtcgtcccactcccccgcgcccgtctcccacgcctcgcgcctccccgcgcgcgtctgcgttctacgccctatccgatcctacctattacacgcagcatggctgtcgactcatcctgacggactgcggccagctcggagcagcctacccactcctccagtgggagccgtgcagcgtcccacaccgccgcgggcgccgtcatcactcccgctgtcgtgcctcctctccgccgatccgccctcacccccacctcgcatcagcagccacttcgtaaccggtcagcatacacaaaagaacagacccgagtgcagctaagcagctagtaaacatggcgtgccgatcactgacctccacgctacac

SEQ ID NO: 655981 - DNA, 1000 bp, Homo sapiens
ggcagcggtccggcgcgaccccgaggcggcgccggctccgccgctcggcccgggccccggcccccggtctcgagctccccgccgctgttggcccttcaaagcaaccctgacggctgaagaaccagggcccagccccgcgggagacaggctggggggcgagacctgggtgggttggcacgcaagatttgcttggggggcacagtgaacccctttgggagaaccagctgacagcctgaggagaagccaatagtttggaacacgagagttggagacgcaagactcacgggttgtccagaggaggtgggcagcaggtaccgacccccccgcgtgagggggggctccacaattctatccaaacggcgggggtacaacggtaacttggccgagaagccgcgttcacaaagtggcaaactgggctataaagcccccggtgtgttgtttcccagccacgtccctgtttggggcaggcaccttttttgtacatgaccgagctgcgactagattttcaccacgcctcataatgaattcccagagaaattgtcacgtgtgacccgtgtcttaaccttacccttgaacacgcggtgtgcacgtggatttggggaggggccttctagaggaccccagagagtatattatatgctgcaggcacctcatctctcactttatgggcttgctcaagataaaaattatcacttctcttgccgtacttttttggcccatattgagcttgccccactgaagcggcagctggtcaacataattgcactgggcgcaacgtcgtcctctcgagcagtgactcccggaggagtgcaagtgatccgatagggcagccgagaatgtttacccttctaacaccatggggaagatgtgttgtaccgcgagtgccatacaggggatgtgttggcacactccatcgtgtacagcaagcgcgtcacattacttttcctgtggagatccacaccaacacttaagtgttgtctctttttgggcccacatatgc

SEQ ID NO: 655982 - DNA, 988 bp, Homo sapiens
gacttcctctcaagcttggggttcgtatggtggggttacacgcgggttcaatatgcgtatcgaaaagtgtcatctctgttcgaggcccatctatcctgtacactggctatgatgtttcgtccgctataggattgcctaacggtgctttttccagagtattttcgcaacaatctaatagatgttcaattatataacacttatcaagatataaggtaacgtcgaccatactctctcggcttaaagtgtatgggtgggaccatggcagttccgtgaaagcagctaggatacacgaggctaatagcagtgcgactacattcagtttgagatgttgataacataccgtagtaaatgagccttatgagataagcagggagagctatggaataaaactatatagtagtggccgatagtagtgagatgttgaaaggagaattaaatagaagtaagacagcctacagctcatagatttataattggaaagagatagaaggataaaatattggagacttacgggtagataggtttacaagggatactcaaaaagatacgtctaagctaaaagatcgctatcttatccgagctcgtcttgctggcaatgggggaaaacagttggatggagaaaatgggtacagacagtatacgatgaggtagtgtgggaccaatgggtaaaggatggctcctttaaatagaaatctctgttaaccagtttcgtttttatgttaacattttgaaagatgggcccttgtgagaataactttgggaaacttggcttaaaactttatttaaattctttttaacatttagtgtccacttaatgttgaaaaaggggaattaaagggagacattctttgccctgaaatttgtcatcgaaacataatatcggactattacgggattggttgattggcattcatcagggggtaagatctttttactgagtagaatgttttgtagtagaactccatgcaaaagtttaacttgtaactaa

SEQ ID NO: 655983 - DNA, 516 bp, Homo sapiens
  misc_feature (12)..(12): n is a, c, g, or t
gtacttatctanaatgcctattctttgaagataggagggaggagagtgatttaggcatgccatgttgaactataaaggaataatacaggccgggcgaggtgggtcacgcctgtaatcccagcgggaggctgaggcaggtggatcatttgaggtcaggagttcaagaccagcctggccaacatggtgaaactccgtctctactaaaaatacaaaaaaaattagctgggtgtggtggcacatgcctgtaatcctagctactagggaggctgaggcaggaggatcatttgaccctgggagacaaaggttgcagtgagctgagatagatcacgccacttcactccagcctgggtgacagagtgagactctgtctttaaataaaaaaaaaaaaaaaaaaaaagaggactagtatggtcctggctggagccgtggccctgtttggcaattttgaggtaaatgcagctggaatagttttcagttcaacccttggcaaaccttcagtgtttccaaaaaaaaaaa

SEQ ID NO: 655984 - DNA, 165 bp, Homo sapiens
ccaggttagacaacccaggtagccaggtagccggtaacctaacccaggtagaggcttactagaagctgtgaaaacgctacagcttggattaaggcgacagcgatttctaggatagtcggtagaattagaattgtgaagacgataagtgtagagggaaggttaatg

SEQ ID NO: 655985 - DNA, 153 bp, Homo sapiens
gtgtggctccatcgcggggtggcctggggagcagctgcatgggtggcactgtgtggagggtctcccagctccctcactggtgttcgggctggtgcggcagctggtggacttgtgcattcagccgtcttccctgtcccaatcgaccagtgtatc

SEQ ID NO: 655986 - DNA, 308 bp, Homo sapiens
taaaagccccccccttttttttttaggggaaggggccggtttttttcccagtccccccagggggggggaaagcattggttttggggaaatttaggaaagccaaattttttttatttttgccccaaaaccttttttttttggtttttttttgaaggagggggcttgggggcccccctttcccctttttttttcccccactttggagggttgaggggttttggttttcctgggggggggggggggggggcgggggtttcctggtccttggttttgggcccgttggataaaagggggcccctttaaaatta

SEQ ID NO: 655987 - DNA, 128 bp, Homo sapiens
cgatggatcccgtcctgcttggactatgtgagatacattcttcgtagtttttttgagatggagtctcactctgttgcccaggttggagtacagtggcacaattagctcactgcagcctcgaactcctg

SEQ ID NO: 655988 - DNA, 215 bp, Homo sapiens
  misc_feature (151)..(151): n is a, c, g, or t
gggggggcggggggactcctcccaagatcacattttagcatttttttttcctaccccctttagaaaaaaaagtaacaggtgaaatggggtttcagggttaacgggaaaattttggccccggctcccccccgatgattttgaaaaacacaantgaacgggcttgggggggtcctttttatccgggagggggtttttttggggagcaattccttgat

SEQ ID NO: 655989 - DNA, 1403 bp, Homo sapiens
acccgtggtgctggcgtcgcgacgcgctttactagtaggtttgcgctccggtatgagtgtagtcgcctcctgcgtgcctcgatagccggctgtggtcctccgatcgacccgccttctgctcgtatcaagatcgggtagtcctgttgtggatttgcacctgcgcggctctgtccgcggtctctcgcttcctctcggcgtggctccaaatggttgtgcgctgctgcaaaacgccatgcgttcgtggatgggctctacctcgctttgtgtcaactggctaaaccacataatcggcttctttccttctttccgtaaatagcctagtctgtggttcgccgttcgtgtcgtgggactgggggtcggtcgtctggccgaccccgtacgccccggtttctctgtaactcgtccgtttcctgacgtcttccttcttgagtctcctgttcatgcgtagcgcggtggtaccctcgtttgatgccaatatgtgtggtatggccgttgtcctgctggtgcactattccctgggttctccgggtccgccgttctttctgcctggggttcatgtcgctgcgcgttgttctgagggacgtggcccccttcttcgcgtgataccttgggtgccatagttgcctctttgcctgctatgttattgttcggcgtctcgtcccccttttccttgtactcttaggtcggtgggaatcgctttgcgacccatggttagtcgcttgctacggaattgtcgcttgcgtaagcctcttcaatcgtcctcctttttcttgggtcctcattgctttgtgtatatggtcccactttggtcaggctccctttccttcgggaattcccatggactcctgggactctttctccccactcggtcgttggaggtgactctcatcgaggcgtaggatactttgcgcttgcaatataatgtgtcacgtagcttatacgccttgacggggtctgtccttgtagtggctcagcctctgtagagtccatgtccgctagtaagtctccatcatgtgtctggggtgagtgtttcgtccactagaccagttcacaccggagaggcgacagactatggacctccgcctcaataggcgttcatgcctggcgctcgtgtcactgggactggtcttgggtgtaccgtccgtctggacccggataggactcctacggatgctggatgctgcctcctgcccaccggtgaccgtcggaggacggactgcgtcggccctctacactgtgcttgaggcctggaaccgttcgcacaccggcatgccccagtcaggccgttttagcagagcttttacttgggcgcccgccgtgctctggcgcagaacatctggaatgcatatactacattatgtgctgtgtttttgattcttggatataacccggggtcacgtaag

SEQ ID NO: 655990 - DNA, 123 bp, Homo sapiens
  misc_feature (32)..(32): n is a, c, g, or t
tatttgggggcttcccttatctttaaaatcancacaggaaacaaaaaggacccactctgagagttcatgatgaaggtgtttaagaatcacattaatccccagtaaaggccagtcgatgcacat

SEQ ID NO: 655991 - DNA, 1287 bp, Homo sapiens
  misc_feature (972)..(972): n is a, c, g, or t
ccattggctgtgttccccgtgccaccgggggggcctcggggggccccttggtggccccctcggagttggggggacccccggggtgggtttccccccgggaggtttctccgcccatgggtatcatccccgaggctccccggggtttcgctcgtgcctgttgacacggggcccagggcggcacagaagccgccggggagcttctctgtgaggctcaagcccctcgaggtaataaaggagtgtgggatgcccccgtcgccacccaaaggttgggccccgcttgggttcaaaagggacaaattgaaagagatcctcaaactccccctgggaggggggaattctaagttctcgtgttctcgcgcctgcccccaacttataggggattccagaggaatcccattgagtgtctttcccttggggggcccctcttctcaaagggaatgagatttttgaagaaatttaagcccacgtcgccagaaagccagacgcccgttgccggggcctagcgtgcaacacaaggggttctaaaggccattttgttgtctaatcgggggagacaaacaaatgggcgcaacgtccggtcttggggtgttataagtgcgtccccaaaaggagaggtgggcccccccgcacacataccgctggggggcccacatacacatacacctgggcacacacagactctgttccacatctggtccccactggtggcgacacagaaggcgtatcctggggggggaacacacagagatctgggcacaagcccccaccacgcggggccccctgtggcacacagggtgaacacagagccccctgtccggcgtctctggtgcctggtgaaccgcgcgtcaaatccccggtgcacaccaccacagggggcacacactggcgacatctgtgttccgccacacactggtggccctataagagaagctgtctctacatgagatgggctgtgtatatcgagatgagacntggtaacacacctctaagacccgggggcgtgcacactggccacacccgtgggcacaacttctgcccaaaggccaccctcttgagagccacttttctaaaggcctacacgctaacctgagacccccgagaccttctggaaaggagactgtattcaccacagttctccctattcacggaggttcacctgagccacaccttcgtcaaaggagacccacacacacacacagaggtttccgtgcagcggactcaggcgtccagctgtggcgtacaaaatagggtttttataccaagaaaaataaagtgaattaagcgtga

SEQ ID NO: 655992 - DNA, 256 bp, Homo sapiens
gccacactcgtctcaagtcatgctcagtgtatatgattcccagtctctttttaccagaaaagaccctagaaaaatctattgaagacaaaaaaaaaaaaaaaaaaaaaaaaaaaaaaaggtggaaaagaaaccctaagggttagggcttaaaaaaggtgtgaggcctaataaagaattatacaggggcatccaagcagaggggattagtcctgaatttatcatgtggtatgcaggcacaccatttcaagggtgtccg

SEQ ID NO: 655993 - DNA, 165 bp, Homo sapiens
gatctagaggatcctccgtcgaggtaccaacagggaagtatattttgctgattcttttgaagaggaatctgtcaggtggattttatcaaagcaagaaagagatacggttgattaatattgcaaatatgatggaaagtgggaggtagaggaaatgaaggagtcaaa

SEQ ID NO: 655994 - DNA, 224 bp, Homo sapiens
gccagcatgcacacgatggctcgggtcgtcctctcatagtgtgcacatgtgccaacgcagagacggctgcaggtgagggcacaaagagacactgagctatggtgccgtcaataacacaacctacagctcccttccgggagctctgaagctacgatagactatgcccttagagatacctcgactagggcgtatgagggttgtgcctttctatcctggagccatcg

SEQ ID NO: 655995 - DNA, 357 bp, Homo sapiens
aaaggaacgcagctcctaaccagcaacagaacaaagctggatggagaatgactttgactaaatgggagaggaaggcttcagaagatcaaaccactccgagctaaaggaggaagtttgaacccatggcaaagaagttaagaactttgaaaaaaaattagatgaatggataactggaataatcaatgcagagaagtccttaaaggacctgatgaagctgaaaaccatagcatgagaactacgtgacgaaggcacaagcctcattaaccaatgcaatcaactggaagaaagggttttcaagggtggaaggttgaatgaatggaatggaacattgaggggaagttaggaaaaaaacacgac

SEQ ID NO: 655996 - DNA, 1257 bp, Homo sapiens
agcgggctggtaggacctcgaggctgaggctgccggggggctgtgggctaccgggccgccggcgcctcaggcgcatgcttattactcatgggctccgtcactgatcggcggccgcacaggatgtaccggacctattgtccggaggcggtcgttcactgctgatgagcgagctgccgtgatgatagtcacgcgcggtgtcccgttcattccagctcacggtaacctccgtccgaccgtgctgcaccctggacgggccatcaagaagcttggcgctcgctcgcaaggactactgctaagcctcgagtaaataattctgtcgtgacgagcgaccgtctatgggcaaacccatagcctgtcctaagactgcctgtataggcggtcccccggtggtccctttggcgtcgcctcttagaaggatcggacagcaaagcctccaatccaggtgctagaagtcctcgaagggggcttagacaagcaaagttctggaaagcgccaggaatcgaccattgtagtatctacgggtgtctcctctcggccaggtggctcgcatggtggacaccatgtgcatcgttcgcataataggccctttgtggttatgaaccatccatgggccgggcccttatttatccaaattcttcgaatcctcctttttggcgacccctgatggttggcggaccagcattctgtggggaagctcattaggcagccattgttccacaagtccctagcatatgcattgcaccagggagaggagaagccgttagcatctaaccccccgtggcaatcttccaaaaaggtaagctggggcccaaggaatttgaaggcaccgtagtttgaatcagcctcgtgtgggccttcccctcccggcctggcatcgtgccccagcaaggacctggtcggggttccgcactagcaccagagttggaaggaaaataaccttggttgcccctgtgcgttcgtaaccaatgaaccttccttccccgaatcctgcttggaaaagatgtcagtccattgaaaacctgtggggcttacggccccccgggcctgcatccatggggggacgcagacactcgccccgcggggactcgacactcccccttttggctgggagggccaggtcttctttttggcctgcccggaccccccacctttcccgaggctctgtatactaacgggccctgccgcgcttgtgtcttggcaccgttgtggtcctatgtcgtgtcaccacccggggtctgtgcaggccttgggggcgcc

SEQ ID NO: 655997 - DNA, 314 bp, Homo sapiens
agcagtcagtcgctcatccacttgatagaagcctatccgtgctggagtgcagtctgcgtcgtgactatggttagtggtgcccacctgcgtacaggctaagacagatgtggcacgtcagatcatatcctagcatctaccactatttcccagaacaggtgactctgattgttactcattccaatcaggccctacagcagttgtatgagactctcgtggcctttgacattcgttgagcgccatctactgcgtcttggtcatggagtagaaagagctggaaacagagaaagatttacgcaaggtatggaaaagtttat

SEQ ID NO: 655998 - DNA, 808 bp, Homo sapiens
gtagttccctgaaaatgtgtccttcgtacccataaagcagatcccaaatgcatttgtaacatttttgcattgcaatataaaacctttacagaaataattatctcatggacaaggtcaaagctcattgtttaaacaattcagtggcaaatcattttttccaattcatatttcaacatgcctcatcaacaattgtccttgccaggcaacattcatttcgcatcaagcagcaacaactcatttttcatttcatcaaactcattttggcaggcctcttgatccttttcaaaccaaaccaaaatcactcattagcatatgtatacatacacatttgttggatcattaatccatttggcctccatttgttcgacacatattcatttgcaacagaatcttcaaacttcttgtagttgccagcaatgattctccatctgtgccatatttttgcaattaacaatgtaacacaccccttcagaagactcaaataagcagccatctactatcccatgtgatggatgcacccaatgttgctcacacgtggactcttttccttctaaacatgatctttatgttctacaaaagttgaaatcccctttatctgtgttatatcttctacagcccataaaactgcatgtgatttgttatgttatacctcattcagaataatacttttcttcacattaaattcttccattggttggttctgacatctttcattaacaacaaatttattttctttaacaaaaagggaactttaccccaggtttcccagtggtctgttttgcgcttaacactctcttacattggggcc

SEQ ID NO: 655999 - DNA, 755 bp, Homo sapiens
atgacccacattgggcgtaataaaaattgttccctggggcaaaacgggccacccgtctgcggagccgtatgattaccccgttaaattgtgactcaaatccaactcagtatatagaatctacagttagaaatcaccaagagatgaggaaacagtcaagcccatggacccaccggaaactgatttgacagaacattctaccttaaaacagcagaaggcacaagtgcccatagttcattcataaccaaaatatattctgggtcataaaacaaactccaaagtttaaatcatttggaattattcagagtatcatctcagatcataatgcaattaaactagaaatcaatatcagaaacacaacagaaaaatatcgaaacccatggaaattaaacaacatacctttaaatatcccgtggaccaaagaggaagtctcaagggaaattagaaaatagaaatgagtaaaaataacaaatatggcataatgaagattgtagaactcagctaaaagactgcttagagagaaatttatagtattaagtgcttatattagaaaagaagaaagacctcagatcactaacctaagcttccacctttagaactggaaagcaaagagtaaaacagactcaaatcaagccaaattaaggaaataataaagtaaaaatcaatgaaattgaaaacctagaacagtagatgaaattagtgaaatcaaatctaattctgtgaaaatatttgtaaatgcattcaagactgacaaagtt

SEQ ID NO: 656000 - DNA, 348 bp, Homo sapiens
  misc_feature (249)..(249): n is a, c, g, or t
  misc_feature (254)..(254): n is a, c, g, or t
  misc_feature (305)..(305): n is a, c, g, or t
  misc_feature (315)..(315): n is a, c, g, or t
taaaaatttttattttttcattttatttcacacattgacattaaatttttatggacacataataacctgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggncaccngaacttattcctggggttctacatccgttaaggccaaccaagggattgggnaatattgggnaaaaaaaattgcgtctgtactggaacatgttca

SEQ ID NO: 656001 - DNA, 149 bp, Homo sapiens
  misc_feature (12)..(12): n is a, c, g, or t
gaattgggacgngcttacccctgaaggacatccttctgtaagcagcactaaaagcactctgagtcaagatgagtgggaaaccatctcaataaacacattttggataaaaaaaaaaaaaaaaaaaaaaaaaaaaaaaaaaaaaaaaaaaa

SEQ ID NO: 656002 - DNA, 551 bp, Homo sapiens
ggaccccggccccatgcacagtttatcgtgcgcagggtcactggtggatatgcggggtggctgtggtcgtcctagctcctcacagtatgcctacgcgatgcacagacacgatgcagtgtgcctttgcagaaacgaagtcaggcttcttcaagtcacaaagggaagggctggaacaactcgttgctctcagtcccatacaaggcatctgtctcacactttacaagctgtgagagacacatcagagcccgtgggcactgtcactgcttgcagcctgagtgtagtccctccttttctatctgtgagaagagcatgtcttgtgagatagcagaaaggagccagggccttaaggtcctagaggaacctcctagtcttggaccccagagaagtttccagaaatgtgtgactgcagacccagggcgcgatcaggaaacatgaagaaagcaggtgtgggtcctggaccaatagccctcctgaggtctgtcctcagggaccttcccctgtgacttgtgactgctgggatcaggtcccatcaccgccgtgatcaacgtgat

SEQ ID NO: 656003 - DNA, 573 bp, Homo sapiens
  misc_feature (447)..(447): n is a, c, g, or t
  misc_feature (480)..(480): n is a, c, g, or t
  misc_feature (522)..(522): n is a, c, g, or t
  misc_feature (545)..(545): n is a, c, g, or t
  misc_feature (553)..(553): n is a, c, g, or t
gactacttcaggtacctcatataagtacctacaataggtacttacaggaagcatgcaacattccatacaacattccaagtacctcatataagtacctactctaggtacttataggaaacatattttacctttgtgagtggcttctttagcagcataatctgttcaaggttcatccatggtgcagcatgtggtagaattgcctttcttttttaaggctgagtaatattccactgtgcgtacattccacagtttgtttatgcatgcaggcgtcagtgatcacttaggttgcttccatattttgactattgtgaataatgctgccatgaaccgtggatattcaagtacctgttccgagtccctgctttcccttcagggaaattcttatcacagattcacttccccagttcgctctcactctcttctctctccccttggagtgagaggtgnctgaaattgggtctggatacttggaatatttcncctgcatctcaagcctcagttggaacaagcactcagtatccnggtatacaacggaaaccatgaanggtgctangtgatcgcctgcaagtctga

SEQ ID NO: 656004 - DNA, 207 bp, Homo sapiens
agggtgagactcttttagtagaacatatgaaggggcatcgggagcccactgagatctatggaaaaaaaaacgaatatccccacataaacactataaagaatatgtctgtgaaactgcttggagatgagtgcattagtctcatagaattaaaactgtctttggattcaacaggtaagaaacactctatctctagaatctgtgaagggg

SEQ ID NO: 656005 - DNA, 392 bp, Homo sapiens
aacccggtcagccttcctgtgctggttaaagggtttttttccccccccctcccccttgggtgggaaaacaatggggacccggggaaaaaattcaaaaccccccccccccgggtggggtcccgggggtccttttttttttttaaaaagccccccctgggcaaaaacagggggggcccggggggggttttttttttttcccttttggattggggttttcccccccccccccccccaaaaagccttttccttttccccgggtaattagttggaggggcgggaaagcccccctccccggggtttttcggttgcccgggggtgtttggggggggccccctttttattttttcccgggcccccccctgggaattaagccccccccccccccctgggga

SEQ ID NO: 656006 - DNA, 305 bp, Homo sapiens
  misc_feature (119)..(119): n is a, c, g, or t
  misc_feature (147)..(147): n is a, c, g, or t
  misc_feature (161)..(161): n is a, c, g, or t
gtttgggaggctgaggtgggaagatcacttgaggccaggagttcaaggtttacagtgagcttgattgtgcctctgcactccagcttggatgacagagcaacaccctgtctctaaaaaanttttttttcttctaatcaaatgtatganctactgtatttganttttttattgtaaaaatagtctcacctggctgcggtgactcagcctgtaatcccagcactttgggaggtcaaggtgggtggttcacctaaggtcagtagttcaaaaccagcctggccaacatagtgaaaccccgtctctcctaa

SEQ ID NO: 656007 - DNA, 392 bp, Homo sapiens
  misc_feature (19)..(19): n is a, c, g, or t
  misc_feature (51)..(51): n is a, c, g, or t
  misc_feature (66)..(66): n is a, c, g, or t
  misc_feature (111)..(111): n is a, c, g, or t
  misc_feature (165)..(165): n is a, c, g, or t
  misc_feature (350)..(350): n is a, c, g, or t
cggccttgaatgtattcgngctttatcgagcatgaacccggacattgaggntgcggcagaaacacnggcggcgtacccggcgttgaccagcaccgaatggacatcgactcnaacgaccggatcgagatgcttgacggcgagcagcgccacgatttcagccctccncgctcagcgcccgccacgcaacgccgcgacctttctgctgagcgcgttacgccgccggtcctgcatgcccaactgcgacaccatccactcgaccaccatcggcagattgctgttcgcacgcatcggctcgtcgaccatcaaccccgcgtcgagcgcattgaacccggcctccaacgccatgcttncgctcccctgcgcgttcccagcacacggcactcatccgccag

SEQ ID NO: 656008 - DNA, 166 bp, Homo sapiens
gttattagcatgagaacatagctctttcatggttcccatagaccttctgaactacacagtgttgtgcgacctgcatggaaggcgtggggctgagtttaagctatagtatcagcagcagcactgagagagcttaattcttctattgaacagtttattaataggcgag

SEQ ID NO: 656009 - DNA, 150 bp, Homo sapiens
gaagtataattcaaaacacgtataatatgaacaactctaaaatcccatttctaattataaaagaaatctacattttctattcactcatacacagaaactgtgcctggctgttctcccttgttataaactgctttgcttgccctccctgtc

SEQ ID NO: 656010 - DNA, 342 bp, Homo sapiens
atgttctcttcaactgatcctcagggatagctgccatacaggttcatgcgattcatgcgacaacgtctcatgttcggggccaccaaatctgggtctgagcggaggcctttgaggtcatggagtgtgtagagcgtgatcgtatcgtttgctcatgatcagctttagcagatctatttgttctggctacagttcattcagtatagtgtggggtggagcagaagagttgatgatgatagatatccttcggtactcccgatccaaaatcttatagtagacaggcttcaaagcagaggcagtactggcgtcttcaacgacgaactgggcccgtgtattctcatagtg

SEQ ID NO: 656011 - DNA, 427 bp, Homo sapiens
gtatggtaggcacggtgaataacatgttccagggtgggctctgctcgttgtctgctctgtaacatacccctgcttccttgtcctgacctctcatttgctaaagtctgatttccagctttgaagtctctgctcaatctctccagccttctgctcatgtcttcacctcctaccttgcagcctgtcttttgacttgatgttgcttgactgcaattcctgtgacttggccttggggtccactcccatgaaatgcttctctggcagccttggcaggtgtgtcccagtgttcctgagttccagtgttcctggctgtgtccttgcaccagagcaggctgcttgagattagacacgctcctccctcctatcagtccaccttggctctgacactttcctcagcctccttttctttgtctgctggagcacagaaagt

SEQ ID NO: 656012 - DNA, 145 bp, Homo sapiens
tatgtcagaggcgtgaaatattccatgtctcccaggactcccattatagtgctgacgtaggctttgatgctcatgcggcgttctggagacttgtgtccacggtgaggtgaatggggttgggggcctctcggctgtagtactcgtg

SEQ ID NO: 656013 - DNA, 331 bp, Homo sapiens
actacatacttccgtctatatgagggggtgcaatcacagtttaaaacaaagattagaaaaggagtatctgccgcattctattggcaatagaaatcaaagggcattgtattagtccattctcatgctgctaataaagacatacttgagactgggtgatttataaaaaaaaagaggtttaatggactcacagttccacatggctggggaggcctcacaatcatgggggaaggcaaaggaggagcaaaggcatatcttacatgggggcaggcaagagagcacgtgcagaggaactgccctttataaaaccatcaggtctcggaagtatgtagtc

SEQ ID NO: 656014 - DNA, 1092 bp, Homo sapiens
  misc_feature (458)..(458): n is a, c, g, or t
  misc_feature (466)..(466): n is a, c, g, or t
  misc_feature (480)..(480): n is a, c, g, or t
  misc_feature (841)..(841): n is a, c, g, or t
  misc_feature (851)..(851): n is a, c, g, or t
  misc_feature (855)..(855): n is a, c, g, or t
  misc_feature (880)..(880): n is a, c, g, or t
  misc_feature (886)..(886): n is a, c, g, or t
  misc_feature (891)..(891): n is a, c, g, or t
  misc_feature (893)..(893): n is a, c, g, or t
  misc_feature (933)..(933): n is a, c, g, or t
  misc_feature (991)..(991): n is a, c, g, or t
  misc_feature (1023)..(1023): n is a, c, g, or t
atgacctcacagaagtgcattggggcctcgccaaaagcgcaagctttcaagcccccgagcgacactcgtctttccagggagatccgaaattccacttgacttccaggccctgcgaatcctctttggccccctgcttccgtcagcctcggcctcgacggctctgctcttggagcctgcctttcctttcactccaggcctggcagcacttctgcgggtgtaaacttctcacaccttgttggctttatgcagctcaccagtgccgaagccttcagacaggcgggtccgcagccctttcccggaggccccacctgtccctgtctgctgctgagatggttagttggatacacaggtcacacctcatgtctagcaaaccctggtccagccacacccttggccacgtctcagagctgcctggatagagcatttttcagatccccaagggctggtgcctttttgcntaatggtncctgcctcactgantgtttccctcttgcattctgctataagtagcaaggagaagccaggtggcaccttccacactgcttggaaatctcagcttgatgtccaggctcatcagctgcaggtcccacttcgcacccaacagcagagcagcagccagccaagctctctgctgcctcctccggttcccagtagcacggtcatttccatctgagacctcactggaagcacctgttgggtcggcattgctgccgacatccagtctgtgatgctgtgtgcattctccaagacggcggcagctctcctcttccagccatttccaggcttgtcttcatgcctttctaccagcagtcgtgcaggcctcaccagttcttccagcctntccccatcanccanttccaaagctgctgccacagttctnggtgtnaggtntnggcagcacccctcctggcccttcctggtaccaaaatctgntcgtttactgtggctgctgtaacaaagtgtcacaaactgggtggcttaaaaaacaganatagattgtcttagttttggaggctggaagtncaagatgaaagtactggcagccccgtttcctcttgacccctctaagagaactccgttgccccccaactt

SEQ ID NO: 656015 - DNA, 1589 bp, Homo sapiens
aaggtggatgatgagagtctgaaagagctattcagtcagttcggtacgaccctaagtgtcacggtgatgagagatcccaatgggaaatccaaaggctttggcttcgcgagctcacgaacaacacgaggcatgccacactaaggcatgtggcaagagactgcaactggacaacagaacactaacgcctggctaaccatcatactcacgctagcgcccgtgcaccacaaagcaaacgctagacacggccagagcacgagcttaacacactggcacacacttctgcacaccagctctgcacacactaggcacgcagcacacttcagctcggcactaactcccagggcgcgctgcacatcgctcgataccactctcaacgcacacctctgcgccactgcaccacgtcactctgcaactgctactgccagcacatacctctcacacgcgcaccaccagcacacctctcatctgcattccactatactacaggaaactccacacttctcaccgccacgactgcccttcaaacgcggctacacctggcatcgtgacacgggccaactcgcgcaaacggacacacgcccacacaacacaggggcctacacacgagccactaatccggactacactggccagtatacatatcaaacgtacatacccacatgacaaaaaaaaacacaggcccaaaccccgaacaaacggccaaccctccgacccctggacgaactagcacaaactggggcacccgacaaacttgtggcatgaaggcgcccatcaccgaaagcccagccaacacatgaacttaactggccttaacggagcccccccatgggggaccccccaacaggaaacgcaggcaaccaggcaggaaacacaggacacgccaccgcaaccaacacacggggggaccatacccaaccaccgagtgggcaacccccaccaaaccccacacacgcgcaacaacctaaagttggacacgcaaaacccacgcaaaaggagcatgggagcgacaatagggccggaaacaacttaggcaaaacacaaaagagccagcaccacacttacgaccacccagctgggaccacacacagcacactcgggaccgcccaacgtgcccgtcacgctaacgcgcaccacatcacaaacgagcacacacacgcacccaacaggagcgcacgcattgaggccatgacgaccgcacaggaaggacgcgcttcggcagggccactataagccacgattcacaataggggactagcgccacacccaagagacgccacacggcttcgccccccgatacgaaacggcgaggccccctaccacaagacgaggcgcgaacaaacgaggggccacccgtccaccacacgagctgaacacttctacacctatccacccaaccccaccgcttcagaacaccgccacagaggctcctccacacagcacacaaccacacacgccaccacttgaccaaccacggcaccaccctctacacacagcgactcacacaccacagcaaccaccgcgcagccacgcccaacaccccacaacacacgcctcacgtgcacgctacaacagaacaacaacgaccagat

SEQ ID NO: 656016 - DNA, 1013 bp, Homo sapiens
tcctgctcacatggctgagaaccctctgcatggtcctggtgaactgccatcatcaacagtgtgtaccccgtggaggactccacactgcatttgggctgctgccgggactgtgatgacgacaggctgtggatgtgtcccccctgctgcctgtgtgaaccatggccatctggctatgctgtgcacagtgcgctctgtgaggctgcctatcctggaacattaagaccattgctgagtgcctggcagatgagctcatcacatgctgcccaagggctcctacgaactccatatgccatcaaagaagaaggcacgagctggagcgtagtggcccagctccaaccgctgatattcccagcctgctgcatcaatcaaaccatgtctagccctattgggggcagtacccagcccacaacaaacaacaaaaaagaacaacaccaaaacacacccttctgcaccccggcaggcacagaacaactaacataatcataacacatcaacaccacaatcaccatcacatacccaacaaatataaaatcttatccccaaaagtcacaaaatacgtaaccccaaatacaaactcacttactccacactcaaactcatcaatcaaataacacctacacgaaaacaacagcacaccccaccgcgcggcagccacaccgcacctgcaagccatgtgaccacacacaaacacaacgaaatacgcaacgcgctaagcggagacccaccagaagaggagaatcaaccaacgcagagaatgcacaaaggacatacaacccaaaaccacaacactagaccccccacgacgcagagggcagccaaccacgaggacgaacgcggagcgggaaacggagcacgaaaggacgcgagcgacggcaaagcaacgaaaaagacacaaacagcagaggacgcgaacgagcacgccggaaaggagacacgaagccccgacaacaaggcgcaaaccacaagcaccaacgaaagcccgagccgcacacgcacaagacgaagagaaggaa

SEQ ID NO: 656017 - DNA, 1486 bp, Homo sapiens
  misc_feature (517)..(517): n is a, c, g, or t
  misc_feature (1236)..(1236): n is a, c, g, or t
cacacctgtcccacttctgggagcaagtggcatgagctgagttctgggtgaaaatagcagatcaccattcagaaagttcggagatgaaagtggtatcctcgcggaagagatccgggtctgagtaaaacaggaaggtgaagggaacaattcaataggaagtaagggagggagggggagttcagcgtccgtatcaggaaggaggttccagaggccacagtgggaaatgtttcatgaaagctggaaaggatgatgggagatgggatagaaaaggagtattatggtacatgaagcgtacggtgaatcagccatgtgggactggcctagagtgcgtggtacttgatgcagtgcaactgataggactattacacgtatgagtgtgctgatgtaggaattacgagctagactgcgcatggtcaacggtgcctgaggtgcggttaaggaaagggtaaatggatggggtagattgttggcgtggcaaaaagatcggtagggacacaatcttgggctattgagcgangtgtgctcccgcgtcacacctatctaagaagtagcgcgcacgagtaggtatctaatcgttcgctagcacctacggttcacactaatcgttattcgtccttctatctaggcaactaatacattgaacatctttctatgacaacatttgatcttgggttagaaaacgcggttatcgataacaagtgggatttctaaagtgtcccctgaggcaaaccatgtgtgtgcatttgaaacggtatgtcaggaggtaaatatcattgattcccataagaggtagagaaaaacaaaattttaaagatattgtggcccagaggttaaatattttctcttcaacagaattcagaaagagaggaaatttaaatcttcagtcgggaggtaccaaacaaatcaatggggatggggttgtgggggggaatgggcacacggttttgtactttatcgcgaatatatccaaggggttttcctggggtggctagagtggtgatatgaggtcttataacggtattaacctacattagttaacctttaccaacaatttatggcccgtgaggttttgaataggcgaaagggtaataattaaccatgttgggtatacgtgtattaaacaaggaacgagaatatgttatggtaaagacagaggtacccaaggatacagttagaagatagacaaaaaagggtgtaggaaagaggtatggtcatggaggagcaagaagtgcacgncactagctatggaaagtcgcaaagaaaattactagggggggttttacgatattccccatatgttttagtacacaagatttatcggtggcggatacattcttgtcacatacagggcgcatatagataacaagaaaattctttcgtagggataatccacttatagtcaacaagtggtgagcatattaatattttgaagattacgcaacaaaggaagggtagaagatagggagggtgtagactagggagtaaa

SEQ ID NO: 656018 - DNA, 162 bp, Homo sapiens
acctagaggattccgtggagtatgtcaatgagttagaacagttggatacaggagaagaaacagctggctccactactgacccaggcccagtgttcaatgtcctccgaagaatgaatgtctttccctggtgatggtcccctgtgcctgtctttcccagcatcc

SEQ ID NO: 656019 - DNA, 293 bp, Homo sapiens
ctctatcaactgtcatcataccctggcttctgattgtcatccacacaacaccaggacttaagaacaaatgggactgatgtcctcttgagctcttcatttattttgactgtgatttatttggagtgccaggcattgtttttaagcaaaaacatgtcatgtcaggttgtctaaaaataaaatgcatttaaactcatttgagagactgcctttaagtttaatgcatatttaaactacattgatcctgtagtgttcctggagaagctagagcctgattgtcggctactactcatcaa

SEQ ID NO: 656020 - DNA, 209 bp, Homo sapiens
acgtgggtggcgcaggcttagtaaccccgtggactgcaacgacaatcagtggatggtgctgtttatgcccaggtgtgagtcctctgtttgccctggacaaattccccccctgttttttttcatagggacatgaagtattgggtataaaaaaaaagataagattttacccccctccccaaaataaaaaccccaaatagtgctgtgttgga

SEQ ID NO: 656021 - DNA, 424 bp, Homo sapiens
agttaagcgtcaggagaaaaatgtatcgacagccaagtttttcttcaaaatattatgtgacagaatacgactcaattcacggtaaacaattcatagaatttttcaatgtgttcttgagatgccaaagttacggtgcgtgttcaatgacatcagtactattctggtaaaaggcactggtagagtcatctgagtgtagagaatgtcccttcactgctggaaaaatccactggctcccaagaaaagaaaatggtctgaagcctctgttgtggctctcacaactcatctttccctaagtcatcaagctccacatcactgaggtcgatgtcatcctccacgggaagctcgccatccctggcgtcccaaggctctctctcaacgatggtagggaaaagcccgcctcctacaggtgccgtggagccacgcc

SEQ ID NO: 656022 - DNA, 848 bp, Homo sapiens
gaacaagaagaacaagaagaagaagaagaagaagatggcagtggcacagtggctcatgtgtgtaatcccagcactttgggaggctgaggcaagagtattgcttgaagctaggatttccagactagcctgggcaacatggggagaccccatttctcccaattttattgtagtgttagagcagccattaacagtaggtaaaggggctgggtgtggtgcctcatgcctgtagtcccagcactttcagaggctgaggcaggcagattgcttgagctcagaaaattgagaccagcctgggcaacatggcaaaaccctgtctctacaaaaaatacaaagaaactagccgtgcatggtggtgcacacctgtagtcccaaatacttgggaggctgaggtgggaggatcgcttgaacccgggaggagaggttgcagtgagctgtgattgcaccatgcactgccatcctaagcaccaaattatttaaacacataaaaaccatcattagctcactggttgtacaaaaacaggccgtgggccagatttggctcacaggccatagtttgcccgcccctgctcaagcctaacaaaatggctgacacacctttagtagattttgcttcagaggaaaatccagttaggtggggtctgtaataccctaactcactgtctggacattaagaccttagacgcatgaatcaccctgtgttattgtagcgtgggaggcaagctgctcctgacctggtgcaaagaactgactgtgtgtgtactttgcttctcagatgctgtgcacagaacccgtgcagcaagaaacatctcagaaggttcaaagccccctagattttaccacagaagatg

SEQ ID NO: 656023 - DNA, 134 bp, Homo sapiens
gatgcgtatgcggtgcctttcctggaacgcctaccatatatctctcccaggcaaattcttccttctcattcaagattctctttatcttcttatactcaacctaaaataccaggtggaggtcagattccagattc

SEQ ID NO: 656024 - DNA, 437 bp, Homo sapiens
tttttaaggattgcagtttaaaactttaaaaactaaaatcattgccaaaattaatatgattattaatcacaggggtgcagaatttgattcactattaaaactatcacaaattatgataatctatgaggaggcctcgctataccaaaaatagttaaaatgctgacataacaccaaaccttattttttaaaaaatctgttgttccaaatgcgtataattttaaagcaattcctaaaccactttattataatggtttgcctgcttaaaaggtataaataaacttcttttctcttctacattgacacacaaaaatgtgtcaatgtaaacccaaaaccatcttttgcgtttatggccaatctattctcaaagttgtacagtaacggcgtttacctttatactatattcgggctatttaaatcctttctattctcactttttc

SEQ ID NO: 656025 - DNA, 910 bp, Homo sapiens
gaggcttgaggcagccagcgcaggcgcttctgctgagggggcaggcggagttgaggaacccgcagataagtttctcttggaaagatagagattatacactcttaaaaattatagtcaataggttcactaagatatggctatagcgtaaagtttaacacgtagtttcaatagctaaaagatttacagagaaccaattatgacgcttagaagagtccgcagtgaggcaagcacccgaatacacaggtttctacaaactatgcggaggtggagatgaaagcttcttcatggacgtaccacactgtctccccacagacaactggcgagaaaaggactacagagccccccgatataattaccaatagaaggggcactgcttttagattacatctgacgggtgacttaaaacagcttaaagttagttaaaaagtgtcaggtgactcaaaatacatgtgaaggcggatctttaaaaagagtattaacgcgaaggtgataaaaagaccttgaaatccatgacgcagggagaatggcgtcattaaaagctaataacgcatttattaaggcagacgacaattggcaccgattaattggcaggtggtaggaatggacccacttggccgaacgccttcgacgttggacgaggccacacgtgcaagcacgacagttcgcgaaggcgacgcaaagcattcgagcacgctgcgcaccaacacacaaacacaccaacaaaataaatttgcggggggccggcagaaaattataccaattgtgggggcgcagagataataaaagttgtaccgggtcacaagacaacgtgcgagtggggtctccaaaaaccggggccgggcgtgcaccaggttggctctgctctcgccaccccccgtcccgcggatcagaagagcaagagaaagaaaag

SEQ ID NO: 656026 - DNA, 197 bp, Homo sapiens
catcaggtgattggagttatcgattacagaacaggctcctctagagaggatatgcagcaccgcctgcatcttggattctgaggcagtggctcgcagatgatctgccaagcagtgattgcttgattgacctagttgacggtatagctgctaagcactagtgggggtatctaactcccagtcatgagtcattagctgat

SEQ ID NO: 656027 - DNA, 353 bp, Homo sapiens
  misc_feature (109)..(109): n is a, c, g, or t
tcgatacgacgttcagttcttatatttctttttttttttataatcaaacaacctgtttatttgggcttatgatttactaactgcaggtctatgtgcaggaaggccagcntccccccctgccgttgttaaccacaaccaaaaagaagccctagttgcaggtggagccaatgccacccacggcacacgggaaaaagacccattctgcagggctgctctcctgcccagggagatgccacgtgtgtctgtccggcagcttcatgaaaaagttaccaagcagctagggagggcttagatttgttggtgtccccaggcctctccctcggggggttgggggcatccccacagcccccaag

SEQ ID NO: 656028 - DNA, 87 bp, Homo sapiens
agtccaacctgagcgtccgagcgagactctatctcagaaaataagacagaatgaaaagagcccggcgagctggcgtagctgtaatcc

SEQ ID NO: 656029 - DNA, 210 bp, Homo sapiens
  misc_feature (30)..(31): n is a, c, g, or t
ataatatgtgcaggaataaagaaggggagnncagcatctcttctcttcacgcagtgcagggaaacccaactatgcacacatgctcaagcccagaaggcagaatcaagctttgctttccatagggcgctgggaggatatggaaacaaaagttgcagaggtgccatgttcagaatacaataataaagtggagtgaaagatatacttcaggca

SEQ ID NO: 656030 - DNA, 419 bp, Homo sapiens
agggtctttgtattcagggtagagaagagctcagtcagttatggtgaaggccattcataactcttccagatatcaccttctgttctgacaaaaggtgctatgtgaaatataataaatgttcaatttaagaaaatgttgagtagccttatttgcgtttctacaaaatagtacaacagcaatatattccacagggtaaaggaaataagtaaaattatcccagtagactgaataagaaggcttttcatgaacttgactatgttggaaccaagtgttaggggatcactagctgattccaatacatgaccagaattagaatactgatctagatgtttacattacctatttccctcttttcttttgagcagcagccagagatcactggttgatttacaggaataagtagagtcagtctaaatttc

SEQ ID NO: 656031 - DNA, 806 bp, Homo sapiens
  misc_feature (137)..(137): n is a, c, g, or t
  misc_feature (206)..(206): n is a, c, g, or t
  misc_feature (218)..(218): n is a, c, g, or t
  misc_feature (243)..(243): n is a, c, g, or t
  misc_feature (260)..(260): n is a, c, g, or t
  misc_feature (275)..(275): n is a, c, g, or t
  misc_feature (388)..(388): n is a, c, g, or t
  misc_feature (416)..(416): n is a, c, g, or t
  misc_feature (418)..(418): n is a, c, g, or t
  misc_feature (467)..(467): n is a, c, g, or t
  misc_feature (490)..(490): n is a, c, g, or t
  misc_feature (517)..(517): n is a, c, g, or t
  misc_feature (544)..(544): n is a, c, g, or t
  misc_feature (561)..(562): n is a, c, g, or t
  misc_feature (616)..(616): n is a, c, g, or t
  misc_feature (625)..(625): n is a, c, g, or t
  misc_feature (634)..(634): n is a, c, g, or t
  misc_feature (657)..(657): n is a, c, g, or t
  misc_feature (664)..(664): n is a, c, g, or t
  misc_feature (706)..(706): n is a, c, g, or t
  misc_feature (773)..(773): n is a, c, g, or t
ttagatggcagcttgtactgtcagaatcccgtgtatccatttgttcttctgttggagagatgagacatttgacccttagctccagttttcttctgatgtttccatcttccagaatccctcaaaaaacattgtttgcnaaatcctggtggcgaaatacttgcgagcccgaggtaattcgacgacatgcgtgccaacgctattcggangttccttgcacntttgtgaatttaaagtccacgtctnaaccgttcgcgcgtcgnaagtgaagagggaancccgtacgtggagtttcctagtgggcttctgcgaacttttgatcctcagctctgtggttttaaagaccacagtgtgacagttccctgccacacaccgcgcgcgtcgcgcgcgnccgaaccgcaccctttgaagaattcaananaagccgttaacgaccaatgcaacgtttggagcatttgcgtagagggggnggggggtggggggaaaagaaacnaattaatctgacacacatggtgctatntaattatttcaaattttatatttttgntgtgaaatgtttttgtnntttttatttatcaatgatttatagaaataagggaaatttattgtaaaatatacnttatgtccntactttctnagaaatgacacgtcgtgttcacntttgctnaaatttttcctcgttcacatggcacaaatgtatactgaatancctcctttccctcccttgctagagttctttgtgattgtactccaaagaattgtgccttgtgtttgcngcatctccattctctaaaataatataattgctt

SEQ ID NO: 656032 - DNA, 198 bp, Homo sapiens
cccctttttcccccccttttttttttccccccccccgggggggaaaagggggaaaatttttttcccccccggggggttttttttccccctttttttttggcggaaaccccggggggggaaccccccttttttttttttccccgggggggtttttttttaaggcccccccctttttttaaaaaggggggggggccttta

SEQ ID NO: 656033 - DNA, 414 bp, Homo sapiens
gaacattgttcatcatttcttaagcttaccacaacttaatttctttctcacattacgttgtgagctacccagggacatcatccttttaaagacttttcggttctgattcttcatctgagaaaactcatttaaagctccgagaatttaaagtctccccaaatggataacaaactggatgtcttcaggagggagttagtggatgttgaaggtatccctctcttttggagcattgctgagcattggtcccaagtagagtcatttgaagcccggcctgatgacattttgatctccacatatcccaaatctgggaacaacttgggtcagtgaaatactgggatttgatctacaacaatggggatgcagagaaattgtaaaagggatgcaatctacaaacgagtaccattcatggagctt

SEQ ID NO: 656034 - DNA, 229 bp, Homo sapiens
gctggtcgttcattgcattccataccattcagtctattctgttctattccattcgagtccacttcattccatgctaatccatttgagttcattccattccattccattctattctattctactctattcttctatgccctatgtagtctattctatctttctatgccctatgtagtcatgccattttattctttcttcttttaagtttggtctcgactcaggtggtgtg

SEQ ID NO: 656035 - DNA, 527 bp, Homo sapiens
ccccccccttaacttttgaaagccccccccccttaaacccaaggttttttttttaaaacaggggaatgttttttccccaaagggggggtttttgggaaaaaaattttttaaagggttccccatttaaaaacctttccaccctagggaagaaaaagaagggggtttttttttttgggctggtttttttttaaaatttgggcccccccccttttaagggggggtttcaaaggttttagggaaaaacccaaaagtttggccctttttgcccttgaaaagaaaaaatttccgcccttggtttttttaagaaacaaaaagggggcgccctttttaaaaaaaaaaaagaccccggggccccaaagggtttgtttgtttggagccccaaagggcccccagttttttggaggctttggttcccaaaaaaactttcaattaatttttttttgaaacaaaggaaaaaccgggttccgggggttttttttccccggcccaaaatttcaaacccttaaaaaaaaggttgtttttcccca

SEQ ID NO: 656036 - DNA, 1129 bp, Homo sapiens
  misc_feature (782)..(782): n is a, c, g, or t
cggtccgctgcagagattgtaccagggtgagggagtgtgcaggctgctcacatctagccatcgtgactcacctgaactcgtcgaaggacgtgaacagactggcagaacgtccgaagacctaggttatgagctgccagtatcggagtcaccaatagtgaccagtgtgttaggcaccacagggccaatacttacaacctaagccgaaagccgaggactgagaacaagtggtcggagtcgctggaatatcctttgatgttagtgtccccataattccatagtacatccaggaggagtcctcttgcgacagcctccgcattggtattgcgagttcctggggaattattccgaatcctcgagtccggttcgttccgcctgaagtacacaagggcgccccgggttgggcgatccacatagcgattctagacgcctctgtaatcgcttgtagtcctcggagctttcccaaggagcaggagagttagatcaccacgttgcttcccgttgatctatgctttacttccctccgaccttatgggaaggattttcggcctcccaccgtgcattgctgagagcggcggagccactgggttatggccaaagttcaaaagttggtcattaacaataatgctatagaccatggaaggcgcatctacacgcgccggtacagattggcaattgattccaaattccctactacaggtttctgggtcaattgcgtcaattcctatcaagcacgaacgccagcgatagacacgggagtgtcgtctacgggtagagcaacccanaagtttacttcctgtctttgttgacttcgtgttgtggaggccgccctggcccgactgcacgctctgaccttgtgtgtcttggccctgaggtttcccaggggacgcctgttctcggtagggcccttgtgtgaattggcgaccgcttgagtgcgtggtatgcccccagtgggccattggcccaagcatgggtcgtgttgtctgcttgtccttgtcaatcacattcctgcattgcgcccttggcatgggctgtattctcaacatccctcggttgggcgcctcacgccgcaggttccgtgcacgcatcttgtcgtgtcgtagcgttcccggtgggagtactcataattctc

SEQ ID NO: 656037 - DNA, 131 bp, Homo sapiens
ggcactctgaggatccacgtagtatgtacatatgtacaacctgcgcgttgtgcaggtacctagaacttgaagtattaaaaaaaaaacaacaagggttggtgttcggattaagtgggcccagagaatgtctt

SEQ ID NO: 656038 - DNA, 145 bp, Homo sapiens
atcagcaggtcaaaaaaaacctttaatactttttaagaatgccacttaagctttcttgccaaaagcctttggaacaggtgctttttgggctggaactttttgacccttttgttgtttttttgcaaccggataagtagtagtaggc

SEQ ID NO: 656039 - DNA, 613 bp, Homo sapiens
  misc_feature (84)..(84): n is a, c, g, or t
ctttcgattgggggcacttatgattccatctgaaagaaatggtacgcaatttcttcctgaccttttgaaaaatttttaggtatngctggatgctgtgccaaaacaacagttgctccatggatcgagtaaaggttttattacaagctcacaatcaccattacaagcatgtaggtgagttaatagatgctaaagataaaaatgaatgaaaatattgtggaaagtgggcaaaaaaagggaatttaagtttgggggtgtaaaaagtaaagtagaggttcctctttaaaaacttttttccccatttaattaggaataaatagtaacttctctcagaagcaaaatttattcaaagacctgtgctaacattcttaaatatttgctagccatgattaaaaaatcaatgtgctttatgttcttagctcccacaatttagcctaaatatttgccctggcatgcttattctgctccaagcaagcattaggtcatagctggttcctcttccttatttaaaggtgtctgttttataccttccccagcattccacaggttactttctccttcccttgtgctcctctgccttggcctcttttaaaaagttctaagtcgcccgccaatc

SEQ ID NO: 656040 - DNA, 81 bp, Homo sapiens
agttcaacaccaaccacatttcccttcctccctctaattctacccacatgatatttattccttcctttcgccaattaaaaa

SEQ ID NO: 656041 - DNA, 785 bp, Homo sapiens
  misc_feature (256)..(256): n is a, c, g, or t
attcggcacagaaatggatgactaattttatgggtaaaagttggttgtttcaatgaaaaatgatccagaagaagaggagtttacttcaaacagaacctggcaatcggataaataccttcaagtgtctgtctccgtaaaaatgttccagaagaagaggaggttacttcaaacagaacctgggcagttggattaataccttgaagtgtctgtctccataaccacattttagcaagattcccagccttcctcaggtatngctggatgctgtgccaaaacaacagttgctccatggatcgagtaaaggttttattacaagctcacaatcaccattacaagcatgtaggtgagttaatagatgctaaagataaaaatgaatgaaaatattgtggaaagtgggcaaaaaaagggaatttaagtttgggggtgtaaaaagtaaagtagaggttcctctttaaaaacttttttccccatttaattaggaataaatagtaacttctctcagaagcaaaatttattcaaagacctgtgctaacattcttaaatatttgctagccatgattaaaaaatcaatgtgctttatgttcttagctcccacaatttagcctaaatatttgccctggcatgcttattctgctccaagcaagcattaggtcatagctggttcctcttccttatttaaaggtgtctgttttataccttccccagcattccacaggttactttctccttcccttgtgctcctctgccttggcctcttttaaaaagttctaagtcgcccgccaatc

SEQ ID NO: 656042 - DNA, 180 bp, Homo sapiens
gaaacctaattaggaaggaacagttcatctcctttctccctgtggattgctatcagattccacttcttctgaagatctggagaactaggtgctgagccagcatccctgccaggaggctgcattttctttacagctcattgtaaaacagtaactagcatggttacccatcgcatcgctttg

SEQ ID NO: 656043 - DNA, 254 bp, Homo sapiens
tacgctttatcttctgatatggtttgaatctgtgtccccacccaatctcatgtcaaattgtatccccaatgttggaggtggggcctggttggaggtgactagatcatgggggtggatctttcatgaatggtttagcaccatcctcttgatgctgtccttttgatgaatgagttctcaaaagatctgattgtttacaagtgtgtagcacctccccctacccctttctcctgccatgtaagacgcacctgctcctg

SEQ ID NO: 656044 - DNA, 103 bp, Homo sapiens
ttgagaactcgaacaagggatctcgaacccgtctagaaggaatgtatttgttgctaaatttcgtagcactgtttacagttttcctccattctccacatctcct

SEQ ID NO: 656045 - DNA, 276 bp, Homo sapiens
agccggcacccaatatttgcaggagtagtggcatatacaacggatctagtacaagttaaacaaagacgggaaaacaggtgttacaggttagaaccatttgatgtagctacgtatcaaagggaaagctggtgatctatccacccatttagtgatctttatcagtgtctctcaacttttggtatataggaatgcacataagattatggggattatgtgaaaatgtagaatcttattcagtagattcggagtgggacctgagattctgcatttctaaca

SEQ ID NO: 656046 - DNA, 223 bp, Homo sapiens
cccctgagttgacacttaacccattacgctggcaaactgatacaactcagaaactgctcactgtcatggaaaacctggaacttgttgatgaacttgttttcaaaatatcatctcatcaactgaggcctggacaaacaatgccctgagtgagggatctgcaacaacccttgaagacaacaatggaaagaaaccatgcaaagaaacttggctctagcgcggtggg

SEQ ID NO: 656047 - DNA, 102 bp, Homo sapiens
cacattcttcacattagtagggttactctccagtatgaattctcttatgtgtagtaaggtgtgaggaccagttgaaggacatacggaaaaaccaagctcacc

SEQ ID NO: 656048 - DNA, 626 bp, Homo sapiens
  misc_feature (137)..(137): n is a, c, g, or t
  misc_feature (159)..(159): n is a, c, g, or t
  misc_feature (254)..(254): n is a, c, g, or t
  misc_feature (258)..(258): n is a, c, g, or t
  misc_feature (260)..(260): n is a, c, g, or t
  misc_feature (264)..(264): n is a, c, g, or t
  misc_feature (266)..(268): n is a, c, g, or t
  misc_feature (491)..(491): n is a, c, g, or t
  misc_feature (563)..(563): n is a, c, g, or t
  misc_feature (574)..(574): n is a, c, g, or t
  misc_feature (612)..(612): n is a, c, g, or t
ggaagcaggtctggaagccctgggtctgcccagtggagtcctgcagacaccagcttctgacatggctcctgggttacggaacatgcgttcagcaaagattgcctagtcagcaagagcctcctcgatcctcatgagtnggttgtatttggccagacgctncgagcggcagggggcgccagtcttgatctgtcctgtgcagagccccaccacaaggtcagcaatgaatgtgtcctcagtctccccagagcggtggntcancntcancnnncagccattagactgagccagtttgcacgcctggatcgattcggtcaccgagccgatctggttgaccttcagcagcagacagttgcaggcttcttctcaacggcctgggcaatccatcttgggagttggtgacatgtcaaggtcatacccccgacaatctggtatgttcacgccccgtagaaggaagcgaggtccaatgtggccacagtcatccaggcatagtntcttgatagagagctcttattacagctctcgcgcgcttctcccacagtgatgtgccgtcgcgggatcatcanggcgacttganagtcacagatcgtacttcccatatgcgatagaactcanggatgcttcattga

SEQ ID NO: 656049 - DNA, 334 bp, Homo sapiens
gagatggtttgaatatttgtccccgtcaaacatcatgttgtagattaattcccctaatggcagtattgagaggtggggcctgtaagaagtgattgggtaataagggatctgcttgtcatgaatggattagcaaggcggtcgtactgtaattgaataaatggcttatgctgggcttgagactgttggcttcataagaagagggagagagacctgagctagtatttaaaggtgaacccgtcatatgcactggcggacacaccctcatgttcatacacctatcccccattttcctcctatccctcaaccccgacatcattaccgggttttcctttta

SEQ ID NO: 656050 - DNA, 267 bp, Homo sapiens
actacacggttcctttcagaagggactgcgggatctatctgcagccatatcagtccacaggtctctttcactaataagcagtgttctgtgcgagatctatgtagttaaaaaagtagtgagagcgtcacctagtcccacatctgacttactgtaggagtccgtccgccagcataccctggcaagtgctggaaatcaactcagaaaagggaactcagcacctagacaatactttggctcttctcccttttcactggggcaatcaagctt

SEQ ID NO: 656051 - DNA, 390 bp, Homo sapiens
ttgaaaagcacccgctcaagaggaacagcattcctgagtaacaagttccatgtaccaagctaaagaattacctcttgcaggcagcataagaatatgagtcaattgaactacatcccaagtaaaaactttgggctgggcgtggtggctcatgcctatcatagatcccagcactttgggagaagaggagcaaggtaggctggtcgggtagatacgggatagaggctggcattcagaagtgcagagctggcctaacttcagaatgaaaactgtctgatgaacaataaatactgtgtacagtcgaatttagttactactgcattagagaatgaatattttcctaaaggatgcgaaccttatatttctcttatcctgtgcctgctacattgcggg

SEQ ID NO: 656052 - DNA, 213 bp, Homo sapiens
agtgcccctgtcccccccggctccccctgctggggtttagggtttttttccctcccccggccctggggtggaggccgtcaacttaggggggccagcccccttcccccttttctcttggcagccgggttgggttttgtgttttggggttttttttttttttttccttttgttttgaaatttaagggtgccaaataaaggaaaagccgtttttta

SEQ ID NO: 656053 - DNA, 439 bp, Homo sapiens
  misc_feature (33)..(33): n is a, c, g, or t
  misc_feature (270)..(270): n is a, c, g, or t
  misc_feature (291)..(291): n is a, c, g, or t
cctggcccggggcaggcgggggccgggacacanaggccctttcagccccgggaggctgcgggcccgggcggggcggggcggggcggcaccctccaggaggacgcccggcctttctccccacttttgcctgggaggcccctggcccgccgggctttgtcctatttataaacgtgctcctgagtaaactccctgaagaaaggggcctctgtgtgcggcagcccggcccacagcgccgccctcagcacacagtaggcgctcagcatggccttntcatgggactgaggacaagcnccgatccttgggagctgccaggcgcctccagcacccagaacccctgacatcgagcgcctggacacctgttcccgaagccctgtgagctgatgggctacgtaacctttgggccgcaatgctagaataaaatgcatggacacttgttcca

SEQ ID NO: 656054 - DNA, 167 bp, Homo sapiens
ctaagcagacatcagcaggtatcaggactacatatggctctaaaaggtccactggattaattaagaaagacgcaccttgtattagccactgtgaactgtatacactgtggtcaaagctctgacaaggtcctttccttattcttctgattattcctattgggattatg

SEQ ID NO: 656055 - DNA, 88 bp, Homo sapiens
ggggtatggggcatagtctcttaccctctttctttggagctaaaggaggttcttcgaatgaagtctgtagaggttctaaaaaaaaaaa

SEQ ID NO: 656056 - DNA, 806 bp, Homo sapiens
agcgggcttctcgcgagcggccgtccgagcaccggcctcgccgccgcagagacgctcgccacgccgctgccagagccggagcggggagccaggctgcgtgcgaccagccgcagagcagaaaagcggcccggggccgggggccggcaaacggcacgaggggtctctggcgcgggcggggagtatgcccgcgcgtgactactgctgtaatggcgcctcctctgtggaaccccctcgccccgggttgcgaaccgcccgggggattgcttggtcccgggcgctcccttgtgtccctgggtggctgcgtcacgttccttttgcgcaggagtgtgggtgttttaagcagaaacttgtgctttttgtgaaaaagaacccaccagggatgtttactggtcacacagaaaaggagccccagtccgttttaggatttgggcacgggctcacggcagaaagttcctatttaaggcgcacacttggttgaaaaaatgtgaggccaaaaatgtcttgaaaaattaacggggtctgagggttcctttctaacggggtcttttattaccattccaagtgagggttgtgaaagggcacaggggcgaaaggaagaagccaggtcccggattgaaacgaatttttatcaaggtgcgttggggccaatgaaacaaattattgggaggccattctttagtcaaaaaagctcatctttgccttatcaagtaagtgtttaaagttttttagtttgttggacaattttttttcaattgggtacaatttttgatggaatttcctttggcgtttaattaatatttattaat

SEQ ID NO: 656057 - DNA, 1212 bp, Homo sapiens
  misc_feature (162)..(162): n is a, c, g, or t
  misc_feature (291)..(291): n is a, c, g, or t
ccgatccgactgcactccagccgggcgacagagcgagactccttctcaaaacaaacaaacaaaaaaaaataggaggaggctgtgtatgttctatatacatctcagagatacacacttcaattaaaaaaacaagatgttcagtgtgcacagcatcttacgttngcttttctgaggtgataagaatgtatctttttatgtgcattaaagcagaataggcagccaagtgcagtggctcacacctgtaatcccagcactttgggaggccgaggtgggcggatcacctgaggtccnaagttcgacaccagcctggccaaaatggcaaaaccccgtctctactaaaaatacaaaaattagccaggcgcagtggtgggtgcctgtaagcccagctactcaggaggccgaggcaggagaatggcttgaacccaggaggcagaggttgcagtgagccgagatcgcgccattgcactccagcagcctgggcaacagagcaagactcggtctcaaaaaaaaaaaaaaacagactaggcaggagccatcagcttagggctttttctgtacccagaacccatccatacacaaacgggaacttaacctagaggcattctttgtaactaacttcaaattaagcttctaccaatcataaacagccaaccagccaactgtggcagaacttgggaccatgcattggaccacacaaataaggcaaatgcccagcagtagccaatcaagcagtcatgcaccgctaagagcagtcatgcactgctaacaacgtttcagtcaatgatgggccacatgtagatggtggtcccgtaagattataataccttattttaactgtaccttttctatgtttagatgtgtttagataccattgtgttacaatggcctgaagcattcagtacagtcacatgcgagcaggtatgcagcctaggagcaataggccacaccacacagcctaggtgtgcggcaggtgtagcgcactctgatgcctgcacgacgacaaaatcaactaacagcaaactcctcagaccgtatccccatcattaagcaacacatgactgcagtttctttctttgcttctaggctcagcctacaaaagcttgctgctcatgctgccggagcagagctctgaacttctaattctgagggctgcccgattcccaaactgttctttgctcaaataaacttatctgttaaatttaaaaaaaaaaa

SEQ ID NO: 656058 - DNA, 103 bp, Homo sapiens
ctagttcggacaggagcgcagtgtctgctcctacatcttctcggacctccttcgctctcgggctcggaaggaatgcgcttctgcatgactgccgcaggtactc

SEQ ID NO: 656059 - DNA, 173 bp, Homo sapiens
ggatccccactactccacggttcgctactagtccacggttcgctactagtccacggttcgctactagtccacggttggctactagtcgcgagggttgttttgagacccccacttctcccctgaagaaggaaccacctggctatgaggaagccatgagccaaccgtggactagt

SEQ ID NO: 656060 - DNA, 548 bp, Homo sapiens
atatttatcggatgtcaccacctatgattggaatgtctcaggtggtggctggatgagatggtgaatcgctgtaccagttacccgacctaggaccaggtgctatacgtagcagggaaagagtatttgtgattcagaagagatgtgtaggacaattgaagtacagtcaatttaaggttgttttgacctcagggcaggatttacagtaaacagtagataaactggaagtcttagaagccttcccaggactagggttaatcataagtcaacatgacagatgagcatccaagatggagttgcttgggcctcgacaagcatgttgtttccctaaactcggaaccttcttcagaacttgaagtgacagttttcctgaggtcattaacagtagtgccatggcctccaccacaggctcggtctattccagcactccctgaaatgtacagctgatgtgtgggttaggaaaaatagtgtattccttgtgttctgctttttctgccctaggaaatttcaggtctacaggaatctgagagttacgcagtggcatcgataca

SEQ ID NO: 656061 - DNA, 372 bp, Homo sapiens
  misc_feature (309)..(309): n is a, c, g, or t
tactccacaggtaggcagaggttgcgctgagccaagatggcgccactgcactccagtctgggcgacagagtgaaactctgtctcaaaaaaaaaaaaaaaaaattgggttgattttggcaaattttgacaatgcttttaaaaaccctatttttggtaaattgttttgtttaaagttagggaataagtttgatggctgcttgcaaaaggtctcattaacacacttgtttctaccttctagaatttcccaggccttcactaacaattgaacagaagaggaaaggggggagttttataaacattcatccttgntagtccaaccgcttttccattgggtttccttgacaacccattctctgcttattagaattagct

SEQ ID NO: 656062 - DNA, 306 bp, Homo sapiens
aagagaaaagaggcaccactaaaagatcgcagtttggctggtttattggctcacacctgtaatcccaacattttgggaacccaaggtgggtagatcacgagatcaagagatcaagaccatagtgaccaacatagtgaaaccccatctctactgaaatttcaaaaattagctgggtgtgttgacacatccctgtagtcccagctacttgagaggcttaggcaacagaattgtttgaacccgggaggcagaggttgcaatgtggtgagatcatgccactacactccagcctggcgacagaacaccgtc

SEQ ID NO: 656063 - DNA, 665 bp, Homo sapiens
cgaggactcattatcgtgtgcactaactagtctagtgatagtgagtctctatttattaaaaaaatagatgaagtaagggtgaggtcttttttgtctatttagacagtttttacttattgggccaaagtccattgataaaaaacccaccatgccaacagcaaataattcttttctaaaactggccccatttcttgaattaacaaggcttcatatcctactttacacccaacagatacttgccattttctccaagactgtacagattccactaggccaccagctagaagggctgcagcgaaatattttatagtactgctaaattttactactttcagcaaagagtatgcgacagcattcacccctactatcacggagaacaggcttcttgcaaaaataatctagtccagacatccacatacttcagtctacaaatgtgtacatgtgcacccatgtaactagtgactcccggtttccatgggcttgactcataggagcattttgaaccccttacaaagaagaggagcaaggatagggtggatatatgagcatttttccattccacttttggacaaaggggtcagaaagaattctcatgaatcctgcaggacagactatgtctatggagaactcttcaaggactaggtcaattgcgctgtcacattcta

SEQ ID NO: 656064 - DNA, 220 bp, Homo sapiens
gcccccccccaattttaagggccttttggagaggggttccccaggaaccccttttttcccccgcctggggtcggcctttccaaacttccttttttttggccatttttttcccttttggggaaatttttccccccccccccccccattcccttttttttcctttttttttaaaaattaaaattaattattaccattattccgggggaagggaccaaaggga

SEQ ID NO: 656065 - DNA, 482 bp, Homo sapiens
tagtacgtctatttgattctactctcaagaggattatctttaagtacagagacgttttcttctgcttgatctattctgtgaagttctcaactgtattttattttttatttcatacatggaattcttcagctccaagatttctgttgggttctttttaaattatatctatcttttggttgaacttgtcagtcagatcatgagtggttctcctgatttcatggaattttctttctgtattctatggtatctcactgagtttccttaagatcatggtttggattacttttggggaaatttgtgaagtttaatttcttaagggtcagttaatggagaatttggtccctttgatcatgtcatatgttctaacttttccatgcttctggtgtccctgtgtggatgtctgtgcctctgatgaaatagtcatctccaatatcagagtagctttcatagggaaagattatacgggcatatgagtcctaggt

SEQ ID NO: 656066 - DNA, 118 bp, Homo sapiens
cttatgaatcctcctcctccttccacgatgggtatcaggtgctacggggagggctcagggtgagcacagacacagcttcggcagggtgctgcgaaaacaggagacaccagcaggtgtc

SEQ ID NO: 656067 - DNA, 192 bp, Homo sapiens
acccccgcgtccgggaagggggcccagggatgggcttcttccctcctttgggcctcggtccccccccttgtgggtgggggggggtggggtttcagtgcccaggccggtgccgctcccccggggggggagggggcccaggggtgggcctcttgtccttttttttctttgaattaatgtccctttttgaggcca

SEQ ID NO: 656068 - DNA, 269 bp, Homo sapiens
agttgttaccagcgacccactgcttaacatggacatttaaaacatagctagactttctgtattacaccaatttgatatcgctataatgaaattggaactaagggcgcaaacgagagtgcaaagcatagtttctgaggtcttactaatcggtgcctgatagaatgccgattcagccttacaatgtagactttgcaacagtggcctttaaagtacgctagatcaagtgtaccctagaggtaaccctatgtcaaaacaattatttgtcttaa

SEQ ID NO: 656069 - DNA, 519 bp, Homo sapiens
  misc_feature (118)..(118): n is a, c, g, or t
  misc_feature (188)..(188): n is a, c, g, or t
  misc_feature (200)..(200): n is a, c, g, or t
  misc_feature (202)..(202): n is a, c, g, or t
  misc_feature (301)..(301): n is a, c, g, or t
  misc_feature (314)..(314): n is a, c, g, or t
  misc_feature (324)..(324): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (346)..(346): n is a, c, g, or t
  misc_feature (363)..(363): n is a, c, g, or t
  misc_feature (368)..(368): n is a, c, g, or t
  misc_feature (374)..(374): n is a, c, g, or t
  misc_feature (397)..(397): n is a, c, g, or t
  misc_feature (414)..(414): n is a, c, g, or t
  misc_feature (417)..(417): n is a, c, g, or t
  misc_feature (422)..(422): n is a, c, g, or t
  misc_feature (429)..(429): n is a, c, g, or t
  misc_feature (431)..(431): n is a, c, g, or t
  misc_feature (474)..(474): n is a, c, g, or t
cgggcggtggcggctacttagctgccgccggccttggccgcggcctgttcggtttgatatgtggcttaaattgcgcatgcgtcggtggcctagaggctgtaagggctggtcgtcctanaaactcgtggacgtctcgcacggttacccggacgcaggcccgcccctctggtgaaccgctagctcctctnatctgggttggnancttcctcgcagttgcggcctccactccttccttctcgcttagccaaggcttcttgaatgctcgcaaattttcttttttttttaataaaccgggcccttnactggcgcgacgnattctcccanccnctnaanaaaacgtctttanttctgaaataggggttntattnaaatanacttttttctaattattttaaanaaaaaacaaattttgancanttttnttattcnanttcaaaaattttcaaaaaacaacaaagacaactcaaaacatcngtaacacatttggcccagtaactgttaacaaacatacagtgcatt

SEQ ID NO: 656070 - DNA, 219 bp, Homo sapiens
ggttaaggccagtaggttgggcttcagtttttcccaggccatgaacatttatttaatttcagagaacttctattgtattttcaactgcatatctctatttttattggtatttaggaatgtgaggagaattcccagcccattattggctaccatggttccttcatcctcgtctaggctaccactctaaattgttggatgcactaggtaatattgtacaat

SEQ ID NO: 656071 - DNA, 997 bp, Homo sapiens
  misc_feature (221)..(221): n is a, c, g, or t
  misc_feature (479)..(479): n is a, c, g, or t
  misc_feature (519)..(519): n is a, c, g, or t
  misc_feature (997)..(997): n is a, c, g, or t
ccaggactttccctgcggatgggggccttcgacagtgagggcacccgctcatgctcgaccgcggcgggcagttccaaaggggaccccaaaggtgcctcacgcggggctggtgcctcctgggcgtccgttgggagcggccactaccgtgcccgggtccagaagctagtacagcactctccaaagccatgctgcgaagagtgagccgagtgacatctgcctangcgctgtgggctccacgtccatgctgagtccggctgtccaggctgtctctactgttcttggctctcggtatctcttggcttccatcattctctccaggtctcctgcatgactagaagcccatcggagatattgcgaggctatgccgattgtccttgtgctactagctgcatgtagcccccatgggagctccccgttcctgcacactcactgtcctcttgatccttttgcttgctcgtgcgtggatccagggctccccnatgtgctacctttgcctaccgtgggtgcgctgcgctaganttgagtgtggaggccccgagagaacctgaagctgctcgatggaatccgccttgggaaggctctcgactatagaggcctaagcgtactgtctacagaggcccttgctaacgcttgagcacctatcaactcgcagctcacggaagacccttagtttggtcgagggcacgcgcattgcctgattcccaaagtactaggtcgcttgctcccgttcgagaccccttggcaagacactcgtcccggtccccagattgtcgtccatcgcccgcaggcccttgctccgcagggctcgctttagcccgttgggcccctccgtgtcccgggaaccggggtccgcccaatgcttcggtgaacccttgggacctggtccccttctatggccaagcaccgtcaaatcggaaactatgttgttgaaccatgcccccgccgatggatcctcacgtagcgcgtatgggtcccaagtccctggtaagtttcccgn

SEQ ID NO: 656072 - DNA, 886 bp, Homo sapiens
  misc_feature (403)..(403): n is a, c, g, or t
  misc_feature (417)..(417): n is a, c, g, or t
  misc_feature (469)..(469): n is a, c, g, or t
  misc_feature (476)..(476): n is a, c, g, or t
  misc_feature (488)..(488): n is a, c, g, or t
  misc_feature (501)..(501): n is a, c, g, or t
  misc_feature (510)..(510): n is a, c, g, or t
  misc_feature (531)..(531): n is a, c, g, or t
  misc_feature (538)..(538): n is a, c, g, or t
ctgaccacatgcctgtggctgtggaagggatgacagaggctgtgcggcggctcagtgtgaaacgaggctgcagtgttgtggtagtatgtgaagactgtctgtggcttgatgtgactgagcaacatggagcaaactatctgctgagtgacctggtctgtgaccaatgtatacagatgtggtgtggcgacatctgccaacagggtacttctggtccttgggtggaagcatctagctcaggtagtgtacggtacttgagcctgtagtgacgaaaagtgtgattgccattgattatggaaagaaacagggaaaatcttcaatgaaagaaacaggaaatgacagaaatggtattgcttattacccaccagcatttcggtaaataactgtgtatgtacacttctccccnttgaagagcgaccnggattatattctcaaggaaggtgacttggtaaaaattgaccttggggtccangtggatngcttcatcgctnatgtagctcaccnctttgtggntgatgtagctcaggggacccnagtaacngggaggaaagcagatgttattaaggccgctcacccttgtgctgaagctgccctacgcctggtccaacctggaaatcaggacacaccagtgaccgaagcctggaaccaagttgcccactcatttaactgcacgcccatagaaggtatgctgtcacaccccttgaagcagcatgtcatcgatggagaaaaaacccttatcccggatcccacagacccgcagaagaaggaccctgaaaaagctgaatttgaggtaccatgaagtatatgctgtggatgttctcgtccagctccagagagggcaaggccaaggatgccggaccgagaccactatttacatgagacccgtctc

SEQ ID NO: 656073 - DNA, 220 bp, Homo sapiens
ggtttctgcctacccaggatagtcttgtctctagacaatgtattgatgatgcaaatgttctggaactaaatagtggtgatggtggcccaaccctgtgaatgtactaaatgtcactgatttgtacgtatttaatatgaattaaatgttaaaatggtgaattatatttatgtatattttaccataataaaaatatgcattggaagatgcattttttgtgaca

SEQ ID NO: 656074 - DNA, 328 bp, Homo sapiens
  misc_feature (28)..(28): n is a, c, g, or t
  misc_feature (41)..(42): n is a, c, g, or t
  misc_feature (52)..(52): n is a, c, g, or t
  misc_feature (60)..(61): n is a, c, g, or t
  misc_feature (75)..(75): n is a, c, g, or t
  misc_feature (77)..(77): n is a, c, g, or t
  misc_feature (84)..(84): n is a, c, g, or t
  misc_feature (86)..(86): n is a, c, g, or t
  misc_feature (134)..(134): n is a, c, g, or t
  misc_feature (139)..(139): n is a, c, g, or t
  misc_feature (152)..(152): n is a, c, g, or t
  misc_feature (194)..(194): n is a, c, g, or t
  misc_feature (213)..(213): n is a, c, g, or t
  misc_feature (221)..(221): n is a, c, g, or t
  misc_feature (266)..(266): n is a, c, g, or t
  misc_feature (271)..(271): n is a, c, g, or t
  misc_feature (283)..(283): n is a, c, g, or t
  misc_feature (291)..(294): n is a, c, g, or t
  misc_feature (313)..(313): n is a, c, g, or t
  misc_feature (318)..(319): n is a, c, g, or t
gagcagcgctttgtcagctctttctctntgtcaccttctannatacataagnctggatannggagcgtgtatgtncngcgcttnancatcagctgcctctcaatgtagagcagtgtaatggataacatcctatntgtgnactacagtgacangcgcatatatagtgtatgccattaggtcagtccttgagatangagggtgtctctgttgtgnctattgtngtgcactcgttatggatactaggttctcaatgtcagttctttccncgaanacaatctagttnttttaaannnnggtatatagcaattgttangttannaatgtatat

SEQ ID NO: 656075 - DNA, 140 bp, Homo sapiens
gggaattcttataactcgcaaactgtgtcataactcacgggagggaaataccgtccgccagccccgctctttcctggctacacataaaagctccaggttcctggggttccggttggtgaattctggggcgacagcttcat

SEQ ID NO: 656076 - DNA, 416 bp, Homo sapiens
gtggctcatatatatcaatggtggtctaagagcatctggcggatagcaccgggcatatttggaatgtatgaggtctggtatcctttagcagtccagacgaggacttggtctcagttgagcaatttggctatgaaggattgtatgcagcacggttctgagtctgtgggatacctgccatgaagtaacctgaaggacgtgctggctggtagggtgtgattacagggttgggaacagctcgtacacttgccattctctgcatatactggttagtgaggtgagcctggcgctcttctttgcgctgatctaaagctacctacaatgtcttggtggccataattctaccgttcatgtctgtaactgactaagtcggcttctgtctggggcggagagacatacaaaatcaaatcctttgttgc

SEQ ID NO: 656077 - DNA, 370 bp, Homo sapiens
  misc_feature (227)..(229): n is a, c, g, or t
  misc_feature (231)..(232): n is a, c, g, or t
  misc_feature (234)..(234): n is a, c, g, or t
  misc_feature (236)..(236): n is a, c, g, or t
  misc_feature (239)..(239): n is a, c, g, or t
  misc_feature (241)..(242): n is a, c, g, or t
gttttttcatttcatttaactgtgctttctccacttttcatcattttgtgtttgatgatttaaaagaagcttgactattcctcagctcttgtgccaaggagggtttttttttttaagactcttaaactcaaaactctgcacaaagatttcagtttcaaatgtgtattatacatgggtagaaaagtgtttgcacaggcaacttttggaagtgtttaagaatcagggtnnngnngncnggngnnaccgggtgggggcaatgctaaattgtatttggaaactaggaaaaattatgaaaccaaataaattggttttgcttccttgccatggattctggaaggacatagttcttctaaaatttcctgttaattgg

SEQ ID NO: 656078 - DNA, 237 bp, Homo sapiens
tgtgtataataatttatagccaataatataacatgttttgatacaggcatataataatgtattagtcacatcaggataagtatctattaccttcagcatttatcctttgtattacacagacccattttacacttcattattttaatgtaccattaaattgttattgactacagggtcattttaattattaaaattatatagaagtattaattaagtccatacattcctgagtcatga

SEQ ID NO: 656079 - DNA, 1594 bp, Homo sapiens
  misc_feature (461)..(461): n is a, c, g, or t
tgggctctagaagggggtaaagggggtgctatagggtaaatacgggccctatatttacaaagattttaaggggaataaatctcataggacgagtgggcatgtgaaacgtggtggttgtgcttccacgaaattttcagagcttgtgacggatagatataccccgcggctcggtgtacggggtgaagaggtggtgtgggttataacacgtctccggcgaatatgtgccatctgtggtattatataacgccttacagtggtggggacacaagtcctcagtgcagtgtcgcaagacacgctcttggggaagtgtctaactttatatatcacgaacagggggggattataaaagctgcgggaaggtgtactatactctcgagagtgtggtccagagcgtttcagaggagagtgtcgcagaggggtcgacgcgtgtggttgtcataaggaaagaatagagtgggcgngcgaaagtctagtgtattaggagagttgggaaaaaaaattaaagattctacgaccacgaaaaagaatctcgagggggagtcccacccgaagataaggaggtctcaacaaaggagaccaccacgtaggcgggggcgcccccgaagttgtggactagtggaaggtgagaaacaagaggggcggaggggggaaaacgccgcgaggtagaaacacaactggcgcagcacgaggggctcagtggatagtagacgggaaacaggtacggaataaagcgtagataagggagcaacagaggggaacacacatgggagagcgagtgaaccaacagggggcactcgccaacgcgggagggggcgacacagacacacacgagtggcataccaacaaacaccgggatacgaacaacaacaatcgagccgccagaggcaatgcggcactccgtgggacccccggtgcggccacaaggcgagaagtcccagccgacaaccacatggcagactgcgggcacggcagtaataagcaacactctagaccgtacacagagagaacaacccgcaagagtaggcgcaagagacataacagcgaaaacacgaacaaagacaacaagatcgcgcaccaacaccagcagcagataaacaccgtagatgacctcatacaaagtccgccgacggcaaagaagaacagcaacttaaaaaagagaacagccagcagagcaccaactgcgcccttcacccacaccacactgtcacaaacagatgtatgacgaacaccaaaccacaccatcagcaaagacaagcaaacccaccaacacgccctccctgctagcagtaagaaacacaaattcctcacatcatcataattcactcatcacaggtgatgcaagacgacagagaagactcacccgctataacacacacccaccctgtgtcgtccccgctggaggccccactcgccaaacacacgcaaggtccacaccaccagtagtacccactccagtggtcacaacacatcacctctcgctatgttcaccaacgtctcagtcacgaccaccatacagcatctaccactcacgtgtggcttccccaccagaagcgatctttcagcttgttcaaatagataaaagcagacacacgga

SEQ ID NO: 656080 - DNA, 450 bp, Homo sapiens
  misc_feature (18)..(18): n is a, c, g, or t
  misc_feature (97)..(97): n is a, c, g, or t
  misc_feature (166)..(166): n is a, c, g, or t
  misc_feature (236)..(236): n is a, c, g, or t
gccttaaaacttgaaagnaagaacaagttaacaaaggttttaccttgggcaagaacatcttgcaaaggtaagatgtcctaaagaaagattttttttntccttttttttaaagacaagagtttcgctcttgtttccccaggctggggtgcaatggtgtgatcttggntcagcgcaacctctgcctccctgggttcaagtgattctcatgcctcagcctcccaagtagctgggattancagatgcgccaccacaccctggctaattttgtatttttagtagaggcgggtttcaccatattgtccagactggtctcgaactcctgacctcaggtgatccacccgccttggcctcccaaagtgctgggattacagcatgagccaccttcccagcctaagaagattttttgagggaggtaggtgacttgagaaggcactacttgaagagattttt

SEQ ID NO: 656081 - DNA, 120 bp, Homo sapiens
  misc_feature (64)..(64): n is a, c, g, or t
ggtaccctactttccttctcctccaccacaggaggaggaggcacagcagtcccaaaatgacagnttttgagcacagcgacagccaatgcaaccctgatggcagtttaccatgcagcgcta

SEQ ID NO: 656082 - DNA, 131 bp, Homo sapiens
tcggtccgtttctccccgttgcatacttgttttggcaaactacacagctggtggaatcacctctgcctacactgcacctgccccatgagctgaaggaggctggaaaggcagcacacagcatgctgacttct

SEQ ID NO: 656083 - DNA, 840 bp, Homo sapiens
ttagatattcttcagtcttccagagttccaaagggcagtaggaagaagcaatgaaaataccacctgtattctcacatctttcattgttccactcaaaaaataccaccatgttcacttctggtggaacgtttatgtccatgagaagcagtggctttgaagagttttggcagactatggcgccttactcaacattgggaaggtatcttgccatcagaccttttgggtctccatgaaacttcttataccccctctgggaaaagtcactaactgtgatcttactgagcttctaaacacagcattttttttacacttaagtgagcgggggtcctcctcatttgtgcttctcttcttgtaagggtgacttcctcccagtaggatgaatctcatgcctatttgtgttattttgctaattccagcttcttttctactcaggggggttccaactcttttaaggtctcatcttcagcacttctaaactgtgggaaactatgtgaaaacaaatggagtggccaaacacaccattcatcactgtgcttctggacagctgcaagtccatacgtgttctgatgaagtctggctctgttgcccaggctggagtgcaatggcacagtctcggctcactgcaacctctgcctcctgggttcatgcaattctcctgcctcagcttcccaagtagctgggattacagacatgcaccaccatgcccagctaattttctgtatttttagtacaaacagggtttcactatgttagtcgggctgatcttgaactcctgacctcaagtgatccactccccgcagctccaaagtgctgggattacaggcgtgagccaactgcgcc

SEQ ID NO: 656084 - DNA, 891 bp, Homo sapiens
cgcagcgcgggtgtatttgcggcctgtgccgagtaaggcgctggggcactcagtctcctcgtgtgcagagcgacgtggcaggaaatctcgaacccagtggtgatgcgcactcgttaaccctgggactcccagaggggtcgcgaagggcaggataaccggttctccctacagaggggcgggactgtgcgtggacaggtaagggaatgtgtctttttcccacgcttcatttgtgaaattcggcccctccccgcatgtgggggaattccccaaggtcaacttccccacaacgagaagggggtaatcccacaagaccccacgcagacaaggagttcgccccaagggggattgatacccatccacaagtcctgaggtaaatctctttcccaagggtgggaaaccccccaagagttgggattctcccttggtgttacacacaaaaattggggacggcaaatataatgggggcctttcccttgtgtcttccccaaacgatgctgagggtcacatataaaggataaaaccccacaaagctgtgggtggtacataaagtggggtaggtaggagaacacgggacattatttgtgggggaggcatgacaaataggtggaacagaggggggcatttccaatagtacgcaagggcggccgtattaaacacgaggggccctttacgcgaggcaacaccacgtctgcagttggcacacacatgtgtgggtgtagggatcccgtattaaacagataaccccaaagcgtggtatatagtagtggggataggggacaccaaacaaatttttatccccggaaaggaaaacgagggctatgtcaagggcaactagagtgtgccttttaactagaaggaacaaaaagcttccattgaacgccttaacaatgt

SEQ ID NO: 656085 - DNA, 197 bp, Homo sapiens
tagatcgagccggtaccagacgtcattctgcttctattaaatatttttaactttttttaggatttccacactcaaaagaatgaaattagccagggtggtggctcatgcctgtaatcccagcactttgggaggctaatatgggtgggtcggttgagctcaggagtttgagaccagcctgggcaacatggcgaaaccct

SEQ ID NO: 656086 - DNA, 1407 bp, Homo sapiens
  misc_feature (600)..(600): n is a, c, g, or t
gagagagagagagaactagtctcgaggtttggttttgttctttatttgtggggggaaacaccatcctctaggggtatttccccattggttccactgactttcttccggtgggtgccccttttaactctccgaatggcttgaaaagccgagaggattatctccccgagtttttttgtggagggcttgagagccgtgctgcaagtgtggggaagttgattagctttacaacaggctccatagctgatactcaagtagacgtggtgggcgtggacattttgtcattttatctctcgtgtgacagatctccaagagaacgaaattattcgtgggtgttattcaccaaaagtgcgaagacgtggttctctcatagtgcgtgaaactccctcacaaagattcaccgagcctcttccacgcttcttctgtccgatccttttcacaagcgtggttttatatcgggacaacttcgagaaagacgaagagaagccaatgtggtcgcatcacaatgagactaggataactccctcgagaaggaaagtgtgactatcccctacttatactctccgtgagcgtgagtggtgtctcgcgtatcccccgagaganagagtttaaagagctatcaacaataatcgctttcaagacgttcttctcctgggggagagaaaattctcgcgtgcacccgtgaaggcgagccaattgttctgtactcccatcttgctcgccttaaaaaaaaactcttgtgtaagaaaaaaagcggattatatgtgtcaatcgtgcgatgtgaggatatcagcagcccaggtcgtgaaaaaagttccactaggtgactcccttcaacaacagagtctagttgcattccaccccaattcgaaaaaaacaacatgtttctacttattacgttaccagaggggaggttacaatacacattaaacgaccccagtgggtgtggagccccccttgacaagaggggcccctttgtgaaaaaaactggttgtacaaacgtaggtgtcccaagggcggatccctttatcccgaggtatttaacaagggtaaccacaagggggtactatacagcattcggggagtttagcgcccagggaatattccccggcccttcaaaacgggccccgcacgaaaatcgcaccagaattagacttctggaaaaaacactatcctccacggagcatcaagggatcgaacaggattagattttgggaccagaaaaatatctaccccttgtagttaaaaaaggagagaacccccccgcattcaaactcttgggaaaagggaaaacgcgcagacttcccattagaaagaggcattaattcccccaacaaagttctccacagaaaaaccccaccggggccttggagaagggcaaacaagtatgccactccaacagtaacaacc

SEQ ID NO: 656087 - DNA, 438 bp, Homo sapiens
  misc_feature (316)..(316): n is a, c, g, or t
  misc_feature (328)..(329): n is a, c, g, or t
agcaagtgggcacgtgccgtcccttccccattttagaaatgggcaaacaggtgtgagaggtgtcctgcaagggtttccacctgatggctatgttctgtggtagctcctgcattgggagctactgcagagtgactccaggttccggaagatggaccggcaagcagtctgtcccttctttgatcacacgtatattccctaaagacatgtatgttccattctctccgggcttctaactggttctccctgcccatggtgtgtctccggcttctgtgccttgctctctgtactgatggctcccacagggacctgtaccaanctctctgcaganncccaggctctcctgctgtacctttctgttcacagttcagtgtatctccagaatggagttattttccttcccttccaaccttgcttttcccccggcgttcccattgctgt

SEQ ID NO: 656088 - DNA, 378 bp, Homo sapiens
  misc_feature (202)..(202): n is a, c, g, or t
  misc_feature (205)..(205): n is a, c, g, or t
cgcatgaaaatacttgtaagcacacatgatccctttgaattgttttactttccgggaacggcttttgcttttaaaaattgaaaaagttttaaacagggctttcatttggtcacccttgcaatccattggggtttagtttggaatttgacaactggaacaaaaaaacccttgaatccggggcatcccttggttttggtggtgntgntgcttcccaaagtccctcaccagggattaaaaaggaacccggtgtgcacagcaaatccccgaaattggtgggtttgccctcctggcaaattgttgggtttttccacttgctgttcaggacccctaaatgttgaaatgtggatgcatcccgaaataaaagcaattcattgtgta

SEQ ID NO: 656089 - DNA, 1043 bp, Homo sapiens
atcgagcggcgggagcgagggttcagatatgggcatctgatgaaggtgacgcatgagtccataaccagacctgcctgaggaaggggaagggggtaatgccttggagagtggagtgactcgagatgtgttcttggtagtcccagcctggggtagtaacgtgagccatggggcaagagtagccttgctcttggatgaacttgcaagataatgtcactccggaacataaagccgactggtgcaagaaaagctcacgtgtgccggcggctcgacgaggctaaggtggacccctatgtgctgtctagtccattacggcatgaggccatgatgagtacagcctcttgtatagtgtgcccagatcggtggtgaacatagctctttcaagtacaatagccgtgccaatcctgtaggaaaccatcatcgcagacggcaatccacagcatggctggaagaaggccatataaacaagggttactgaaactgtgagcagagagactgtctgcgaggaaagtttgccaaagcacgaattccgggccaacgaaggcggaatctcaaccatgggaaggaagaaaaacacgtatgataaatgccccaacgtgtgaccaggaagtacggcttacgaggcgaggcggcatcaaggatcacgtacaaccagcgacgagccagtcaagggactcaaccatagggacagaggcgtggaacaatagcgctgacatggatgtaacaaaatcgtgtctgagtcgaagagggaggcctatgttcttatgtctctagaggagttgtgggcaccagaccgttgagccatagttttgctaaatctatcagcgagagggaaccccatatccctggtgggaaaggcccaaatgcagagctccccatagcgaatttcgtgggcgtgtgtagaccaagtagctaggaggaaagcgaaggcatgaccaaggacagtcaacgctataggcttcgcgaggctctttctagggggggattgcaacttctgacccgggatagcccgcaacatagcgaaagaggttgaaagagatgagaag

SEQ ID NO: 656090 - DNA, 300 bp, Homo sapiens
atgagtatgaactgaatttaaactgggcacaaattcaccctccttctcatcgagaacatttaatggtttgcagcagttcatgttttggcgcactccaacacacccatccgagccttcttctcatcttcaaatgctcttaaagtaaacgggatggcatctaaacgccttttcaactcactgaagaaggcacgtgaagttttcatatttcagtccctactgtttagaggggtctcgtttgtaaatagttgttctctgtcctgcatcctttggcttgccctctcctgggcggtaaaaagcttg

SEQ ID NO: 656091 - DNA, 236 bp, Homo sapiens
gcatcacacacaccttttggcatgcataattttatttctctcaggtaaatagtcagaagtagaatactggttttatcctgtgtgtatagttttgtaagaaactgccaactgttttcggtatcattttgcattcccactagcaacggatgagagttcaggcgtccacatgcttaccaacactcgataatatgaggttaaaaatgtaggcatcctaatggatacaaagtcatatttca

SEQ ID NO: 656092 - DNA, 108 bp, Homo sapiens
atgtgctcactggcagctgcagctatgtagtgcttctttctagcctcaagttcagaaacaagctggactatctcagtgtgattgaattttcctgctgtggaatcatag

SEQ ID NO: 656093 - DNA, 168 bp, Homo sapiens
gtctcgacaacacgctcctgatgaagaccttgcagcagacttacgacgattccgcgcccactagaggcctgcgtcacttcatgggccgtcagtagtcccgaggccagcacaccaacgaccacttggccgccgtggccgcaccgacgggtcatccaagagaatcaagct

SEQ ID NO: 656094 - DNA, 201 bp, Homo sapiens
tcgtgggtgattagaggatcccaagttagcgggagttactgtgtgaagcggcctcagtgctgatgatcgaagaagtgaagctgggaggactctgtgaggttgtcttggttgtagtgatcaaagaagtcaagctgggagtactgtgggatgtggtctcaatggtggtgattgaagaagtgaagctgggagaactgtgggatg

SEQ ID NO: 656095 - DNA, 307 bp, Homo sapiens
gtactgataatgagtgctagctatactgctggacagagtcatggttggctgtgtagataggagtcttgctccaggcatcgcagattctcttcgtcatttaaaggtgtggatagagaaaacctcttcggccctggatggaacgtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatg

SEQ ID NO: 656096 - DNA, 331 bp, Homo sapiens
  misc_feature (38)..(38): n is a, c, g, or t
  misc_feature (124)..(124): n is a, c, g, or t
  misc_feature (246)..(246): n is a, c, g, or t
acatatttttatacttaaacccagttcaaattgatttnaggcttaggaaaataagttaggtttagttcagtatgtggtttagaaaatgtgtacacttattctggcttccagctaaaactgtggngtgtttcttgcctctgaattggacagatttctatgtttggcctgtattgtggcaatggtgtattattttgttcttgtcagttgcattcatcattattttaaaaagattccagaaagcctggngttacagttagcccaccttgaccctaaatgctgcactactgcattttgaccaagcattgggatcataaaaattatccaccttctg

SEQ ID NO: 656097 - DNA, 114 bp, Homo sapiens
atgtatcatattacattagctcacttgtccatgctcatttgaaaacaatcttatgcattatccgcaatattttgtcatggcttctcatagatcgatctaacttttgtagttaca

SEQ ID NO: 656098 - DNA, 1125 bp, Homo sapiens
gcggtagcccagtcgagatggaggaagatgcgacggcagacggattacgctgggaacgatggatacgacctgggggctgcggcctagacggtccgggcttggacgttcgcctcagaccgcggtggacgccgccggacgtctgacgacacggtcttcacggcacccactggacggaccaacaccgcaacgcatccagactcactcgacgtgtggacaccaccctggaccaacgccacgaacgttctaccgttgattatggttgttggcaacttgaccaactgactgactcctgtgtcacgatgtctaccccacttcaccccctcactccgcagcccgtgtttgcaacgttcacgacacggggacacgacgcctctacccacttgggaccccttcgactcgccttgcctcacacgactcctggcgacggcacgactggtactcacctgtggcctctacccgacgggattcctgtgtcacatacctatcaccctcactctctggaccaggtgttatgtcaccacattatgagctcacaccggaagataggtacgctgacctacagaccagagtaacacagtcaacactcacttggtggcttggtgcgctcagcctcccattgatggcccagagcatcacagttgcccattggatgtagatctcccagacaccttgatgatgcaacgcaagggtgcgaaacatgggccggctctcaagagtgcgaggggaacccagacgggaccaggcggtcaggaagcctctcggccaacacaccggacctccatcacggcagatacctgcagcgcttgcatggacctcgccggctcctcatcgacgccaaagtggcatccaacagggtaaaccaacataataccaaaagaagtagaagactggtgagcactgatcaccatacccactcaaaaacacagtacaacaaacaggggggccaacaggcagggccaccccaaggagactacccacccggcaccggcgccccggggtgtgagaccaacgctcccacacagacaaacacccccgagcgcaagccaccgggtgacaataggggcacaccacaccctagacctacacactcggagccacgcgcgagagaccaaagggctcgaacac

SEQ ID NO: 656099 - DNA, 348 bp, Homo sapiens
ccattgatcagctcaagacatatcatgtaacgttacattttattttacatctcacaaatatgtctgccataattagagcttcattaatgctgtcccacttggtaaacagcttgtcaatataatttacagtataagaagatgtgatggggcataatgaacttgtatacttcatcaatcgactaagaaagataatagggccttaataggaacacagtgggagttcatgaaggaaagagttcagaagctctttcccatgtggcccccaaatggtacacaaaagcaaaacacacagagcgcaaccgcgggttctctgagggaagaaaaaacgaaaagtgatcatccctgagc

SEQ ID NO: 656100 - DNA, 519 bp, Homo sapiens
tggatgtgtaaaagggcttatatttgcgggggagcaggaatttaatcaaaagggccaaatctcccatgtgttcatcattcgtgactcttaagaacctccctcctttcttctcattcttttcttctccttctgtgcgtgcagcaggggcagaaccagcagcaggggctgcagagcctgtggggcagcagagacggcatacagccccaccagcgaggtacactgtggcaagcttgccaattacccgtgggcaagtgacgttctctcaaggtttttcccattctcagctcacgtgattacccttgtttgagccggctcgtcgtccgcctcgatacccagcgcgtgttccaagaatctctctggagtgctcctgtggccctggggagaggagtggccccctatggggacacgccagcagggtacggaggcagacagtagcgacattcgacggcggcagctccttgcgagcggaaaagctcctccaacgcggtgcaaccctcggtgaagagaacgacactagct

SEQ ID NO: 656101 - DNA, 900 bp, Homo sapiens
gagacgttcttcgccgagagtcgtcggcggtttcctgcttcaacagtgcttggacggaacccggcgcatcgattcccacaccccggaccggccgcccatagaccagaccctccgatcacctcgttcaccgcacccatcggacatgcacccaaggcccccgccgccgactccagcgccgacgcagcacacacgccgaacgcacgacgaactctccattagtcgaccgcacatgacgaccgcagatccacctcgcaggtgcgccagaactaccaccaggacatcagaggccgaccatcaaccgcacagatcaaccgtggagcgtctacgccatcacaagtacgtgtaccatgatccatgatctctacgtacttggaccgcgatagatgtggccttagacagaacatatagcacaaatacctttcttcacacaatctcatgaggacgagggaacatgctgcagacaacctgatgacggctgcagaaccaaacgagggtgagacgaaatctgtccatttacaggatatcaaggaaaacagacttgtgatgactgggagagccgggatgaatgcacatggaagtgtgcaatgacatagggcaaaaaactgtgaatcagtcaactacagggaaaatggcaacaaaaaatggcccaccagacaaaaagctgaaccccacaataggcgcacgaacgccagaagagcaccaacattaaaccctggaaatggaggacagggtgcgaaaaagcccagtcaagaggaacgcagggagtcggaaccacgaatgaagccaaactagcagaccaagcatggggaaggagcgacggagagcagggaatgggagggaaataatagaaagaggagaagaaggcacaaaccgaaggggagagaacagggcgataaatga

SEQ ID NO: 656102 - DNA, 101 bp, Homo sapiens
acatcaacatcttgtcagactttgaactcttcaatctcttgcactccaagcttgttaagatagttaagcgtgcataagttgcccgccaagtcgaatggtgc

SEQ ID NO: 656103 - DNA, 106 bp, Homo sapiens
gggtctcagcgaagcgtctgcgaccgtcgtttgagtcgtctgctggccgctgccgcgtgccactgccactgccacctcgcggactcacggacgccagcgttgttcg

SEQ ID NO: 656104 - DNA, 778 bp, Homo sapiens
  misc_feature (32)..(32): n is a, c, g, or t
  misc_feature (117)..(117): n is a, c, g, or t
  misc_feature (138)..(138): n is a, c, g, or t
  misc_feature (140)..(140): n is a, c, g, or t
  misc_feature (147)..(148): n is a, c, g, or t
  misc_feature (150)..(151): n is a, c, g, or t
  misc_feature (156)..(156): n is a, c, g, or t
  misc_feature (164)..(164): n is a, c, g, or t
  misc_feature (177)..(177): n is a, c, g, or t
  misc_feature (181)..(182): n is a, c, g, or t
  misc_feature (185)..(185): n is a, c, g, or t
  misc_feature (190)..(190): n is a, c, g, or t
  misc_feature (192)..(192): n is a, c, g, or t
  misc_feature (228)..(228): n is a, c, g, or t
  misc_feature (236)..(236): n is a, c, g, or t
  misc_feature (243)..(243): n is a, c, g, or t
  misc_feature (440)..(440): n is a, c, g, or t
  misc_feature (442)..(442): n is a, c, g, or t
  misc_feature (459)..(460): n is a, c, g, or t
  misc_feature (479)..(479): n is a, c, g, or t
  misc_feature (589)..(589): n is a, c, g, or t
  misc_feature (639)..(639): n is a, c, g, or t
  misc_feature (660)..(660): n is a, c, g, or t
  misc_feature (674)..(674): n is a, c, g, or t
  misc_feature (778)..(778): n is a, c, g, or t
gaagagaggaagcccatttccaggccagatcnctcaaatggcccattgagggtcattgctgccctttttcttcccttgctgactggcagtttgtagaacaggggatccatctaagtnccctaagagaaggtagagctncngactggnngnntctgnccctctgnctcatcccatggntggnngcncattngngctgagttaggagagagaaatcatttaatgtggtangccagttngatttangagctgtttaacatactattttgttatgttatgagtagcattcagattgcagatccagcttctgaataagctcaagaactttaacttctatccctatggcctatgcccaggggaagatgggacttaaagggtgtttgtagaaatcatggtagaaaaacttacatacatatgtgtatatatatatatagatacaaaananaactatacatatttaannatactgcgcggcttgctgngtttcctgagcaggagtggattgcggcagacaaaaatcagcaaatgccccctgcgtcctgtagagagggcctcgccaatcccctgattccataagctcttgagatctgcnactggtttctctggagtcatattgggatccctgaatcatctgcagcctgngtgtcctaaagagcaagccanatagctgggggggnagaggctcagcggctgggataaggctgttctcataagggttggagtaggggcatcggataagcccccttggctccctgggagtccctgagctgtagtcagttgn

SEQ ID NO: 656105 - DNA, 204 bp, Homo sapiens
tacctggactcagtcggctcatggatacgctgggaggaactcagctcaggtataacgctgggaagaactcaggctcagagtataaagctgggaggactcaggctcagggataaagctgggaggaactcaggctcagggataacgctgggaagaactgcagcctcttcttccctttcttggtctcttcagaaggcttagggcttg

SEQ ID NO: 656106 - DNA, 108 bp, Homo sapiens
tcagtaatgcggagcacagtaagggagttcagtaagcgcagcggtcacgcctgctgggggtatgttgttgttggaagaagaggaggcgaggaggtgtgcatagatctg

SEQ ID NO: 656107 - DNA, 285 bp, Homo sapiens
gagacggggtctcacgagaggaaagataacatagtgaagatcccgccttgggggaggctgaaccacccaggcctccattgccaccttggctggcagggcaagaacggtgtggtgtggtcttagctttaaaacagtcacagttctagctctatcatagatgaacaaatactttctggatcattctgtaagaccaggaggtgggtaagagtgactaaccagcctaactttaatacacatgtataaagatgtccacagaggaacagatgctctgtagagaatcggcta

SEQ ID NO: 656108 - DNA, 178 bp, Homo sapiens
gggtgactctgaggatcccccacatcatcacatcatcatcatcaccagcagtcatcgtcatcatcatcacatatcatcagtcatcaacatcgaccctccattaagctctacttttacctacgcctaattctactccacctcatcatcagtatcaccatcatcatcatcatcaccatca

SEQ ID NO: 656109 - DNA, 373 bp, Homo sapiens
cctccttacatcaaaaagatctctccggtgtgagtctctcgtgattcgaacagaactgcgcactaaaggctttaccgcactgtttacattcgtagggttctctcctgtgtgagtcctttcatgtattttgaaagtttgggagaataaaagcctttctcacatatactacatttattaggtctttctccagagggcattcttatgtgtttttctgtcctttcatgaatttggaggtggttcacatatttgagggcttcccacattccttacattcatagggtttctctccagtatgagtcctaccatgcactcgaaggtgtgaggtagatctgaaggctttcccacattccttacacactgggttaagtaagca

SEQ ID NO: 656110 - DNA, 128 bp, Homo sapiens
cgcatacggttacatttattcttacaagtcttgccctccctattgagatagtgatactacctccggtttctcatgaatgttcgttcggtcgctcttacaggaaacagttgtccatgtataggagtcaa

SEQ ID NO: 656111 - DNA, 638 bp, Homo sapiens
gcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacagggcgcaacccggttccaaggctctggattcctccggggccaaggccaacccagggcgcgggtggcccgtggggcggcgagcgcagacgcgtgtctacactctccatctcgcggcggacacccgaggacggggcacgcctcatggatgagcagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaacgaggtgaatatgtttacaaaccaaggaacagtgatccactttaacaaccctaaagtcaggcatctctggcagcgaacactttcacca

SEQ ID NO: 656112 - DNA, 219 bp, Homo sapiens
aaagttttattattcattctgcccacaggtacacccttaggtccaagagggtgactatctactaagggtaaaagtactacggatacttttctcatgttctgtcctatgacccatctctgccctcaggatactcccaagtctagacataaagacagtttaaaaaggacaaggaatctgggcacagtggctcacacctgtaatcccagcacttttgggagg

SEQ ID NO: 656113 - DNA, 135 bp, Homo sapiens
  misc_feature (126)..(126): n is a, c, g, or t
gaaacaaacaatacaacaacaacaaagaatgcaatctgtacttttcaacacctacccttcataggaccttgcttggtaaagtaacccccactgcaaaacctgtaggaaagaagatatttacaaagngaatgtgca

SEQ ID NO: 656114 - DNA, 99 bp, Homo sapiens
  misc_feature (29)..(29): n is a, c, g, or t
  misc_feature (39)..(39): n is a, c, g, or t
ggcccacgttcactgagtagggactgctntagccggatnttaccggcggatctccgatgaggagagatcctgcggaggaggattgtcctgaattggttc

SEQ ID NO: 656115 - DNA, 1248 bp, Homo sapiens
  misc_feature (778)..(778): n is a, c, g, or t
gttttttttttttggggctgtcaattggtcagtccagtgtttaaaatctagacgcaggcttatgcggaggaaaatgtttccatgtcacttatactaacattagttcttctatagggctgatagattggctcccaatggggtgtgaggagtccagtcatatgttcggggattcttacacggtcagctgggtgtacgacgcttgaaccgcttactaaatgaggtaggcctgcttatcaggcctactatgggtgttacacttttttactctctctacaaggtttctccctagtgtccaaagagctgttcctcttgggactaaccagttcacactttacacaggggattcacacgggtcctgtgggcacacattcacacagctcgacctacagactcctcatcttggaccacaccagctatacaccaggctacggacaaggtaaagcacgcccatccaaccctattacactccttccccactaatatctgcgcataccaatacacaccggccagcaagcccctatcacaaccactgctcctaaacgcgtagcccacgccataggctataccagcggagcgacacaaccctatcggcctacatcactatgccacaagctccacgaacgccatagctagaaactccacatatactgccccaaacacggcaacacacgggcgctccaccccgccatcgccaagcacacaaacacagaccacagaaccaacaaacaccaccccacatccactaccacccagaccagcaaccagcaacgacaacggnaccacagaatccccaaccacccacacgcgccaaacaaccgacaaacctacgcgccaaacacaagcagcggaggaccacacaggacgaagaacaagagctaaacaacaagcaggggcaacatcacaacgccaccagaaacacaacaacacaggcacacacacagacaaacaccccacaccagcacaaggccccaaccagcgccactcaccacgcaagcgacccggtgggcaaacacaccacggactaggagactccacgctaggacgcgtaagcgacccacgagatacacccgccacacaaaccataccacgagcagaaaagagaaaacacgaggcgaccgaacgcagcagacgcgacccacacagcatagagaccacaacccacgccaacacccaagaaaacacaaggcaacacgacacgcgaccccgcagcacaacacaacgacgacgcgcagcacgccgaaacagaac

SEQ ID NO: 656116 - DNA, 233 bp, Homo sapiens
aaataattcccttttgccccttactcttcccccctttttttgcatgaagtcataaaaggtatggccggtattttttggcttggaaaaaaaaaaaaatctatttttgccggttgaagatgggatggaaaatttttggggaacatggatataaaaggatattttttggaccctccctatacccatatccctgctgattcccatggaaaaaaattaaagttttttggaattttcca

SEQ ID NO: 656117 - DNA, 195 bp, Homo sapiens
tatactcggactcatgatgtatatgattcgccgcgctacttatgctccctgaatactgccacaatattgtttgcaggacggactgggaattaatcatccagcacattgtccatacctgtgtcacattcttactccgacaacaccctcatgttcatacacctatcccccattcagcctcttggacacgaatgttca

SEQ ID NO: 656118 - DNA, 406 bp, Homo sapiens
gtaatccgaccggcttacaaaagtcgctcgccttctccaagaaaatccttcatgttgactatgtaatatactacaccactatctgcaccaggcaacttactccatcattgatgatgctacaatgagcgatggacttcctgcttaggtaactaagaacgaaaggttgagttgcactgcccaagcagttcgatgacgtccattgtggtgacccctagcctttaaaggagttagcttacatagaccagctcagtctctgaaacctcaaatagctatggaccatgaacatgaagatggacttggatgggacaatggggatggtcttcaaagtgataccagtgctgatggagcacaatttgagttcgatgcagccactgtcagtgaacacacaatgctattagaaggaaca

SEQ ID NO: 656119 - DNA, 1027 bp, Homo sapiens
attggactcttcatgcctcccggccgcaatactgccacgatgtatgcctggagtgcgatgcccgggatgcatccgtggacttgagtggcttggttctggtcattgaacctcctcgatccgcacagacgtgcctggcatagcccccgagagactcgggcgatccttcgcggaatagccgcgtcctccatctcgcgcgagtgaggtgggcatgacatcaatgggataaactaggaattcaacgggtccatacgtggtgagccacgtgcatgaccacatgccccattggatggtgctgccatgaccgctctgatcgcgatggccgtgtgtgctcgctttctcccatgacatggtacagcggaagggacagggactgtgacacataaacacaagagaaggccccaatacacatagatgtttgtgccttgtccctgtgctagtctccccacatacagaagtgcaggccggcgtactcgcgttacaaaagcgtgccgttgtaccgagccctgtacaggggcttccggaggggcttaccacaaagaacgggaagtgatttctgtaagagctggccccactttaaccctagtgatacacggcctcgcgcaggaactgattgtgtagcgcagaccacccccgaatcaccatgaccggaacgaagccgacctagtaagatgcgcacgtgcgcgaggggaagggtgcgaaagccccacagtgaagagcaaggccacttggagcagcatggaaacagcgggatcccatagaggagtacacataccatgcctagggcatccaggtcctcctagttgtttcgccccttatcagggcccaaactaaatatcccaacttctggaaacactcgtgggattgagccaaagaggtgccctatgggtcacaaaccacggaaggtactagggagttaccgagacgtatcaagagggacatatcgcagtcgtagaaattgaaagggatgaacctccatgggccaacaacttgaggtcaaaagagaagaggccattacagtacttccaaa

SEQ ID NO: 656120 - DNA, 813 bp, Homo sapiens
agcgtgcgccagaggtgccgctggagtgttcccgcggcggcaagagggcggcttgccaatgctggttggccccccgggcgtacagaccgcgtgccgctcgctcgcctcggtgagaacacttcccagggccggacctttagtcccccccgggggaccccatgggggataatgatcccggacgctgcagccccacaccagcgggcaaaaaaaggggggggtttctcctagaaacgcaggcctcgatcaggcgccgccgacatccagcaagtggtgctgagaccgcactgaggcgtccccacaccctggggttggccttcgctgtgcgcgaaggcgagccccccccccagcaagtttgttgcttcggcacgcgctgtctcacctcgccccattggtaaaatcttgggcgccagatggtctaatcttccccccgacacacttctttgttcgaagcggcttgggactcctccgccagaagctagaagtagcctttcggtgcagtggcccccaccgcaccccgcgcggggggagtaagcaattgtgttgactccccacgcaagtaaaagaacaatattgtagatgatcgcggggccagcgccacaacaggtgtgtccacgcgaagacttgcggcgattccccgaacatgttctcccgcaaagaagcactaactcattttcttcagccttcccgcgggcaggccatcgagcattggttgctcgtcgtggtggggatcgtggtaattattactctcagccaaatcggggtgtttcaaacgtccatagaacccgcatatgtaaaagacggcgcaacaaaaca

SEQ ID NO: 656121 - DNA, 1822 bp, Homo sapiens
ggttgcgtatggggggaccgtgttgatgtctatagacgcgttcaggtatggctgtttgactcagggtggaccttatttatatacgcttaagagcgagcgcagacgacattaccgcgagtccagcgagtcagacatccgctcacgtcggtgtgatccgcgtccagcttcgacttgtgctctttactgtccatcgagacgtgggagggtggtaccgcaataatcaagagatccttagactggagcaacagatcttcgtgtgtagaccgtgagcagaaggagatgaggacgagtacctgaacctctctagatgactcgttgaagaggaatatcatatcgtagatccacattgtcttacctcttagcacagactagattagccagaatctaaccattcgtgggctggcccatgaatgcaaatacacccgacaaatgtttgtggttactgtaggataacaacgcattatgccaaatgagtatccttggaatgcgagcatagtgacattgagcgattctaattgctgtccatttaccctaagaccggacaattcaatttatgcgtgccccaatgatcactttgtggaatgcacagcccagggatgagcgtgtgtaatttcctacccaagttgccctagaatgcgtaagcacatgttccatgcgagttccttagggtcatttgtgttatacgctattgagtcacgccgtactaactaaaggctggagattagaggttccccctatttggggaaaagactaaaaaaccctttatgacggcaaggtaagcgtttaaattgcggaaatgggctaccccttttgtaactgattacaacaccgctgaagacggaacacgatggaccctcctctccataggggacggttgttgcttgttgacacccctaataggacaaggccacatggcaccacatttttgtcggaatgcaatagctacgggttcaaggaaaccattttcggttacacaatgacaagtctctttggacataaggttttttccgtttgttcaaatctacaacgtttgttacaggtgagggtgacatacatcccttagagagacaaggggaggctttttaaggaaaattcacaacgttgagaggagttcccgtgtccaacaagaggcttggactaaaatcacatgccggaaagggattaatctccaacaatatccgttggttcatccaacaggtcataattgtcctcaccctaacattagcgttttctaatatccttgcccacttttttgcaatcattgtggtcgacccaccggttctttgtggtggacatatcaaaacacaaaagcgttatccctgtcggagagcgcagacgaaataaagaacatggggaatctctcatgtaagaagatttcggaggcacaggaagatattaccccaaaagagtgagattcccgtataataagtttgaagacaatcacgcctagaagaaagtgtggagcgtctgtaaaaacaccagatgtaggaagagaagtcaaagcgacctttaaatataaccgaacggcgcataacaaagaggaaaagaaaagtgggtgaccgacgaaaccacagaggcacccacgcatcagccaaacctagtagcagatagaaccagaacagccacaagagaggagttggagcagaaagaacaaccgagactgcatgcacgaccaactgcaatagccaaccgagcattagcagcaaagacagagtgtagtccaacactgcagagcagcaatgagtccgtagcgcacaatacatgacaatcatgcaagcgacatggcacgacaacaacaagagcaacaagtgacagaatgaac

SEQ ID NO: 656122 - DNA, 114 bp, Homo sapiens
caggttctttttgcacctttcccagacatgcaaatgactccaagggttccatcgtcccctcctgccctgtgtacctgcttgcctttttcagctgccccacctcccctgggctgg

SEQ ID NO: 656123 - DNA, 590 bp, Homo sapiens
aagatttaaagaaggaagactgaactaccccgagcaagaatcccaccagcacacaaacttacgactctgctgcgcgcaatcctgagtccccagcctgacagacccgacctgcagatataggactcgacaagcctccacaatctctctacatctctatatcctgtagctatacgggcttctctgaggaaccctgactacatacaggacacattttatttatatgagaaacatactagaaattttatgtcactaaaaagaaaatcttttcatttctatgaaacatctttcacttgtccatttttgatagagacacagcgtgaagaagtacttctctactttgaaaaaaacaacaaatggcacacgatcaatgacaactaactctgtggtctggagacagggacgacagggaggagtggggtctgcagtaaattcaaactaatggaggcagtggctccagcgatggctgctgtgtgtgcaggactgtgaggctccgtatagtacagatcttctgattcttcaaaaggatccagaaatctgaatatcttgtgtaacatatccccatttataaacacagcctcaaaaataccttg

SEQ ID NO: 656124 - DNA, 265 bp, Homo sapiens
gccaaaggcttggccaagctgagccacacgtttttcaagacagcctgtgaactaggcacatatccttcccttccagtccataaaaaccctggaccagcctcgtagagagaaccactttcagatacctatctctgctggcaaagagctttcttctcttgcttcttaaactttcactccaacctcacctttgtgttcacgctccttaatctccttagaggtagaacaaagaactctggatgttatctcagactacgagagattttta

SEQ ID NO: 656125 - DNA, 152 bp, Homo sapiens
tgcgcttgttggaccccctatggggtcaccgtgatgttgcctatattgtggtgtgtccagaaaatgaggccttgtccgaagggagccaaacagtttcttcaggtgacttgatgtgcctgtatacgacgactgtgtaggctatgggcacgcac

SEQ ID NO: 656126 - DNA, 165 bp, Homo sapiens
atgtgagtctgagatttagctggaatggcttgttatagttaggggaagtgatctgagtttgaaaaacgctgtgtgccaggtcaccattgttgccccctcgggcgcctctgtttccagttgaggcccccggtggcatcctcgtagatgtcgaccgtgcagtgcgtg

SEQ ID NO: 656127 - DNA, 289 bp, Homo sapiens
gtgagcagtagtgacgccagaatttctgttcccatgactcttgtagttctgtcccggtccccgcaagccccaggaggggaaaaatgtagatacaaaactggtagggcctcaaaccgagttaggcacaagtcccatttctcgtcaataattgatttcatctcccaaggagctgaaggcacgtgcagttacagggctgtgcccgtattcgtctgggtcaagagaagaacacagctttctttagaaggaacatttactttaaaaccaagcaccttgattagatatgtcagtg

SEQ ID NO: 656128 - DNA, 669 bp, Homo sapiens
atgctaatggaactcctgctacatctgacagcagacttttctaggcgaaacatattacaggctgagcagcagtggcatgcacatattaaaacaagctgaagacacataaaaaaatactttcattttacaataatgtatttggcaaaaagtcctttaaacttgacagagaaataagaactttttccgacaaacaaaaactgaggtatttcattaacaacagacctgtcctacaagaaatgctaaagggagttcttagcctgaaagcaaaaaagtgcgtgagcaataagtcatctgaaggtacagaactcaactagtaatagcacatggaaaaacacagaatattataacatggtaattatggtgtgcaaaaatctcaaatagaaagagtaaacaataaaccagtaaaaaataactacaacatatttccaagacatagacagtaaaatagggaaggaagagaaacaacaaaaagtttacaagaatggcaatggagttaaagtgtagagttttaataagttgcttagcttgtatctttgtttatgcaatcagtgtaaacttgtccacaggtctaaaatgacatgttataagatattatattcaagcctcatgatattttaaatcaaagcgtacacaatgccaaaaagtaaagcatagttgttatttacgata

SEQ ID NO: 656129 - DNA, 166 bp, Homo sapiens
tacttatgcaccattcagacttgtgagagtagatgtgggttaatgactgccaagtttgcccagtaccagtagtttattatcactaaaagtcggactcattgatggagtcctgtagtacgttcagtgttagatacagttttttccaccatacatctgttgcttttct

SEQ ID NO: 656130 - DNA, 159 bp, Homo sapiens
gtgcaggccctatataaaagattgttaagggaattaattgttagaccacgggcatgaaactgtgtgtttgctccacagatttcagagcattgaccgtagtatacccccagacgtataacagcgcaagacctttggattacacgtccgggaatagcctct

SEQ ID NO: 656131 - DNA, 616 bp, Homo sapiens
  misc_feature (428)..(428): n is a, c, g, or t
  misc_feature (539)..(539): n is a, c, g, or t
ttttagtttcatcccaacgttttaatatattctctatcattcagcccaagtattttctaatttctcttgtgatttcttctttgacccgtgagttgtttaaaagtgtgtttaatttctgaatatatgggggctctttatgttatatttttgttatttatttttcacttcagttgtggtcagagaacatattctgcatgtttcgagacccggcttatggtctgtcttggtgagtgttccaggtgcacttggaaaggatgtaccttctactgttttgggatatagaatatatatgtcattgggttaaccctgttcaagtcttctgtattcttactgactttctgtctgcttgttctgtcaattactgagagaggcgtggttttgactattttttaggagcatacacatttaggattgttttgtcttctggntgagctcatccttcttaagctttgaaaaaataataataattttttatgaccttccttgcttttaaataatgggtttcgttcacccctgaagttgtcccctttctcttggcngaggagttttttttgggtggcattctttgtgagtgaaattggtagtagggctcagaaggtcagataaagcaataata

SEQ ID NO: 656132 - DNA, 436 bp, Homo sapiens
ctgatgttatgaagaactgtaaacttcttccaaagtacttgtttcattcatgactccaccacaagtacaacatggttccaattcctccatacttttgccaaacctgttattccctgactttttgttacagccttcttagtgggtgtaaaatgatctctcatcctggtcttggattgcattttcattacggctaaaggtgttgagaatcttcatacgtgcctactgatcattcatatatcttctttgaaaacagtctatccaatccttggaacatttttaaactttgctatttgtcttattattaagtttaagaactatttatatattatgggtcatgtcagatatataacttgtaaatattttgtcccactctgggtgcactaaattttactttttgatgttggtctttgaagcacaaaaaatataattttaagtt

SEQ ID NO: 656133 - DNA, 653 bp, Homo sapiens
atgatcctgcattaaaccaaggacagcatcaaaggcacgtactggacagcgaagggtacttgctgttctatcacaaacagatcctggaatacgagtagccttatctagcagctggtcagaaaaacaaaggcaatgcattggcaagacctcacaaagtgatcctccctggccgcaccatcaaacaaaagaaaccaaacgacaacaacaggacaagagagaacacacagcactcacagagcaacgagcaagagacaacacagacacaaggaagacaacaacagaaacaaacaagggactacacaaggcaacaggagacaagcagacatagaaacataaaaacagcaacaagcaacaaaaaaaaaaaaaaaatagaccaacacgccgcgacgagcagaaacaaagaacacgaccacacataaagaaaccaaagcctcagaccacagctcgaataacatgcacacaagcccagaagacagacaaccagagaagcagcacacgacataacccccaacactatacacccacctcgcatccctctacacaaagcaccacaacgagcacttaaaaaaatacactatcatgaaaagaagaacaaacaacagtaatacaaacaaaacctaacatagaaaacaaacacaacacatagtcacaga

SEQ ID NO: 656134 - DNA, 188 bp, Homo sapiens
gcagtatcaacaaaccatctaatataacgcaaataatcactgaaactccacccacatcttaaacctgggctaaactgtcttatacctttagcctatgaacgttgcgggcggagaagaagagatgagtatctcattttgacgcgacaactcaataattcggtcgtgagcctctagcagtaagctctgag

SEQ ID NO: 656135 - DNA, 164 bp, Homo sapiens
attctcttcgttgtctggtgactgcacattcactccaccaccaatcctaaacgctgtccctggccacctaacgcgattgctgctgcattagacgacccggtggacactacgacgagctccgttgacggagagccttggattagtccgcccccgctggtaggcag

SEQ ID NO: 656136 - DNA, 218 bp, Homo sapiens
gcccctccccccttcctttttcccccccacagaagaggccagggactcccgcaaaggggcaaggttcctccctttcctgcagagtaggcttttgggccccaagcccttccctcaacagagggccctgggccccacggagttttgggatgggaggggtgggggcatgggaaggggggcctccccccccccagaagaactgaataaagattgttgggcca

SEQ ID NO: 656137 - DNA, 578 bp, Homo sapiens
gaggggtggtggttcacccccacctctttggtccaaggcaataatatttctttcacaaatttacaaacgtcaagacctgccagcaataagacaatagaacagcgtactcagctctcgcgtcgggaatgcctctcgcacaaggcattaatgtggattcacttgcacagctgctctcataaaagctacacgattcagaggtaaccctaactatccgcaatcccaaccaaagtcatgttcatgccgctgtcctagtctggacaatcatctgtcactcatccaacacagttaaatacagaatgcgcagtcccagcaacagtgtagattacagcaggcgttctctacctggactcatgattggatttcatttctaaattacatcagagctttcaaagattgaaatacacaaatctgcactacccaagcctccttgcctgtacgggaaacaaatcagaagagcatttattgggaactgacacgtcaggcctcacaggtgctgggcaggaatcacagaggcttgctctgcatcatgtcttccgttaacctgaagctttgggtttattgtgcttgccaaccatcgt

SEQ ID NO: 656138 - DNA, 128 bp, Homo sapiens
ctgctcttgatggatcccatcagttgcttacaatcaagtgctgtggagtacgctgtggcaggatgaatgggacagtttctagccccctaggtgatgcacttgggtgggcactggtggtaggtggggca

SEQ ID NO: 656139 - DNA, 220 bp, Homo sapiens
aaatctggatgacattttcaataattcggcgctcacaacaaaaactgccgtttttataaagaaggaaccagtcaaaggcgcttgcacctgactttgggtgctggggttcatccgaggccggcttcgtcggacagcgatagtcacacccctggccccacgcggagcacagtccccttgaggccttttttgcgtggccccaacttcctgctctcttgggcag

SEQ ID NO: 656140 - DNA, 574 bp, Homo sapiens
tgtggtagctcatgcctgtaatcccattactttgggaggctgagatgggtggatcacttgaggtcagttgttcgagaccaaccagaccaatatagcgaaacctcatttatactaacaatacaaaaattagccaggcatgcttgttatcccagctactcaggaggctgagacaggataatcgcttgaacccaggtggaagaggttgctttgagccaagatagcgccactgcattccattctgggtgagagagtgagacgctgtctcaaaaaaaaaaaaaaaaaaaaaaaaaaaattctttctttctttctttctttctttctttctttcctttctctctttctttttctttcctcccttcctttatctctctctctctctctctttctctctttctttttgagatggagtttcactctcgctgcccaggctggagtacagtggtgcgatctcggcttattattattctccatgttggtcaggctggtcttgaactcccaacctcgggtgatccgcctgcgttggcctcccagtgctgtgtttaccactgtacccggcttgccgtcttctttccct

SEQ ID NO: 656141 - DNA, 249 bp, Homo sapiens
tcgtcatcaccaagatgccacagcaggggaggtgactagcatgggctatatcgtgtaaaatgactgacatgcgaaattattttaatcgatcgcacagaatacttgatcttattgatgcttttttagtgatatggaaaagttgaattggtagctcttcgtgtcctcccttccacgatgtttatgttgcccccaacttgagaggtatgaagcatgtatttggtctgcatataagaggcagagccaccaggg

SEQ ID NO: 656142 - DNA, 1277 bp, Homo sapiens
atggcctcattggtatcagcactctggcctgcaggcctccctgacaccccccttcactgatgcagaccccagctaaacctgcctctgtgccagtggctctcaaatcaacctgtgcctgtgatgtcccctctgatcatgggacttgatgtgaacccagatgcctgcttgacggctctgctggacatctgcaagctcctagaggctgtctgtccctccagccctacctcctctggccatgaaatccccactcagctgctcggcaaggaccttcagtcatccctgtgcccaccctttcccttggcctgggcactcctcctgccaactccacttctgagctttcacccagagggctgtgcaccctcccactcccactgccttgcctgtcatctctccttgcacccagtgcaaacctcctccagtggtctcccggcccatcagcctgtcatgggctggatgcccaaatgcagggccaagctcatgcacctgctgcttatgagcttcagtgtctgcctgatgacctcaggggatccgagctcctcggcacggcagccgaggtcccctacgctgagctcagcatacctgcccagccacggcagacagcatcctcagtcacgagaagtctgtgcttctggaacctggaacatgcagggctttgcagacagagctccatgctacttcctctgcccttctcactccctccaaaatccacactgctcccccgtcaccacctgtgccctcctaattccatcagcacccatcagccactcaccagccatcctaactccatcggccaccttcctaattccttagcttctacgccactaaggcccccaggaagagactatgctgttcactctgatgaccccaggacccaggagtgttctccctgcgtagcaggtcccctctatatgctgttaattcaaaggcactcaggttagtcctgagtcaggcctggatggggatacaggggggaaagttacaaaagaaggatctggggacgggtatggtggctcacgcctattatcttagcactttgggaggctgaggatggaaaatcacttgaggccaggagtttaaggctagcctgggcaacacgctgagaccctatccctaaaaataatattttttaaaaataggcatggtggcaagtacctgtagtctcagctattgggaggctgaggcaagaaaactgagtgagcctgggagttcgaggctgcagtgagcaatgatcgtaccactgcactccagcctaggtgacagggcaagaacctgtgtct

SEQ ID NO: 656143 - DNA, 377 bp, Homo sapiens
tccacttactgcgacctctgcctctcgggttcaagcgattctcctgcctcagcctgccaagtagctgggactgcaggcgcgtgccgccatgcctggctaattttttgtatttttagtagagacggggtttccccgtgttagccaggatggtctcgatcttctgacctcgtgatctgcctgtctcggcctcccaaagtgctaggattacaggcgtgagccactgtacctggcccgtaaacttttttttttaactgaggtataatgtacatacagaaaagtagtttaattgtaaggtgaccacccagatagagatatagaagacccagaagtctttttttgttttttgtgacagagcaagacttgccctcaaaaaaaaa

SEQ ID NO: 656144 - DNA, 277 bp, Homo sapiens
ttagtgaattgtcgaagtgagagtgaatagtttaagcactaaaaaccctagaggtcagtctaagaagaagcccatttctgaatatatctcaaagaactccaaaaattctcaaagtaattacggaagaaagttaccctcatgactgacaaggggaggggaagtaacactttttaagttcaccctggaaaagcaaccactatctacacaccacaccagacacatcgcacactcaccataccacacactacacacatcgcaccacacacacatcacacac

SEQ ID NO: 656145 - DNA, 111 bp, Homo sapiens
  misc_feature (37)..(37): n is a, c, g, or t
  misc_feature (103)..(103): n is a, c, g, or t
gagaggtgtgagggtgtggccagcctgggagggagtngggacagaggcagacctgggagaggggccggcaagatgggccaggataggcagaggtgcgcaggcngagtgaaa

SEQ ID NO: 656146 - DNA, 479 bp, Homo sapiens
ttgcaggactcggaggagccttacccgacttttactccaggatcacatcaggccgacccctgtgccctcccccaggatccacctccaggtctgcctcctggtccccctcctcgtggagccccaccaaggctacctccccctgcacctcgcaggtattcctccaactcgtcctgggatgatgtgcccacctttggtgccgtccccttggatcgtgccccccctgggctgttcgcatcatctctcttgccaaagcctggggtttgaagtgccccacccaacttgattcagcgacccaaggcggatgatacaagttgcatgcatcattgagaagcaagccacagcatccatcagtgccaagccacagatcactaatcccaaggcagagattactcgattggtgcccactgcactgagagtacgtcgggagaataaaggggctactgctgctcctcaatgaaagtcagaggatgattctgctg

SEQ ID NO: 656147 - DNA, 131 bp, Homo sapiens
gcccagattgagaaagaaggaaggaaacaacaagacctggcactagtgcattctcagtttgtgtttgtttccttccttcttttctttctttcctctctcttccctccctccctccttctttctctttcttt

SEQ ID NO: 656148 - DNA, 444 bp, Homo sapiens
  misc_feature (9)..(9): n is a, c, g, or t
  misc_feature (11)..(11): n is a, c, g, or t
  misc_feature (14)..(14): n is a, c, g, or t
  misc_feature (190)..(190): n is a, c, g, or t
  misc_feature (360)..(360): n is a, c, g, or t
gagacggancnacntctgtcgcccaggctggagtgcagtggcgcaatctccactcactgcaaactccacctcccaggttcacgccatcctcctgcctcagcctcccgagtagctgagactacagatgcgcgtcaccacgaccggctaatttttttgtatttttagtagagacagggtttcaccgcgttancaggatggttttgatctcctgaccttgtgatccacctgcctcagcctcccaaagtgctgggattacaggcatgagccaccgcgcctggccagcaaatcattcttaattaccccagagtggaagagaacaaaggttgaaggacaagagcccaggtttcaggatctgttttntttgggggtcatggacagagggcgaggggaagggagttgaatttgggattcaggcagtggggtgcttccctggttccttccttt

SEQ ID NO: 656149 - DNA, 498 bp, Homo sapiens
tagtaccactagtcacggttggctagttggaaagttaaggagactcagatcactgggtgggtgaagctgagaggtgacagcatgctggcagtcctcagagccctcgcttgctcttggcacctcccctgcctgggctcccactttggtggcatttgaggagcccttcagccccccactgcactgtgggagcccctttctgggctggccaaggctggagcccactccctcagcttgcagggaggtgtggagggagaggcacgagcgggaaccagggctgcgtgcggcgcttgcaggccagctggagttctgggtgggtgtgggcttggtgggccccgcattcggagcagccagccagccctgctggccccaggcagtgggggacttagcacctgggccagtggctgcggagggtgtactgagtaccccagcagtaccagcccaccggtgctgtgctcgatttctagctgggccttagctgccttcccgcggggcagggct

SEQ ID NO: 656150 - DNA, 617 bp, Homo sapiens
ccggttgtgacccgctccgtaggtggtaaattgtgctcccactgcacatccggggggaggttttaacaacctgctttagtatagcccggttaccagttggggccacgccattccactccggaaagttaaccatctcccatccacaggcatctggggccgcctcagccccctcggctctcctaccaggccctggccaagcccggggacccttttcttcctggaggatcccaggatcctagcgatcgcaccccgcccattactccagcccaggtcctgatccggttccccacgcagaggaacttggtggtgatcccccagtctgtgacaccagaacgcattgctgagaactttaaggtctttgactttgaactgagcagcccggatatgacccccttactcagctaccacacggaactggagggtctgtgccttgttgagctgtacctcccccaaggattaccccttccctgaagagttttgaaactgtggttgcctgctcgtccccaagtgacctatacctgtgtttcttgcctcatttttttgcaatccatctgtcctccatgacccaattcaaactgcacctccttcataccattctccattaaaccagctgccat

SEQ ID NO: 656151 - DNA, 1870 bp, Homo sapiens
  misc_feature (560)..(560): n is a, c, g, or t
  misc_feature (565)..(565): n is a, c, g, or t
  misc_feature (567)..(567): n is a, c, g, or t
  misc_feature (571)..(571): n is a, c, g, or t
  misc_feature (575)..(575): n is a, c, g, or t
  misc_feature (578)..(578): n is a, c, g, or t
  misc_feature (580)..(580): n is a, c, g, or t
  misc_feature (585)..(586): n is a, c, g, or t
  misc_feature (588)..(588): n is a, c, g, or t
  misc_feature (592)..(593): n is a, c, g, or t
  misc_feature (598)..(598): n is a, c, g, or t
  misc_feature (600)..(600): n is a, c, g, or t
  misc_feature (607)..(607): n is a, c, g, or t
  misc_feature (609)..(609): n is a, c, g, or t
  misc_feature (613)..(613): n is a, c, g, or t
  misc_feature (615)..(615): n is a, c, g, or t
  misc_feature (618)..(618): n is a, c, g, or t
  misc_feature (622)..(622): n is a, c, g, or t
  misc_feature (637)..(637): n is a, c, g, or t
  misc_feature (647)..(647): n is a, c, g, or t
  misc_feature (670)..(670): n is a, c, g, or t
  misc_feature (675)..(675): n is a, c, g, or t
  misc_feature (704)..(704): n is a, c, g, or t
  misc_feature (711)..(711): n is a, c, g, or t
  misc_feature (856)..(856): n is a, c, g, or t
  misc_feature (864)..(864): n is a, c, g, or t
ccggttgtgacccgctccgtaggtggtaaattgtgctcccactgcacatccggggggaggttttaacaacctgctttagtatagcccggttaccagttggggccacgccattccactccggaaagttaaccatctcccatccacaggcatctggggccgcctcagccccctcggctctcctaccaggccctggccaagcccggggacccttttcttcctggaggatcccaggatcctagcgatcgcaccccgcccattactccagcccaggtcctgatccggttccccacgcagaggaacttggtggtgatcccccagtctgtgacaccagaacgcattgctgagaactttaaggtctttgactttgaactgagcagcccggatatgacccccttactcagctaccacacggaactggagggtctgtgccttgttgagctgtacctcccccaaggattaccccttccctgaagagttttgaaactgtggttgcctgctcgtccccaagtgacctatacctgtgtttcttgcctcatttttttccttgcaaatgtagtatngcctntntcantcancantnggacnncnaccnntagantngccaacnanggcntntcnagcntgatgttggatctcnagagcccttncagtagagtagaagtctcttccngtttnctttgcccttctttctaccctgctggggnaagtacnacctgaatacccttttctgaccaaagagaagcaaaatctaccaggtcaaaatagtgccactaacggttgagttttgactgcttggaactggaatcctttcagcaagacttctctttgcctcaaataaaaagtgctttgtgaaaanaaaaaaanaaaaaaaaaaaaaaaaaaacaaaaaccaaaaaaaaaaaaaaaaaaaaaaaaaaaaaaaaaaaaaaaaaaaaaaaaaaaaaaaaaaacaaaagaaaaaaaaaaaaaaaaaaaacaaaaaagaaggaggcgcgcggcgcgcgcgcgcgacgcgacgacagcaagcaccacagcacgcacagttgggggggcggcgaggcgcacaaggagaggcggaaggagggagagagaaagcagagcaagcgagggacagcaaggcccggcggaaaaaaccagagaggacgggggaggagcacccaacaacaaagcaaaaaagagcaggggcggggaggacacacccacgtcaggccagacaaaacagacacgaagaggagaaggaggaggcaacacaaagagggctcccacaaccagcagggagggggaggcaggaacggggaacatgaggaacaaaaaaataatccgacgcgcccgcgccgggggaggacagacacaaaaaacgagagcagcaacacggtgacaagagcaggaaagagagagaagccgacgccagaagagcagaagccaagcgcaagaaaggcaggcagcaaagcgagcagcacaagagagaagcacaaaacagagcgagaaaagaaggaaagagacagagagggagaaacagacaggaagagaaaggagagaacgggaaaaaaaaagaaagaggaagaaagaggcgagaaagcgagaggagggacaacagagcgggacgcgggggagcgcaagaccgcaagaagagcgccgccacgcgagagcaagaggacagacagggagaggcgagagaagcaaagagaacggaaagacacaaacaggagagagagcagaagagaggaagaaagcgcagcaaaggacgcagggaggaaaagagaggaaaaagcatgcgaagaagcgaaacacgagacacagcgagaagaagaaagaaaagaggagagagagaaagcgaaacagaacagagaaaagaagaaagaaaaagaga

SEQ ID NO: 656152 - DNA, 144 bp, Homo sapiens
atcaagtctattccctaccctcactgctgccaccatgccacagcctctttatccccagcatgctgtaccgagtccatctgctgtttgaaaccatcctaccttgtctgttccacctatggcggacacagacaaggtagagccgag

SEQ ID NO: 656153 - DNA, 158 bp, Homo sapiens
cattatagtggaggccttcaattgtatcagacttttttgtaagctctggcacattgagctctatgtgttaccagtcattaatgagctgctgcagaggggactatttggtttactttcgtgagtggtaacattacactactctggatagggggatcctc

SEQ ID NO: 656154 - DNA, 1345 bp, Homo sapiens
  misc_feature (560)..(560): n is a, c, g, or t
  misc_feature (565)..(565): n is a, c, g, or t
  misc_feature (567)..(567): n is a, c, g, or t
  misc_feature (571)..(571): n is a, c, g, or t
  misc_feature (575)..(575): n is a, c, g, or t
  misc_feature (578)..(578): n is a, c, g, or t
  misc_feature (580)..(580): n is a, c, g, or t
  misc_feature (585)..(586): n is a, c, g, or t
  misc_feature (588)..(588): n is a, c, g, or t
  misc_feature (592)..(593): n is a, c, g, or t
  misc_feature (598)..(598): n is a, c, g, or t
  misc_feature (600)..(600): n is a, c, g, or t
  misc_feature (607)..(607): n is a, c, g, or t
  misc_feature (609)..(609): n is a, c, g, or t
  misc_feature (613)..(613): n is a, c, g, or t
  misc_feature (615)..(615): n is a, c, g, or t
  misc_feature (618)..(618): n is a, c, g, or t
  misc_feature (622)..(622): n is a, c, g, or t
  misc_feature (637)..(637): n is a, c, g, or t
  misc_feature (647)..(647): n is a, c, g, or t
  misc_feature (670)..(670): n is a, c, g, or t
  misc_feature (675)..(675): n is a, c, g, or t
  misc_feature (704)..(704): n is a, c, g, or t
  misc_feature (711)..(711): n is a, c, g, or t
ccggttgtgacccgctccgtaggtggtaaattgtgctcccactgcacatccggggggaggttttaacaacctgctttagtatagcccggttaccagttggggccacgccattccactccggaaagttaaccatctcccatccacaggcatctggggccgcctcagccccctcggctctcctaccaggccctggccaagcccggggacccttttcttcctggaggatcccaggatcctagcgatcgcaccccgcccattactccagcccaggtcctgatccggttccccacgcagaggaacttggtggtgatcccccagtctgtgacaccagaacgcattgctgagaactttaaggtctttgactttgaactgagcagcccggatatgacccccttactcagctaccacacggaactggagggtctgtgccttgttgagctgtacctcccccaaggattaccccttccctgaagagttttgaaactgtggttgcctgctcgtccccaagtgacctatacctgtgtttcttgcctcatttttttccttgcaaatgtagtatngcctntntcantcancantnggacnncnaccnntagantngccaacnanggcntntcnagcntgatgttggatctcnagagcccttncagtagagtagaagtctcttccngtttnctttgcccttctttctaccctgctggggnaagtacnacctgaatacccttttctgaccaaagagaagcaaaatctaccaggtcaaaatagtgccactaacggttgagttttgctgaaaggattccagttccaagcagtcaaaactcaaccgttagactgcttggaactggaatcctttcagcaagacttctctttgcctcaaataaaaagtgctttgtgagcttggtttgtgagcttggttttttaaaacaatagcaaccttctgtctcacttcaaccatcactctccacatacccataaggcaggccagtcagtgatgcaaaaggagtgaggacttgacttttctacaagtcctcaactgcaagttgggggcccctcaccccagtactttacccatttagctttagggttgtgggtctcatcctggctgcacaccaggtcacctttgggggctttaaggctggtgatgtctggacctcgccctggaggctgatctgattgggctgtgatcaggacagcaggagtgtacaggctctccaggtgattccagggtgcagccaaggctgagccacagctttagggtaaacccatgttcgattccacagattccttggttgctccttctacgtatgaaggccgaggtcggtgtttactaagcagcacaacctga

SEQ ID NO: 656155 - DNA, 355 bp, Homo sapiens
  misc_feature (9)..(9): n is a, c, g, or t
  misc_feature (25)..(25): n is a, c, g, or t
  misc_feature (54)..(54): n is a, c, g, or t
gaaaagttnagggattttttggccnccccctaagggttccaccaaaaatttaanggttacctaaagatggatagggtttgggctttgccatccccccaccccaaatctccttccttataactccccataattacccgtgtgttgtggggagggatcccagtgggtgagagatgattgaattatgctgttctcatgatagcgaatgggtctcatgagatctgatggttttgaaaatgggagttgccctgcacaagctctccttttgcctgctgccatccgcataagatgtgatttgctcttccttgccttccaccatgattgtgaggccttcccagcatgtggaaatgtaagtcca

SEQ ID NO: 656156 - DNA, 202 bp, Homo sapiens
tccgcgctcggtagtcctacgtgcttggcttctgggcgccctcttctgctttgtctcgtttggatcttggaggcatggggcttcattgctaggatgaggctggcacgtaatagcgcactactggacatttatgtttttttcaagttgttcttgcagcgcaccgtgtgttccatttctagctacgctgaactaatctcaagga

SEQ ID NO: 656157 - DNA, 325 bp, Homo sapiens
  misc_feature (17)..(17): n is a, c, g, or t
  misc_feature (104)..(104): n is a, c, g, or t
  misc_feature (125)..(125): n is a, c, g, or t
  misc_feature (130)..(130): n is a, c, g, or t
  misc_feature (168)..(168): n is a, c, g, or t
  misc_feature (174)..(174): n is a, c, g, or t
  misc_feature (178)..(178): n is a, c, g, or t
  misc_feature (185)..(185): n is a, c, g, or t
  misc_feature (195)..(195): n is a, c, g, or t
  misc_feature (230)..(230): n is a, c, g, or t
  misc_feature (292)..(292): n is a, c, g, or t
  misc_feature (322)..(324): n is a, c, g, or t
gccttcttgtagatgtnaatctggctacactggacagcactgtgaaaagacagactttagtattctctatgtagtgccaagtaggcaaaagcctccactcatgntcttattgcagccaattattngggcntgtacagaattgcccatgcatagtagcaattgtaatgngcatanacangaaaatnccccaaaaancaatagaggacgtcgacagaaagcaaaacctaggncattttacttcagatacgtcatccagaatggtttaaactgatgacttttatatgtacactgnaccatgtgatgtacatttattatgtctttnnnt

SEQ ID NO: 656158 - DNA, 742 bp, Homo sapiens
ggttgttgaggggacgtccttggtcttgcacgcacactacctgggggagtctaatcactgggatggtctgtggggtgggagggcctacggatagatgcgtaagagtgtcgcatgctccgtcattcttcgcttgagacccatctccctagtctcctcctagttagctcctatctggtccgtgatcccatcctccttagctcttgtggcccctatttggtctctgtgcttaacgttcgctatggtccacctccagccatcactaggtcgtgcgagtcccgacgcctgtcatcaggcaaaagatagatctacttatgaaatgtggggcataaacaacacaaggaagacgagacattggaaaagctaaattgatccaacagctgttgaccgatcaaagcgccaaaaacgggcaacgtggaacagcaccaagagaatacgtgcgggactatggtggtaaaacgtgtgtcaccacaacacgcagtcagagacgttgcaaccttatcgaccagccaaaaaaggatcttcaagggtctggcgcctcggctccagttgtgccagggatgatgtgtccccagcgacaggcctttatgggccgcctgcaccagacgtatgctaggcgcatatgggaattcttcgccaatgttgcccacagataggccccgtggtcaccccattcaaggtctggggcttgttccccaatcgattgatcggtgccactggagggcacggtccggcggagaatccg

SEQ ID NO: 656159 - DNA, 711 bp, Homo sapiens
tgaggcggagtctcactctgtcatctatgctggagtgcaatggtgcgatcttggctcactgcaacttccgcctcccaggttcaaagtatatttttgcctcagcctcctgagtagctgggattacaggtgcccaccaccacgcccagataatttttgtattttttttagtggagacagggtttcaccatgttggccaggctgctcttgaactcctgacctcgtgatccccccgcctcggcctcccaaagtgctgggattacaggcgtgagctaccatgcccggtgactcttttcagtccaaagagtcatcattgtcactagaccacctttgaacatggacagcaacagcactatctaatattaactttccctgaatcaataccctcgtttgacaaattataatttaacaaaaatatgtttatgtgtagaaaaaagactagaaggatgcagtgtctccgtgggtgagaaacacgtgatttctgttttattctcactcacttatattttctaaatttcctactgaaaatgttaatgaattatttaggtaatgagaacacaatcttaatcatgtttaattggttcataaggaacgacagagcttggcagcttcttgcagggtgctttctgccatccccagctgagacaccagtggggctcgggagctgccctccaatgacagctggtgatgacggggacactgccagctcccttt

SEQ ID NO: 656160 - DNA, 188 bp, Homo sapiens
aagaggcaatacagatgacaggtgtacgtacatcaatcatcggtattgccatcgtaattattaatgcgcgggcatcacgttggggcgggatagcagtgcatccgatcagacactccacccagctgaccgccagggccgccccgtgaagtttctttgtatttgtcatgcatatcggcgccggaatcgcg

SEQ ID NO: 656161 - DNA, 599 bp, Homo sapiens
cattaattttattttttaaaacttttttaaagtttcggacagaaaggccaaatttccggataccaacataacggggcgattggcgcgaaaaaaaaaaaaaacaaatccagagctcggagatcggggaaataaaggaaatagcggttaaaggggggaaattggggaaagtttacaatagataaagtacttggcatattttgcacctcgggcccatccaaaatacgccatagaaattccaaagagataaaagggtaaaaaccttcaacgggggaagggggcaaaataaccctaccaattttttccgcttaggcccgcccccacgcaacctgaagcgagagtaagggggggatttcaaattgtcaaactaaaaaacacagcgagaccggggaaaaaacgggtacccgggggaaatggggaaaatttataaacttcacaaacatatcgacccgaaaggttaaggtgaaaatccggaagcccaaaggggcaaagaaataaaaaaaaatacttgcggtcatgcgcccttttaacttccaaaaaccggaagcccggcctatcaagtaatcgcaaaacccccgggggggcgggtgggttttgttccg

SEQ ID NO: 656162 - DNA, 218 bp, Homo sapiens
tgccctatgacggtgagagtgccactggttcctgagcccccgcacggagtacatgtgtggcctgtgtccagacgtggagtgaagcaagagcgatggggagtacctggtgtccggacttgggagcgagacgggtggagttctgcaactgggggatttattgccaaggagcacctggcttcagcttccaggagaacagctgagcagaatcggcaggccgc

SEQ ID NO: 656163 - DNA, 560 bp, Homo sapiens
  misc_feature (50)..(50): n is a, c, g, or t
aattgaaatgtagatgataatctgatcattgtttgttttaccaaattagntaggattctgaggatacattttgaatatttgtgtatgtttagcattttgtccctttgttagaaatctctcagtgtgacttgtttttaataggatgtgtcttgaattgtaggccaatcactcctgaaaagtattaagccctttaaacacactggttggacccatagagggaagcctacaggtttattagtactccttatcctgaaagcacagcatacccttttaggtgcacagcaacagactcctagcaaccgtaatagattgaatttctaagagtgaccaggccggatgtaataataaagcaagaggtacaaacagttgtcatggttttcttttcacggtaagctagtttgatttgggaaagcttagcttttcaaaaatgggcaaccttcttataaaactactgctgtttgtgcacaggacttgtggtattaaaatagcaataatagtaccaaatttaaacagctactgcttaaaaataatatacccaaaataacaacaacaaaaaaaaa

SEQ ID NO: 656164 - DNA, 513 bp, Homo sapiens
gtcatcctgtaattaatagtttctcgcataacaaggtccgatatttgcaaacaaacaacatgtttggaagcattagatccagtccatagatgctgtgacaaaattaactacagtcagtctgtgcaatgagattgatgtggttggagttctatgtgtgtggcattgtcaggtcgaaaacagagtggtgtgctcctagaaaatatttcttcttctagcttatgtgcattggacctacacatgtataaccaatgactgactctgaactatcacgcacggtggggtggctggaaggtaaaggtctaagctgtgtgaaacactatacatatataatctatatttacttgtatgggctattactataacagtccaagtcacaatacacctagaacataccagaaaagcaagctttgtcattcctgcttgaccggtatgatctcgtctaaacaaacatttcatttcagaaaatctgcatcaatctacacggaccatacacagtgcacaaactgaaatgag

SEQ ID NO: 656165 - DNA, 216 bp, Homo sapiens
tttcctcccccccccccccccccctaaggggggtttggggcctcccaatggggcttgtgctttttccacacgtgtttgtggggggtttgggcccaaagttccagggtgagaggcagggaactccagggctggttcccaaatgttgtttgggggccccttttggttgaggccccccctaagcccggggccctttaaaatcagttttctccctgggga

SEQ ID NO: 656166 - DNA, 659 bp, Homo sapiens
gtgatctggttgggtcagatcctgtagatatgtgagatacctgggtctatccagtcccgcgaggagcaggttgggctttcctggcggcaaaggtcacaatagtgcagttggtatcatatctagactagcttataatcgtcatctgctgcaagcacaatcaactcagtgcacgagggctactccaagtgtgatgtgtgatgagaagctggtgacgaaatatggtcggctccgtaattgctgctatcgttgtggaaatatagcttcgatcatggtcttgaaatgatgtaaatacagagaaccgaaagttattccgggcagtgccagattcagagacgtgtccattccgtcccagaaggacgacgccagtatctcctgtagaggccttcgcaccagtcctgctgagctgattttgctgagcctcttcttaccccaagtcgctggtattacccgctagaatatactgttgaatgtgaggcactttgctgctgaagatgcgggctcttgccttgtatttttttctgcacattgttaaagtcattctacaaatgcacgggtggctggagggggactatggccaagatggcctatgaatttgtccgcacagacccgggcaacaaacgtggggcgatttggaaagactgggaagaggggtcgaagtc

SEQ ID NO: 656167 - DNA, 1389 bp, Homo sapiens
ggggactcgcgtcggatgggactcccggacgtaggtagtcgtgggccgggtactgaggccatatgctacatctattacttttccactcataggccacgatgacagcagataccagacctgggagtgtctgttccagacgcgctgccgagaagcattaaactcgactgaccctatgaaggcacagtgtggttctcaaaatatacggcatcctgcatgggacctaggtgcatgtcaaacgcatacacacgactgactcaacgccgacacgcgagagtaatacaaagcacgagacacagactcacagaaatgcataaagacaagcaccaggcgaacacaaccacaacagaatacaaaccataaaaagaacgcaacacaaacggaaacgacgcacagggaccagccccgaccacagtacacccaccatggaaacacacctgaacgatgcaccactgcgactaaaagcaacaaagtggactagcgacacaaacggcaccgcaacgtcacaccactaaggcgaccaagatacccaagtacgaacacaacgacagacaaatcaccgaacgagcacacaagaatcgaaacgggcggacaccacaagcaaacacaggatcaaaaaaaacaccaaggcacacacacgataacaaagcatgcaggagcccatcgacaaccagcacaacaagagcaacgacagaacagcagaaacacactgacaacaagaaacggaccaacaaccagacacccaacacagacaacaacaagacacaagaaacaacatcagaccagacacaccacgcgacgacactcgaccaacagacatcggaaaacacaaaggatcaaacacacacacagaccgcagcaacaacaaaaaacaaccacataaaaagacgagcaacacacggcaggccacaaccgacaagccacacacgagaccacacaaccaagagaccactacaacagacaaacatacgcggcacacacacacaccaaccgaacgaacaccgatacaccgacaggcagcggacagcacaagcagacgaacacacaacgaactagaaccacaccagcggagccaagccgaacaccggccaagaagcagcacaacacacagacgaacacaacacaacagaagaaagccaaatcacgagccagaacgagacgcgacgaacccaggcaaagagcatgccgcaacagacgagcacagagacagcgacacgacgacagagtagcacaaacagacaaccagaccaacagcgcccagaccacactacggagcgcagaaacaacgcacagacaacaacaacacggcgacacaggcacacacaacgacacagacagacgacccgcacgacgacacagcacgcagaacaaacacaccagccgagacataca

SEQ ID NO: 656168 - DNA, 884 bp, Homo sapiens
gactgcttaaccccactcggcatcaggtgaatcgcgaatcagccacttgaattaatgctaagcccttactagatcactgggacttaaacccacaaaatatttagtataacagctaggtcacccgaatcaagcgtggctacaatctacttctcccgccggcgggaagaagaggcggaagaagccccggggaggtaagaacgcgtgcttcattcagaactaatgcgagtatcaaatgagtgcataacatcagccctcggaagtctggttccaaatgaggcgcgtaacccgcctgtctttaatattctatcggagtcgctagatgcttcactcaatccattttaccttcacccccagtgatgtacgccgatcgttggactagtgcttctacaaaccacggagagttcaattgcgaaacgagctgatatcctatgaacttcggacgcactgagctggcagttccctagagtcgcagtctctaagacctccttattcgagaccgagctgggcgcaggcacaggcaatgcgttctaggtaatcgggcgcagcagtgctagcgaagataatcgtcagcgaggcaccaatgacaatagtgtagaatagaggcttcttcagtagatgactacccattcatagatcggaggctttggcatctggacatagttcccctaattaatcggttgcccccgtacttatggcggttgtccccccgcagattaaaacctaacgataaacgtcgtttccagaacatcctataaccatcaccacatctcttcccgtaacttccctagcgtctggcaatttcgtggctaataggttggcaggccccggaaggcagggaaaccaggttgaaccaggcctaacctcccgtttagaggggaactact

SEQ ID NO: 656169 - DNA, 104 bp, Homo sapiens
cagcccctacccttggcctcttcagcaactacagcaccatggaccctgtgcagaaggctgtgctctcccacacttttgggggacccttgctcaatacctcgcgg

SEQ ID NO: 656170 - DNA, 176 bp, Homo sapiens
aaggtctgacttgttcccgtcacggcccagtggttaacgaacctgactaggatccatgaggatgcaggtttgatccctggccttacttggtgggttaaggatccggcgttgccatgagctgcggtgtagattgaagattcggctcggatccagcgttgctgtggctgtggtgtagg

SEQ ID NO: 656171 - DNA, 236 bp, Homo sapiens
gctggcgtgctgctcgtcggccccggcccggaaccggctgggtagagttatgcggaccctccagctgggactgtggctggcgacgcgcggaaagtcatcctaacttgtcaaaacggagagacggagaagaagtctttattgaggagatacccgacgagaacaaggacaaaggaaactaacccgacgcagctctatagacaaacaagccggagggagaaccaacccggcccaccccg

SEQ ID NO: 656172 - DNA, 879 bp, Homo sapiens
gagagaagtttccgggactgtccccacgacagtccggttgtagatcccctgatctgcaattcttcccgtcccttcatggattggaaggctctcctttcttccttgaatgactttgcatccctctcgttgctgagagttgggacaatgtgtggattacgtggtggaacggcagatggcccacactacatactgtaaatacaactcttccgtgaccaatgactgtgaactgaggaagtgatggaggaggtgctgcaagaagaaggcagacctcattctctcctagcatccgccatatcttccgacccatgagagcgcataagctggaacagcatggaaggacgcgcctggtgatccgggctcgtgtgagaacagagtcggtatctactctcctcatacggcctatgagtgctgcgccccagggtgtcaagaactggttggctaaggggcttggagcttgtacctccaggcccatacatccttccaaagctcccaactaccctaacagagggaaaccaccgagtagaattcaacgtgaactacacccaagacctggacaaagtcatgtctgccgtgagcggactggacggtgttctgtcacttctttgtctggtaggactggtactgaggaacaacacggttatctggattgtactcagaacgcttgatgccggtgggtgatctctttcgcgcgaacaacacttatccgagacggaattctgccagtggaaagcttgtctcaatactggatggcggtatgaccgggattggtcctgcacattttggggtaaaaactaaaattttattcttcccggtggggacactagttttaaacgccgggggtggaacacagggggcaccccacagagacccaatgtgtcc

SEQ ID NO: 656173 - DNA, 179 bp, Homo sapiens
gactatataacattaaaaggggttaagaaacaaactctgcctttgtgctatgaatattttagtcagaggtttaagctgtgtgtccattcctactctgaaatgcatagctttgttctggatgtcatctcttgaagtagaaactcctatgtgttatcacattgcagggcttgctaatgtat

SEQ ID NO: 656174 - DNA, 412 bp, Homo sapiens
acctttgactcaagaagaagatgatgaccaaaggtgatttgtaacttaacattccttgtcctgattttgaaggatttttgaagggaaaaaaaattttgggctctttggtttaataaaatggggctgggggccttttgaaatgaaagaaactcctttatttttccaaccccaatcaaacatttaaataagcctggaaaaccaactacaacccgcaatttaaggtttcttttactttaagaaaatcaatttcatagtattgggtttaaatctttttaagtttttttaatacgatctatttttttaggttctttttcagaagtaaaattttgtacatttttacatgtacatatctgtttaggttgggttcatttttttaacattttgtaagaaaataaaagtttgggcccctgga

SEQ ID NO: 656175 - DNA, 158 bp, Homo sapiens
agcgtatctctcttatacaatcaggttgatacgcgaacctttcaagaacatcagcctttccaggggcagcagctgcggcatttgaggcgctggaatttcttccggaaaaagaactgaagaagtcggtaatatccatcctcgaaaagggtgaccaggtt

SEQ ID NO: 656176 - DNA, 236 bp, Homo sapiens
ttatctccaatctgtatgctttttatttccttttcttcctatgctacttgcaatgctgtttcataatagtggtgggagctgacgagcttgtttctgatcttagtggaaaagcattcagtctttcaccagtaagtatatgttagctgtaggttttttgtagatgctgtttatcaagttgaggaagttccctttttatttgtagtttgttaagtgtttttatcatgggtagtcacaga

SEQ ID NO: 656177 - DNA, 197 bp, Homo sapiens
gatcgcttcctcactctcgcacgctcacgacgctctgcattttttgtttatacaaaaatgggagctaatgtgtttgatactgatgtggtgaatgtgggtaaaccaatcacagcatttgttttggacatgtaccatattgtcagtcttttttactcttcagcgcatcaaaataatttaaaattctttttttaattttt

SEQ ID NO: 656178 - DNA, 390 bp, Homo sapiens
ggaatacgagattcgaggcctgaggaccctactgtgtaggctatgcggggaggctggcattgcagaggtattagaaatgggccaaacacggacaggctcgagaggttagtgtcagtagtgatacctctgacagctcttgggggaggatcaatgatggggattggagacggagggcaaggcaagaggctggtgagccaggcggttgtggtcatggtccagatgaaggaggaagtggtcagtggctgtgcaggtgaagaagagggctagtcagatagtctgatagtttgtgtctcatgcccccacctccaggaagccttcaccgctttcctttccctacctccattctgctggtggtcttggagctctgggccagaatctgaaactctaaac

SEQ ID NO: 656179 - DNA, 735 bp, Homo sapiens
gtttgattagattttagggtgttcccacaaaggtttaaattcgtcgacctctttggcatagctttcttgaggttctacagcggctcagcacttctctagagtggggtcatatgtcttggccagtgttcaacaggagcactgcaagagtaatcaggatgctttcatgcatattcatctaatgtcatgccaggaatgacatcctttgcctcagcatagttgtagcgaacatcctgactttcatcagaatcagcagctaatgaaggcaagtcagcaggcatctcgtcattttccacttcggcaatgcagtgggatttttctaacagaggtttttcgcagcattccttcagtttactgcagatcgagtcttgacggtctcaggggcacttggcaaggctcgcactgtcatcagcacatgcaagcagatctccatgacagcattctgtgtggactttggtaagttctgtcactaacttggaatcttatgcaaacctagctttgggcaatgtctgggtcaggctagctactgtcagtgctttgaaagctctttctcctaatttttgtagtctggcacgcttcagtctctgtttggcagccgaagctttcgtatcatcgcgaagttcatcgagctttgtcaacaggcaggcagctttagcagcagcttgactacgttctgtgagagcagctttatacctatatcaaggatagtaaatccggggcataaagctggtccgattc

SEQ ID NO: 656180 - DNA, 122 bp, Homo sapiens
aggtgacctggtaaattagataggcttggtgatttgtactccctcctggtcatttgaagggccctttagtttttatgataatttttaaaataggaacttttgataagcccttttggaggcga

SEQ ID NO: 656181 - DNA, 104 bp, Homo sapiens
accaacccctgacctggcactgaggaacgcatgacgccagcccggccctcacctccggcctcagttctatctccccaaccaaaatatatcccttatacaaatta

SEQ ID NO: 656182 - DNA, 810 bp, Homo sapiens
  misc_feature (96)..(96): n is a, c, g, or t
  misc_feature (147)..(147): n is a, c, g, or t
  misc_feature (149)..(149): n is a, c, g, or t
  misc_feature (152)..(152): n is a, c, g, or t
  misc_feature (242)..(242): n is a, c, g, or t
  misc_feature (318)..(318): n is a, c, g, or t
  misc_feature (418)..(418): n is a, c, g, or t
  misc_feature (440)..(440): n is a, c, g, or t
  misc_feature (481)..(481): n is a, c, g, or t
  misc_feature (491)..(491): n is a, c, g, or t
  misc_feature (553)..(554): n is a, c, g, or t
  misc_feature (561)..(561): n is a, c, g, or t
  misc_feature (564)..(564): n is a, c, g, or t
  misc_feature (570)..(571): n is a, c, g, or t
  misc_feature (576)..(576): n is a, c, g, or t
  misc_feature (578)..(578): n is a, c, g, or t
  misc_feature (595)..(595): n is a, c, g, or t
  misc_feature (617)..(617): n is a, c, g, or t
agcggacttacggccggagctgtttgtgctgggagctggtggcgcggtgcaggctcttaagaacgaacggttgggcgcggactggtatccgggacngtgacttgcaggtccgccatgagccagagcagatgctgagggacaaacgcngntgnagaaaatcctcatctgagtacggtctcacagacaagttgagagaatagtagaaaatgagaagattatgcagaaaagtcatcaaagcaganggtagatctccagtctttgccaactcgtgcctacctggatcagacagttgtgcctatcttattacagggacttggntgtgcttgcaaagggaaagaccaccaaatcccatgtgaatttctagcatcttatcttttaaaaaacaaggcacagtttgaagatcgaaactgacttaatngggaagaacagaaaatttagtngctactgtagatttacatgattaagaggcagctttaattgncatgatcatnccctctttgtggatgtataagaaccttccggaaacagaacctattctggaatggcgaagatnncatattnccnttattnngattnantcaccataaaccatacntatttaatgagtgtatctggcnattttttctcagattgtctttacttttgtttttaaaatgaccttcaaaataaatgtcaaaccccttttaaaagaacacacaacatacacccatcaccacacacccccccccacaccacacccacccaccaccccacacccaacccgcacacacacccaccccacacaccatcgccgccccgcacaacaccgcg

SEQ ID NO: 656183 - DNA, 1024 bp, Homo sapiens
  misc_feature (35)..(35): n is a, c, g, or t
  misc_feature (297)..(297): n is a, c, g, or t
  misc_feature (393)..(393): n is a, c, g, or t
  misc_feature (940)..(940): n is a, c, g, or t
  misc_feature (946)..(946): n is a, c, g, or t
  misc_feature (1024)..(1024): n is a, c, g, or t
aaaagggcccagggccgcccgggaccgcgccacgnccagccggacggcaggcaggcccgggcccagaccgggagcgcggaacggggaaggcccaggaccgccggcccggagggggggggggggacagggaggggacgccgggggagcaccgggaggcggccgaggggggaggggcggcgcaagggggcccggcaccgccagaggggcaggcgggggcaggagggagcaggggcagaggcgggggaccgaaacagggcgggcggggacaggccgcgggggggggagggcaaagggganagcagcagggacagaggcaaagagaggcggcggggggagggaggcagcgaagaagggcccagccgcaagcgggcggaccacagggcgggggcaggncgccagggacaccgccaccgcaagcgcccggaaggcagggaaaagaggcggcaggcgcgggaggcacacaggggccacaaaggagagggcacccagggccaggaggaggcgggggaaggcgggcggaggcaggcccagggccggcaggggggacccagcgggggccggggaggcgtgcgggaccaggggcgggggcagcggccagcggagcgccggagcgcaccggcagcagcgggcaggccgcaacgggggggcgccgcagggcggcaaggcggggggggacaggaagggaaacggaggcgcccgggggggaggcagccgggggccgaagcggcgccgcgggcggcaggggcggcagcggcagcggcgccggcggcgggagcaggggcggcggcggggagaggaggaaggcgacagccacaccacaccgcggcggcagcgcagcacgggagaacgcagcaggggcaaaggacacgggggccgaggagcggaagaccggcaccccccggacggccggggccgcggaggacgcggccacagcgcgggnaagagncggggcgggcaccggccccaggacagaggaggggggcagcgggggccggaccacacgagcagcagggagaagaggacn

SEQ ID NO: 656184 - DNA, 324 bp, Homo sapiens
  misc_feature (324)..(324): n is a, c, g, or t
gtggtacacagaggtactaactctgtgaatgggaagagcacttggctatccagagctctcttataaacataagtgcacagagagtgttatgagaaacgcgttttgaaggcttggtttgaggatgagactctgaagagacacgaatttctggcacgaatgcgcacaggacatatagtcagccaagtgtgtcgtgcgcacggatactttgactttgggttgctgctgctgcgtatggatattgggagaggtatacttttcaggttgtaagagagaggtgtgggtaaaggtctgtcctaaaggaaccctggctggtatcttcaactn

SEQ ID NO: 656185 - DNA, 840 bp, Homo sapiens
  misc_feature (154)..(154): n is a, c, g, or t
atataagatctttcttaacaaatcacaatctatgtaatacaatattgaactgtcatcaccatgctgtacattggatatccataacatcgttcatctctgtatcactgagaactttgtcaccatttgaccaactatcatctcgcaatttcccccnttccctctagtccctccgtggtaaaccgagtcgttaccgcgtctgcttctattgatatttggatctcagtatttcacatactaatgtgagatgatcgtgcatgtatgtctcttctctgtgtcttgcctatttcaattttgatcagcataatgtcctccatgttctgaatggcaggatttcttccttttataaggctgagcagtttgatgtcactggtaatttccataaaccctatctttattcagtcaccaggacgttgagtccatgctgcagtgaacataggagtgcagactatctctttgcaaccttgatgtcaatgtctttcgggtactatacccagatatcttctattcttcaatcttctgtggggggaacctccatattgttgccataaatttacatccccaacagaagtatacaagcgctgcctctgctcttcgtcctccctagcccttatctttgaccttggatcccgattcatcctaccaggtgttgaagctgtatctccctgggtttgattagcattcccgtcctgcctggcatgtgggccacttttcattatacctggttagcattgacttctttgaacacgtgcctatgttggccttgcccatttaggcgaccatttcccgcctgggtgttcctcttcaaaaagggaaaacccccgccgggatcaggagggaccc

SEQ ID NO: 656186 - DNA, 183 bp, Homo sapiens
ctcattataaacctgtctctactacaatacaagtattagctacatgtggtgtataagcttgcaatcccagctattcgggaggctgaggcaggagaattgcatgaacccaggagacggaggttgcagtgacctgagattgcaccactgcactccagcctaggtgacagagcgagacgccgtctc

SEQ ID NO: 656187 - DNA, 423 bp, Homo sapiens
  misc_feature (6)..(6): n is a, c, g, or t
  misc_feature (391)..(391): n is a, c, g, or t
taaaangggcacccaagtaaagttaccctctgtatccgtctgaactggtttttgaggtaccctacgagttttgaaaataggtgttatttgcttattttaaggaacctacaacccaggaagtagaatgaatgtggaaatattcttcttctcttgccgagcatggtggctcacacctgtaatcccagcactttgggaggttgaggcagatggatcactgaatgtcaggagttcaagaccagcctggcaccaacatagtgaaatcctgtctctactgaaaacacaaaaattagccaggtgtgttgcaggcgcctgtaatcccagctacttgagaggctgagacaggagaatcacatgaacctgggaggcgaaggttgcagtgagctgcgaattngccattgcactctaggctaggtgacggtgcga

SEQ ID NO: 656188 - DNA, 508 bp, Homo sapiens
gagcatttaaaaggatttcccttcaggtataattaacctgaggagaaagaaaaaaaaagtggaaagaaaaaaaaaacaggcttctaacttttcctcccgtcttacgtttggcatgacacggtccactgcgaggacattgaggctgtttttacactgtctgatgcctgcaggaggagaaagaaaacaagctctttcacagatttactttgatgttaatgagcctggaagtttgtagcgcttttctgggggccggtgtgtgtcaagagaacccgcgtcaataggtggaaaactgctgaaaccacaaaaagagcagaggaatgtttagtaggagccattgtccttcatttgttagttgatttgtgtctagatatgtcagaaatatgctgtacttcatcctgtgggtgtgtctgtttatagttctttcagtgaaagagaggtattattggtgtgaatttgttctgttgtaatatgttttaatacaaactaagtaataaagttagtattttta

SEQ ID NO: 656189 - DNA, 747 bp, Homo sapiens
  misc_feature (704)..(705): n is a, c, g, or t
aatgtcacgtggcttctaaatggataacctgtcaccacttgctttttaaaacggtttatttgctcaaaatttacccatgcaaatgggtgaaactactgctgacagaaacttacactgagtgcaaaggcaatattgaaatataagctggcaacacaagacccacttgacacatggaaatatcatagggttcacatcaaacggatcagtaaaggcctattaagaaaatgcaaggaaaaagaaaacagagtgaatcacaggattaacctcatgataaatggccggagtcaaggcataaggcaaaattcatcatgatggtcatggagattaaagagctcccccatatggatacgcagacaattcctcaactgcggctccctaaggtttcttatgagttctctcatctacttcatgaaaatttccatatcatctgcatatgcacccatcccatcattgatctggctattgagtatggcccatcgggctttaccatctgccatagggcggacttactctccattctgcataagctgatgcatctgttcaatttcttggcctatccttgcaggctacttattcttcggatctcgcgagaagtgcactccgtaacactagcctcgagacctggccggttttcccggcccaatgccacccgccaggtcaggccatggtagctgccttggccaattctggagcccggggaccgnncggttaaacggccccacccgaggctccagtttgtcctttacg

SEQ ID NO: 656190 - DNA, 167 bp, Homo sapiens
aggacggtgatggaccagcctttacatgctggcctttctgctcccagagctagtgtgcttcccattgctttcctatcctgtcctgcctgccttctcatacactgcctctcatgctagggggcacagcgagaactgctgcaaaggccagtgagcaatgtcacggagta

SEQ ID NO: 656191 - DNA, 262 bp, Homo sapiens
attcgcggccgcgtcgacgtatgacaggcataaacccaggcctcagtgcatttctatggttaggtggaattagctccaatgtctgatgcccagttccctcccatggaaagtacattcgccacataccattacactgccagtaaagataaagtaccttctaatatacttataaaagcacatagtgcatgggctagggactatataagaaggcaggtggcatggaaactaagggttttatttttatttaatgctcccaactctt

SEQ ID NO: 656192 - DNA, 399 bp, Homo sapiens
ccaatctgcgggaccactcagaatacttacacaacttctattattcagcatatgttcatattttaggcttcaggtgctagaaggattataatgtaatgtctaagatttgctaatgctgttatctatttgatcttgaggcttgatggtcactagaaaagtaacattatatagtacagtaaaaaaacttagagatactgtggtttatagaatcgtatcttttgtctgataacaaaattagtcaattgaataataaaatcatcgtgagatgtcagcagtcaatgatgatggggcatagaattggttctgcattccgaggagggagaaatcgatgcaagcagaagtgattaaacatttcacatcttggagctagatgacctcctaggatggatgggtcttatg

SEQ ID NO: 656193 - DNA, 185 bp, Homo sapiens
attcgcggccgcgtcgaccagctgaatattgaactggaagcagcacatgattaggctttatgactgggtgtgtgttgtgtgtatgtaatacataatgtatattgtacagatgtgtggggtttgggtattatggttcattacgacccacataattagtagttgtagagtcatgctgtccttgcatg

SEQ ID NO: 656194 - DNA, 935 bp, Homo sapiens
  misc_feature (311)..(311): n is a, c, g, or t
  misc_feature (422)..(423): n is a, c, g, or t
  misc_feature (570)..(570): n is a, c, g, or t
  misc_feature (638)..(638): n is a, c, g, or t
  misc_feature (781)..(781): n is a, c, g, or t
cggcacgagcacatcttatgccaagcactctgctaggagctgcgtatacagagaagaaaggcattcctgctctcatgatgttcatggtcttctgcggaagagaccagaaaaaaagtattacaatgtagaatgaaataagaatgacagggtattttggcagcaaggaggagggcactttaactcaaactgggcagtggaagaagtaaaaaaaaacattgaaagaaatcctgaaggataagcaggagttaagaagagtggatgaagcccttcaagggtaaaagcatggcttattcagagcactgcaagtgttntagtatggcccacatgtaaagcttacagaggaacacagagagaaaggcaagagccaggaagtgaagggtcctgtgtatactggcttacttcgtgacgtggagaactattgnncgattcctctgctaagctcagggtgcattcgtggaaaacctactgcaactggcccaatgtgcatacaaagctggaactgagatgtgaacagacttgcattgccttgatcactttccgtggaaatatagctggcgccactaattgtangagctactgacactgtaaactaggttaactggatggaagcaacgtgcctttggatcatgctgactgantccatacatgtctaccatgatacaggctgaggtattcccttgaacaccgactatttgagttaatgcccatgtgatggctaagtcctggactggcttaatggtaagattgtaactaccagtaagtttttggcttggtctcatanggcaataaatgggtgactttaaccctttgcatgacactataatcatggttttaagctcaggagggcctgcgtaaaccaatgtggtacactagttggcccgaacttggtataaaccgccttaaaaagtggtaactttaactgcttaatgtttcaa

SEQ ID NO: 656195 - DNA, 727 bp, Homo sapiens
  misc_feature (444)..(444): n is a, c, g, or t
  misc_feature (470)..(470): n is a, c, g, or t
  misc_feature (496)..(496): n is a, c, g, or t
  misc_feature (536)..(536): n is a, c, g, or t
  misc_feature (589)..(589): n is a, c, g, or t
  misc_feature (599)..(599): n is a, c, g, or t
  misc_feature (614)..(614): n is a, c, g, or t
  misc_feature (619)..(619): n is a, c, g, or t
  misc_feature (628)..(628): n is a, c, g, or t
  misc_feature (642)..(642): n is a, c, g, or t
cacagtgactcacgcctgtaatcccagcacttgggaggctgaggcgggcagatcacctgaagtcaggagttcgagactagcctgaccaacatggcaaaacccagtctctactaaaaacagaaaaattagccaggtgtggtggcgcagcacctgtaatcccagctacttgggaggctgagacaggagaattgcttgaacccttagggcggagggtgcagtgagccaagatcctgctgctgcattccagcctgggtgacagagcaagactctgcctctaaaaaaaaaataaaaaaaagaaaagaaaagaggaaaaaacacaacaaaaaaagagaattcaatcaaattttagatatctgaaagcaaacgagcaattaagatgtcacaggtgactagggaaatctaagtgtgcagtgacggaggacaagataagatgcaatcttattngtgtcaaagaaccacagaaagaatanaaagaatgagaatcagcaattcaaanactagattcctctgaagctataaacagaagaactgattanaagtaagaagcaattagtctgcttagacaccatccctaaaataaccaaattanccttctagcngaagactagaggttnctatnggatatgtngaatgaagaccctnaagtagcactatcaagaagctgaggaaaagggttcaaaacagacagatcaaggcaaagcctatattgagtagtggaactctcacc

SEQ ID NO: 656196 - DNA, 113 bp, Homo sapiens
gggcccagaaattttctgtttgtcctgggaaagtaaaagtgggatatttaaacccttccgtttagttttgtaatgtccgggatttttccaaaaaatttaaaaatgggctggga

SEQ ID NO: 656197 - DNA, 389 bp, Homo sapiens
gggttctaccccaaggggttgggccccgccaccaaaactccttcccttttggttccagcctccagtgggggcccccccccttttttttccagggtgggcccccctttttgccccccctttttgggggggttttttgggggcccccccccgggggggtttggcccccctttttttcccccccgggggttccctttttttttttttttttcccccccggccccggttggggcccccccggggccctttgggggccccggggcccgcttgggggggggggggcccccccttttttttttttttttttggcccggggaagggggttttttttccccccccctcccgggggggggtccggggtcccttaacgttttttttttggggttttttta

SEQ ID NO: 656198 - DNA, 224 bp, Homo sapiens
agtctctaccgtggctcgaggagtagcatcctctaggagtagtgtagcgagcaaattctggacagtagtcctcactcttcgctgtcccagcaaggactttctcagcgagcagatcttgcttgttgcggaacaggatcacagagatggtgcgcagccatctgttgtaccagatgctcttgaagaggttcagagcctcctgcacgaattcccttagcacccgcacg

SEQ ID NO: 656199 - DNA, 361 bp, Homo sapiens
tttttcccttttttcccccggggtccgggcagttcagggggtttaaaaaacccaagggtcccgcaaaaatgcccggacattttttttgggcccccgggggttttttttttccgaaaacttaaacaaaaaaagacttcctaagaaatttggaccgcccccccctttttccggccctttgtttgggaacctttttgcccttggttttcccccggggcccccgcccccgcaagagggggttctttttttttttttttaaaaaccaaaaaaaaccttttaaattttttaaaaaattttccaagcctgggggaaaagctttcttccttaggcaaggggttttggtttgggtttaaaatttcttata

SEQ ID NO: 656200 - DNA, 183 bp, Homo sapiens
ttgactctgaggatccccaggccgcaccgcggtcaaattacagtcctgagccatatgacctgaaagtactatatatacaaaggtggtccagaagattataatcctgtattgtttcctgtaccttttgtacgcttagacgtgtacatgatcacacaacctattttcccattggcgttaacaact

SEQ ID NO: 656201 - DNA, 138 bp, Homo sapiens
caaaaaaaaaaaaaaaaaaaaaaaaccctttggaacccccccttgatttcccccttttcctccctacccctttttttttgggaaaaaccgtccccccccccccccaaacccccataaaaaaaaggttttgggttttta

SEQ ID NO: 656202 - DNA, 130 bp, Homo sapiens
gttagccgtcagaggcagcgtcgtgggagctgctcagctaggagtttcaaccggtaaaccccgagtttaaagccaccgaaaaagctgttagcaatcacaggttttcaccccagagcacgatgggatcgag

SEQ ID NO: 656203 - DNA, 758 bp, Homo sapiens
ggaagatggccttagatatgtgagatgcagaactcctcaagtcaagatatgccagtctctctagcgtttcgggtggaggcgatattgaagttaggtctgtagacgtgatctgtgtaagtttgagcttctcatactgactcatggtgtgacttttgattagtcaccttgagcattagttggggttgtggcagagtgggtttcagactgcttcaggggtgctctaagcagctcattgtggtaagtagcttgtaaataagcacaagtcagtttccatctagcttattgagcaagtgtccatgggatgaaaaacaagcttcagtttaatttgctccctcaagcaatcacctgtaagttgtcctttggagcaaagctttatgcacgcctgatgactagattgaaactgcatgggtattatggtcaagttagagtatatacaaatatagagtatatgcaaatgttttcaactaaacaaaaggttgcttgtcggtgacctcagaatatcactgtgtcgataacgacctttagtgctaaaagagcaatgacttctgtctcacctgtgcctttgtgacaattagacgttgatcacaaaggtatagaaaagctgcagggcactgacctgacaaattactttgctctggtaatagagagaaactaacgtttcctcgtcatttttgggcccagacgttcagggattttcttacagctatcattgtcatgatggctggaattattttgaaccagttatattaaacacctgg

SEQ ID NO: 656204 - DNA, 423 bp, Homo sapiens
  misc_feature (19)..(19): n is a, c, g, or t
  misc_feature (38)..(38): n is a, c, g, or t
  misc_feature (185)..(185): n is a, c, g, or t
  misc_feature (201)..(201): n is a, c, g, or t
  misc_feature (239)..(239): n is a, c, g, or t
  misc_feature (356)..(356): n is a, c, g, or t
  misc_feature (391)..(391): n is a, c, g, or t
  misc_feature (403)..(403): n is a, c, g, or t
aataattaggatggaatanatcaagcaatttgtttacnatctcatgtcttaaaataaattaaaaattctatggaaacagcagaattgagcgttttcactgggaaagacttcaagaagaaaagacaatgattaaggtaatgtttttaaagttaaatattttcattcgaagatttttatagtataanaagatgatctaatccntgaataaatcagattccaagttacagttttttcactantttatcacaattcagaaagcacaattatgagcatgggccacacttggcagtatatcatagcaaaagttatagtgttccaagcgttcctgagagtgagctaagacttcctaatgtagntccacatccatttattccagggggttgacagagcntgggggtccccntgcctttaacccactccctt

SEQ ID NO: 656205 - DNA, 666 bp, Homo sapiens
tgccctccgtgaacctgcattgacttgagactcggtagcactctgtcttattgagatcgcaaccgtagcagtcgacaacactccatcgttcccccatgcacgcgccctcgatgcgcaccccaagactccgacccactgccgccacaccagcgagtaccatgacaccgcccagcacatccacgcaggagccaagcagcgaagaaacaaaacacaaatagcaaaagaaccagaaccgatactcagccacacacacacaccccagaccacacacacaccaaacacaaccaacaccatcacccattccacactcacacctactgcaccatcctctctaacaccccgtacacacaccacgacaccccctcctaaacagactccaccacatacatcacagcgcaccccggacgcgctacgcccacgaccgccgcgccaccacaacaacaacacgcgacacgaccacacgacccgcccccaccaccgagccccacacaccccccccacctctcgtgctacacccccacggcagcctcctacacacacgcaacctcgcacgcctccacacgcatccacaagcccactgcaccaccacacacgcaccaccgaacgacacccgacaagacacgccaacccccaacaccaccaaacgagctccaatcatcccacaca

SEQ ID NO: 656206 - DNA, 302 bp, Homo sapiens
gtctcgatctcctgacctcatgatccacccgccttgcccaaagtgctgggattacaggcgtgaaccatcgtgcccggccacatgccagtcatttttaaaagtcaactctgtgtgctgagctaggtgcctgagacatagaaatagattaaaccagtctgtgatgtcacatagctcacataagtttcctgtctctgtgagccctaccatacgcgagtgcctacaaagtgtgtctttgtgtctctgctcatttggccatatacctagtaggtagaaggtaagccactccaacctggttgctagca

SEQ ID NO: 656207 - DNA, 1556 bp, Homo sapiens
ttcgcaagcacgcgtgtcccccttctcccacacggctgcggagcctgggctggtgcgcgggggaggcggggttggcatcgtggaggtcgatccgccccctcccctcggccgctcgtgtgcccccacaccgcacgtgagcgcaggccggaccgcatccctcccgcaacataggtcgctgtccctggcatccagcctgccgtgtgcctccacgagctcctggtccccagacgcctggtgctgcacaagtccctgcgtcgtggtcccctgcaggccccgggccgggcgctatcgccgaggctccggcatccctgcattcccgggcggcagcgcgccaggcccgaagagcgcaagaagcaaggcacaggacccaccgaacaagactccgcgaaccagccccgaagataagacccaatagaagcaagcgcaattgggcaaaacacggacctaggaaaccctatcggcgcgacagaaaccaggacacacgcccgcgcattgaggcccgagagcatggaacctaggactagacaagcaggacatagccaacggcaacaacagacaccataggcaacgcgagagaaacgaaggccaacgatggcagcacaaacggaacgacaccatagagatccgatgcgacacaacacgaaatagaaccacactaccgtaaagcccaactagcttgacttatgcagacatattaccattgccagacccggaaataacggcccaaaataccaactgccttggccttgaaccaggtaccaaagcaagccccgcatggtaactcaaactatagaggcaaggatcaaacgcacaatgggaccacttttatggccccacatttgcacgaccccccaaataaatacaggcacttccaagcctattaacaccaggaccaacgcaagttccaaccgactataacgattataccatcacatattatataccacatagacgaacgtaagcgcaaatttccatcggaactgcacaagagcgaagactcagcctcgccgcaagcaaactttgcacagttggcacattacgattacacaaacaccatacgtaccacgtatgttacaataacaccaaacagcacataggaatacaagcacgaggcaaactacgcagaaaagtacccacatagagacgaacacaaacacacacggacccacacaacgcgagagcacgacgaactagcggacagaacaaagcaagagaaaccagcacaacgacagatacccataaacaagaatgagaaaggaaacacaaacacacaatccaatacccgcaacagaacccataacaaagacaccaaacagaacaaccaaacaaagaagagaacccaaccgcacaactccagaattaccagaagtccacacccagaagccacacaagcggcgaacaacaacacagtcgcacaggcagagctaggacaagaccgcaccagcaaaccgccgcccaagcaagaaaaagaaagaaaccgaaccaaccacgcaacaagagcaacacgaaagcccgacacaatacagagaccacaactggagaaacaaacagacaaa

SEQ ID NO: 656208 - DNA, 474 bp, Homo sapiens
  misc_feature (26)..(26): n is a, c, g, or t
  misc_feature (202)..(202): n is a, c, g, or t
  misc_feature (230)..(231): n is a, c, g, or t
  misc_feature (251)..(251): n is a, c, g, or t
  misc_feature (259)..(260): n is a, c, g, or t
  misc_feature (279)..(279): n is a, c, g, or t
  misc_feature (281)..(281): n is a, c, g, or t
  misc_feature (283)..(283): n is a, c, g, or t
  misc_feature (315)..(315): n is a, c, g, or t
  misc_feature (363)..(363): n is a, c, g, or t
  misc_feature (460)..(460): n is a, c, g, or t
agactcagagagaacccaccatggtnctgtctcctgccgacaagaccaacgtcaaggccgcctggggtaaggtcggcgcgcacgtggcgagtatggtgcggaggcctggagaggatgttcctgtccttccccaccaccaagacctacttcccgcacttcgacctgagccacggctctgccaggttaagggcacgggaagaangtggccgacgcgctgacaacgccgtggnnacgtggacgacatgcccaangcgctgtnngccctgagcgacctgaagngnanaagcttcgggtggaccggtcaacttcaagctnctaagcactgcctgctggtgaccctggcgccactccccgccgagttanccctgcggtgacgctccctgacaagttctggcttctgtgacaccgtgctacctcaaataccgtaagctgaagctcggtggcatgcttcttgcccttngggtcccccagccc

SEQ ID NO: 656209 - DNA, 188 bp, Homo sapiens
ctcctcttacgccccaaactcatatttattatatacgtaaatattaatgtttactttcgtactggctatactgttccaaaataaatgtgaaagctagctgtaaaatctgatttagaaacctgataaaacaacacctctggacacaatacaggctgtgaagacacacacacacacacacacacacacac

SEQ ID NO: 656210 - DNA, 534 bp, Homo sapiens
gcgtcgacagacgtcggcggtacgaatcgaacacatatagcacactcgcttccacgaatcggaggggaacaagaaagcgtccaccccactagagggtggaccgacagatcatgaggggcggttaggagcgggcgttgagcagctgctccatcacctcgtcgccgggcgtggtgcccgcgtagtcggtggtgcaggtggcgcgcacgatctcgtaaatctcgtaccaatacacattcgcctgcttcccgaaactctgggacatggcgacaaacgggctggcgatggcggcaccggtggtggggtgcttgccgagcaggccgaacttggagatcgcctgctcgcactgcacataccgggcaaacgcctgcgcatacgcctcaatcaggcgaggcgcacgaattgggaaccgccacgttgatcgagccactgccacgtctcccgatagacgaggtcagcgccaagcggtttgtcgtcaagctgaatctcgcgcaaataattccgatggtttgggaaatcttccccgaagaaacgaac

SEQ ID NO: 656211 - DNA, 209 bp, Homo sapiens
  misc_feature (193)..(193): n is a, c, g, or t
tccatccgggccaacccttccttcccatcctaaaaaagggccattttatgaggcatggccccccctttggggaaattgttctttaaattttgagccagtataaggaaaattgggtgggggttttccaagggagctgccccccttttttattctggggattaagaaggaagtcttgaaaaaaactttataaagncatctttaatcattcc

SEQ ID NO: 656212 - DNA, 147 bp, Homo sapiens
  misc_feature (101)..(101): n is a, c, g, or t
atcggtggtacccgtctgttttcttgtgcaaactgtgatactgatcctgaccaaccgctcagaactcatctcaactcgtttcacaggcgccactggcaganaattccttttaaacaaggtagttaacctgcagtacagtgaagttca

SEQ ID NO: 656213 - DNA, 405 bp, Homo sapiens
  misc_feature (179)..(179): n is a, c, g, or t
  misc_feature (286)..(286): n is a, c, g, or t
  misc_feature (307)..(307): n is a, c, g, or t
  misc_feature (360)..(360): n is a, c, g, or t
  misc_feature (386)..(386): n is a, c, g, or t
gacggctggctgcttttctcagcgccgaagccgcgccatgctcgtcctcagaagcgccctgactcgggcgctggcctcacggacgctggcgcctcagatgtgctcatcttttgctacgggacccagacaatacgatggaatatctatgaatttcgttcttatacttaagccctcaaagntgaatgattcctggaaaatttgagacgctcatcttcggacagcttcactctgaatggttggatacggatgtagatttggaagcagatgatacatgtttcaaattggnataagataatttgctcatcgnactgaagttcgaaagcttgccgataaggaatggcagaacaattcctcattccnaattcggctctcatgataaccagagntgagattactcggtaccgg

SEQ ID NO: 656214 - DNA, 349 bp, Homo sapiens
actcacacaggaagggagacagacagagagagagagagagagagagagaggcagagacagagacagagagaaagagagagacagacatagaaagacagagatggacatgagacgacagagagaaacacccagaaagagagagagagacagagaacgagaaagggagggagagagcgagagagagagagagagaaagagaagtaaacccacccaccacctccttgatgtgagtcagggggtctctggccttgaggagagaacgtacagcgacaatgcagtatgtgggcccgttctttttttcttcttcttcttttcttactataattggggagtgagtctgtataaagtg

SEQ ID NO: 656215 - DNA, 565 bp, Homo sapiens
gacccagagagccctgagcagcccacgacgccgccggcctagttaccatcacaccccgtggaggagccgcagcatgccgcagcctggacccagtcaccatcacctgcaaccatgagcagcgaggccgagacccagcagccggaagacgaaccaaccaggaagaaagaacagagaaacaagcgaaaggagaaaacacaagacaaaggaaagaaacgggaccagcggaacaagtgaaacacgcaggaccggagcacgacccacacacactatcacaccgacgacacgcccccaccacagcgaaacaacaacaagaaaaccgcaacacaagcacgtaccagagagaacaaacgacaagaacgagacccacacccacccgggagcagacagcgagcgagacgcgcccaacagcagacagcagcggacacgaaacaccccgcagagaagagacagagcacatacagagagaaagacccaacccagggcaccactagacacacagagactaaaaaaggcaggagaagccggacaaccagagggacaaagaccaaacgcagaaagcagaaca

SEQ ID NO: 656216 - DNA, 301 bp, Homo sapiens
  misc_feature (58)..(58): n is a, c, g, or t
aattctcaagaggctgggtgtggtggctcatgcctgtaatcccagcactttgggaggncaaggcgggaggatggcttgagccagcagttcaagaccaacctgggcaacatagtgaaaccccatctctacaaataattacaaaattagctgagtgtggtggcacacgcctgtggtcccagctacttggctggctgaagcaggaggatcgcttgaacccaggaggtggaggttgtagtgggctgagattgcataactacattccatccagggcaacagaatgagagcgagaccctgtctaaaa

SEQ ID NO: 656217 - DNA, 484 bp, Homo sapiens
  misc_feature (91)..(91): n is a, c, g, or t
  misc_feature (384)..(385): n is a, c, g, or t
cctacatctcagtggaggaaagttcatgacgatgggacgccaacgtcaaaaactttttgagcatgtgactagcgagattggagcagaggangcggaggaagtcggagtggagcacttactaagagacatcaaggacactacagtggggactctctcccagcggatcacaaaccaggtccatggcttgaagggacttgaacttccaagcttcctggatatcaggagcttacctggagaaggtaccagcgcaagctgcccatcaaccaccagatcatataccagctgcaggacgtcttcaacctgctgccggacgccagcctgcaggagtttgtcaaggccttctacctgaagaccaatgaccagatggtggtggtgtacctggcnntcgctgatccgctctgtggtcgccttgcataacctcatcaacaacaagattgccaaccgggatgccgagaagaaggagggacaggaaaaggaggagagc

SEQ ID NO: 656218 - DNA, 643 bp, Homo sapiens
cctcggaagatgttccggcacacggacagccctctttcccatcctactgcagacgttatctggatgaatcggatgaggtgatcctgaacgacctggaggtgctgttgcgagcataatcgcttcctcccccgcaggccagatctggatcgacccaggccccctcgatggccctgacctccaggccagccactcagagctccaggtgcccacccctggctagagccggtcctactgatacacctctggtaccaaaggctcagaatgttctccttcaactcccaccatgaattcttacgttcaataagttcatgatccacaccttctccaagagattcacgcagcgcgaactggcaagctcctgcgaggtcacgatggccctttcatcatcaggcagctgtgcctcctgctgactgcggagaacatcttccactcacatggcatgacatcctgctgcgcggaggaggcacctcatagttcgcctcgatccatggtccactgccctcagacatccatcctgctgacctccacgagagctcttccagctgaggaaccaggctgaaggacctgcagacctggagagccgaacctgtctgctgcctgtcccgctcctggtgcccaagccagtccccaccggtgtccctcg

SEQ ID NO: 656219 - DNA, 974 bp, Homo sapiens
ggctgggtaggcaagctagtgagctggtgataaataaactatagcatggactctaaatgcagtcattaatttaggtctttagcaggagggagaggactttacctgggtcttccaaaatgaggaaggggagagattttggtaagtagagcagaatgagggcatttcagaaaaggaaaaacatttgtctacctgctgtaaggggacatgaaatggtagatgcctgggacaatatggtcacctgcccaaggagcaggggagtaataaaccagcatgagataccatcatctgaagcaatttgtggcagcatctctgcggttaccacaccatcacctcattacttcaccaagctgtaattttccatattactaatggggttgcaaagaatctagtgtttcctattcagtgagggctgcacagtgggaaacatacagaaatcttcttgattcattctttcccctttggaaacttaggggacacaacatggactgatgtcatggctttacggtggattcagaagaggaccgaggaggcaggcacggaaggaggcaaggaagatgctgcagataaggggaaacaggagggagcacggagagagcagaaggagtagccaaaacgaactacctaacgcaggaaccacattccacacgaagtgacccgccatgggcggaaatgggtggacacattagggacacaagaatggcgacaaccgcggatacaccagagggaatccgaacaacaactggaaccagcaagcggaggcagcaagaggtgaaacaatacagtaaccaaacgaacagaaaagaaacaaggggaccagggaccgcggaaacgagaaggaggggaaaggggggaccaacgggactggtgcactgcagcacagcacaaagggcctgggcacgacggcacacaactagacagaaggagcagcaacaacaaaacacaaggcgtcagcagcaacaacacccaggaacacc

SEQ ID NO: 656220 - DNA, 430 bp, Homo sapiens
tctttacattcttgccagcattcattattgcctgtctgttgggtgaaagtcattttaactgggatgagataatatctcattgtagttttgatctgcatttctctgatgattgattaatgatgctgggcattttttcatatacctgttggccatttttatgtcttcttttgagaaatgtctattcagatcttttgcccattttaaaatcagattttttctcttgagttttttgagctccttatacattctgggtattaatccttgtcagataggtagtttgccaatattttctcccattctgtgggttgtctctttatttatttatttattttctttgagatagagtctcgctgtctcgcccaggctggagtgcagtagcatgatctcggctcactccagcctgagcaaaaagagcaaaactcccatctcc

SEQ ID NO: 656221 - DNA, 134 bp, Homo sapiens
cacgagcaggagccaagcatgcatgcatggctgaaggtcgacgtgtatcaccactgcggtgcttgcctccctgtacaagtccgacgacacgtgagcaccgtgctgaccatccaaatatcgttaagctggagcct

SEQ ID NO: 656222 - DNA, 1132 bp, Homo sapiens
  misc_feature (443)..(443): n is a, c, g, or t
  misc_feature (492)..(492): n is a, c, g, or t
  misc_feature (542)..(542): n is a, c, g, or t
  misc_feature (562)..(562): n is a, c, g, or t
  misc_feature (667)..(667): n is a, c, g, or t
  misc_feature (688)..(689): n is a, c, g, or t
  misc_feature (823)..(823): n is a, c, g, or t
gctccggacgactgttacagaggtctccagagccttgctctctcctgttgcaagagatggcatagtctgtaaggcgaagaaactcgattcgcatccagtttgcggaagcaagaggcaactagttccaatgcaataggatcactgtagtgtggtgtgggacaagttggtatggcgtgtgctatcatctattctgggacaagtcatctggcttagaatgaaccttgcatctctgtgagatagtctgtgtgaatgagtgaagcttaataggacgaaatgatcggatcatgcaagcattgggaggtgttatttatcgttctaggagtagcacttagataatttggtggcagtactaataggatctagtatcgtagatggatcccgaccgacattactgaaaagatgtgttaaggatggttgttaaccttgccagggcatgttccagntgcgatgactagatgcacagtgggaaccgtatgtcagaggccttcgaantccatgggttggcgaggatgacgactggtggaactgggtcatatctaganatttacacatataacttccntgcgaaagagtgccgatctaataggtgacgaaagtgcccgtgggacttgtgccagttcaactaaagtttggtagagttattccaaatcccgcaagattggaacanttgctttgacggttactgttnnacctggtaacactaaggctggacttaaacccagaacagccggcggtgactctggacacgtggactgtaactctggggattcgtgctagaatttgcgcgtaccttcatggcttgaaacaactttggcattcatcnccagcagcatgccatggcatggattttcgggggaacatggcgactcaagtgtggctgtgtggagtggtgtgactgtggcagggtgtactctccaggaattgaatccaaaaatgggaactgacaatgatagtgaacaatggaagggaagtgctaagatggtgggtgacaagtgcctatgaagtccacaggctaaagggttacaacagggctatgggatcacgtgtggggactcattgatcccgttgaaactatacggatctccgtgcaccaggtaggatctggctcaataactacaacccagttccagcg

SEQ ID NO: 656223 - DNA, 121 bp, Homo sapiens
gaagcacgatggcgcgtcccaggaagtcttaccccctcttctatttattaatttgcagacgccagcccctcccctacttttagggtcagctacgtctcttgaatagggtaccgatgctcga

SEQ ID NO: 656224 - DNA, 768 bp, Homo sapiens
aggacaaatccaggacagcctggctcctggccccgagcctcaggacgaagaccagaaggacgcacttccgaggtggaggagctggttcatctctgagccaggtgaccctgacgcagccatctggttgggagattcgcctggcgtatctgatgtactctacggaaatatgcgaccgtgtcctccctcatctgggatccctggagtcgttgtctcacggcatcctagctctctagtagacacagtaggtcgagcaggacagcgaccgatcttatgatctcgcgtgatagggatcctgatctcgcgtgagaagccaaagtcagcgccgggccaagtaaagccaaggccagtctcgtgcgctggtggtctagtggagggcagggccaccgccgggtgcacaggaaggcccgggagccccaccaggaagagctggtgccgaccgtcatggtctggcagatccctctgctgaatatataagcaggacggcgccttctgctgtcagaatttgcaatcaagggtgacttctcagctaatcctacagcctgagtggttaagctggtgtctacactggttgggactgaattaacaacagtatttgggggagaaacgtgcaatagcgtaatggtggtgtccctgccaaattccttccttctcttctgtacagcacgaagttattacaagcacttctcacgaaggcagaagactgatgcgatttgcgagtacttgagtgccggtctgggaaactaccacattctttttgactgctgatca

SEQ ID NO: 656225 - DNA, 181 bp, Homo sapiens
gggtcggccggacctaatcacaaggtcgtgggaatcatgcatataagggaagtagaagggggaaaaaatatcttaggatgcactctatggatcaaaaacccttacattccaagtgttaagccttggttaataccaatcgttggtgggcatatgggggggtacagttacgacatggtgatta

SEQ ID NO: 656226 - DNA, 229 bp, Homo sapiens
caccagacatagcatgtgcttgtgacttgctgagcattatggcatgcttgaattctgcgaccactgctccaagaagttccctgtgccatggacactttctttacaagaagagagtaatgcaactggtgccaaatgatgaatattctaagacccaagatgattctttatgagactgtcttctacttggatcagaacatgaacagctgtgaaattagcgcagtgagatcag

SEQ ID NO: 656227 - DNA, 1111 bp, Homo sapiens
taaataccaatatagttctctctaaaatcccggtgtttcccaggacaaagtgcgggggcaggctttgggcaaaaaagagttaaaaggggaaatgtggtggaaaaaaagtggaatgtggatgtggcccaggcccagggttccctgtgccttggggcaaatagggacttggggttgcctctcggggatgtgggggaggtgaacaagcaagctctcccctctggtgtctccaagttttatgtgcgaagagagcgcggctctgggggcctcccctctcccctcccccagaggccgtgaaaacatatttcttcagaggaatatatacttctcgtgcacctttcacagcccccaagacagagtggcccgaggcgcccgtggcgccctcctctctggggctcctagagaggagtggcgccccttgtggcgccaaaaaagagggcgccgtgcgcacgcaaagaggccggtggtgggggtgggcgctgggtgagcaccccgctggggcacgagcgccccgggcgtgtctctctttagcagagggtgcctctgtggggggccccgggcgagaggttgtgtcagagagggtttgccgtggtgcccctcctgtgggctttgctcgagggggggacatatgcttcctccccagggacagtgaagtggtcctctgtggtggcgccccccaaagcaacctgcgggaaaaatcccgtgggtgaaccacccgtgtggaactccccgtggggccaaccatccaggtggatactcccgagggcatcacggggcccgtggacaccccacaagtggcctcaccaaaagggggcgcaaagccacagcgtggtcccgtgcaagggacaaccaacccaaaaaggccctcccacgggcggcagaaaactcaaagcggggtcaagcacacgagggttggcccatagtttttgctcccgttgtgagcactcgcccgactaattggttcgcacaactcgctctaacagacgaagggctcccacagcacttgacaaacgacaatgggtgcccccctgtgacaccaacggggggacaccacctgtcatataggccagcaaccgttgtgaacacccccctacgggtgtcgcaaccacagaat

SEQ ID NO: 656228 - DNA, 139 bp, Homo sapiens
ggaacgaattccagccgttaccgttgagatttaggtaatcgataagaagttcagaatgaaatggtcttagaaattcaggtggtgggctcttgtgtttccacgtacgtggtacgtgtcgagacacaccgggttctcagag

SEQ ID NO: 656229 - DNA, 336 bp, Homo sapiens
gagagagacagagacagagtctcactctgtcacccaggctagagtacagtggtgcaatcttggctcactgcaacctctacctcccaagctcaaccgattctcctgcctcagcctcctgagtagctgggattacaggtgtatgccaccatgcctggcccattttttgtatttttagtagagatggggtctcaccatgttggccatgctggctctgaactcttgacctcaagtaatccgcctgcctcggcctcccaacgtgctgggattacaggcatgagccacctacctgcccagcctaattgttcttatgttctaatctctgtcgacgcggccgca

SEQ ID NO: 656230 - DNA, 423 bp, Homo sapiens
cattataggaagcaaaatgttaattggaacaatgtcttcttctgaaggaaagtgctgggattacaggcgtgaaccacagcacctggcccatctgtggaactcttatcttactgtcacttcacaatcattggaacaggaaagactgtatttataattactgatttcagtttgctcacctaaatcctagatgctattttttagtgtgtgtgtgcgtgtgtgtgcgtgcgtgtgtgcccgctcgctctcgcgtgctgtggtgaatgattcctgaattcacattgtctgcattaggcctctggcaatctgtcttttgactttactactcaatttaaccatcctatcttgacatctttaatgcgtctttactataattaccctccgtgctacgcctgataatttttcatttttcttcttatgatgtct

SEQ ID NO: 656231 - DNA, 736 bp, Homo sapiens
  misc_feature (59)..(59): n is a, c, g, or t
  misc_feature (66)..(66): n is a, c, g, or t
  misc_feature (111)..(111): n is a, c, g, or t
  misc_feature (136)..(136): n is a, c, g, or t
  misc_feature (221)..(221): n is a, c, g, or t
  misc_feature (230)..(230): n is a, c, g, or t
  misc_feature (238)..(238): n is a, c, g, or t
  misc_feature (250)..(250): n is a, c, g, or t
  misc_feature (252)..(252): n is a, c, g, or t
  misc_feature (259)..(259): n is a, c, g, or t
  misc_feature (293)..(293): n is a, c, g, or t
  misc_feature (313)..(313): n is a, c, g, or t
  misc_feature (341)..(341): n is a, c, g, or t
  misc_feature (352)..(352): n is a, c, g, or t
  misc_feature (413)..(413): n is a, c, g, or t
  misc_feature (416)..(416): n is a, c, g, or t
  misc_feature (438)..(439): n is a, c, g, or t
  misc_feature (441)..(441): n is a, c, g, or t
  misc_feature (453)..(453): n is a, c, g, or t
  misc_feature (469)..(469): n is a, c, g, or t
  misc_feature (488)..(488): n is a, c, g, or t
  misc_feature (490)..(490): n is a, c, g, or t
  misc_feature (495)..(495): n is a, c, g, or t
  misc_feature (499)..(499): n is a, c, g, or t
  misc_feature (548)..(548): n is a, c, g, or t
  misc_feature (558)..(558): n is a, c, g, or t
  misc_feature (568)..(569): n is a, c, g, or t
  misc_feature (591)..(591): n is a, c, g, or t
  misc_feature (593)..(595): n is a, c, g, or t
  misc_feature (609)..(609): n is a, c, g, or t
  misc_feature (617)..(617): n is a, c, g, or t
  misc_feature (670)..(670): n is a, c, g, or t
  misc_feature (672)..(672): n is a, c, g, or t
  misc_feature (675)..(675): n is a, c, g, or t
  misc_feature (687)..(687): n is a, c, g, or t
gggtcctgacagagttcacagcatatatggtggattcttgtccatagtgcatctgcttnaagaatnaacgaaagcagtgtcaagacagtaaggattcaaaccatttgccanaaatgagtctaagtgcatttactcncttcctggcattgattggtggtaccagtggccagtactatgattatgattttcccctatcaatttatgggcaatcatcaccaaantgtgcaccnagaatgtnactgccctgaangntacccangtgccagtgtactgtgatgagctgaaattgagangtgtaccaatggtgcctccnggaatcaagtatctttaccttaggaatnaccagattgancatattgatgaaagaggcctttgagaatgtaactgatctgcagtggctcattctagatcanaancttctagaaaactccaagatannangggagagttttnctctaaattgaaacanctgaagaagctgcatatanancacancaanctgacagagtctgtgggcccacttcccaaatctctggaggatctgcagnttactcatancaagatcacnnaagctgggctctttgaaggatngnnnaacctgaccttcantccatctnccaggacaaatcgggtgaaagaggatgctgtttcagctgcttttacaaggtcntnaantcactcgaatanccttgattgagcttcaatcaagatagccagaatgcttcttggtcttccg

SEQ ID NO: 656232 - DNA, 191 bp, Homo sapiens
cgagtatgcaggcgatctagtatatatcaggatgggtctcacgtagagttaaaataataaaaacgacaaagagaatataaaaaaatcatccaacggactggacatggcaaatggtgaattccatattcagacgaacacaagtccattatgatagtgcacagcaaagtcagtcattcagtgcctcaggttgt

SEQ ID NO: 656233 - DNA, 159 bp, Homo sapiens
  misc_feature (156)..(156): n is a, c, g, or t
agatgcactacgcgctgctgaggagaggtgccactgactcagtacagacagacggtgacaccgtcagtggtacattgtgaaaggtcaggatgcgagtcatctctcccgcgagcaggtcaccatgacacccgctgaggactcagctaccccggccgngca

SEQ ID NO: 656234 - DNA, 197 bp, Homo sapiens
agtttccagagtaggcaactagcgggacggagcgtcatgcatgtactcccagcagttggggaggcaagacaggcggatcacctgaggtcaggagttcacgaccaacctggccaacatgtgaaagcccgtctctacaaacacacaaaaattagccgggcatgattgcgggcgcatgtaatcccggctactctggaaag

SEQ ID NO: 656235 - DNA, 1188 bp, Homo sapiens
tgggtctgaaaacactttattacacaaattactttcagattctgaaaatagtgttctaacagggtaaccatctaaaaataaaacatcccaaaaacacaccaagcgtggaagaaaaatttaaaaaagaaattataaatagagaacttttttatttccttcagtgtggcaatataagtgtcgaggtgattttaaaaaaatgaggaaatttagcagccttgggtcgctcagtgttagcacaaagagttttcctcttttatgtgccacgaggcttaaagaaagtgcgtgaacgaggaagaggccaccaagagaaagagaccacgtggccaatgtgacagaggtgctagggtgggacaacaattacgtggtgttctcagagcaaaagaatgtggggtatattttacattccacccaaagaagttcttcaaagaggtgtcagatgtggggcaaaatttcttccatgtgtggtatagcatttagaaatttatgtgagtggacaaaaggaggagcggcgttctctcatagctctagtgtgtctcataataagagaccaagtggccacgggggttagtgaaacttttatgaggaaaaactctcctctcaacttagaaaaacgagaaacgccaacttttaaccaaacagcgaagttaacataagaggggggttacagttccccaaacgagactaagtacagtttcacacattaatatacacaggaactttaaaacgtgctaaaggggaaagggaatcgtgacattcgggggtaaatttactcaatctaaaacaaaaagctgggtttaccaggagggaggaaggtgcgaacgcaggcaaaagggtgcgtgaaaataaccctcttgtgagttaacttccaatatcgccctttcctgggcacgcgcccctagtgtaaacgcggtaaacctttttgagtgtggcctatagggttgaaaagattccacgagtataccccacaatcctccttaaatcccgaatccgaacacccgcatgttggccacacacggtagactaggacaaagacacgctaatgaggcaggcacccacaaggacaccaccgccagagctccaacacaccacccacgaggagggaaagacccccagaatcacgaaccacacatctacgcatagagctctacgctctctccttctttccagatcctacagacggggggggga

SEQ ID NO: 656236 - DNA, 409 bp, Homo sapiens
tttttggccggggatccatttggggagagagtccgttttaaaggtaggaccctttatgaatggttgggggttgaaaaagtgtggggttaaatgggaacctggccggacccacttaatggcaaggattttccgggaaatggtggcccccttcaacttttggccattggggccattacttaattccggtggcaagattttgttcaagtttaataagttgagtcccattgccggaactggattaaactggggggtaccaggcgattaccttgtaaaatgggccatgggcaagacccaccaaatggcttacatccgggggtaatttcccgggaaattttggcaggggattcagttgaattggggggtaaccgggattttggcttttaataaggttttaacacatggcgaccaa

SEQ ID NO: 656237 - DNA, 241 bp, Homo sapiens
cggcacgaggttttcactgagtatattttcaaggtgcatcccagctgtggcatgaatcagcatctcattcctttttattgccaaataatattctatcatatggatatgtcgcattttatgtatccattcatcagctgatggacatttgggttgtttgtactttttggctaccatgaataatgctactatgaacttttgtgtacaaatcttatgtggacttgtacacaaaagttggcggccg

SEQ ID NO: 656238 - DNA, 188 bp, Homo sapiens
gatggctcatctctctgtaatgtctttcacccctagcaagggagtggggcttggttcagaggacccttgttggaagggccagatttagactcagagctgtctagtttttacacgcggcacttgtattagccagcctaggtttaggtagtttctaggatagctgagccaaacaagccactcacacccta

SEQ ID NO: 656239 - DNA, 966 bp, Homo sapiens
  misc_feature (965)..(965): n is a, c, g, or t
cactataattcagatggtgaatcctaacaaggccaccattggtgtggggctgggcctgccatcattcaaaccagggtttgcagagcagtctctgatgaagaatgccataaaaacatcggcaggagtcatggacttgaacacgcagatgctagcaagactcccgtaaacgggccacagactgggaggccaccaatgaagccatcggaggagcaggtggtcgtcgggaatcctacctgcgagtggttgcgggatcaggagaagacaggctcggcaggtccgagggcccaggcaggcccggaaagccagtcgccacatgcagttcggcagagcagaagctccagtggtctggaggagtggactagacggtccccgtgggagcggagttcagtactcgtcactctgagtcaccctgtagctgcatgctgagatgtggcgcatgaacgcccccttccccaggctctgtgttagctcttggcaaactccttcgcctgtgcgccaggtacaagcagtcagttctcggcaggggccgaccgggcaacttccccccttgtgtccctctacctgctttggagtgccgggcctcattcagcagatgtccccctctgctttggtctgaatgactgggatgatgatgagatcctagcttcggtgtggcagtgtcccaacaggaatatctagacagtatgaagacaaacaagtgcacagagaaccgccccagacaagagttggtgggacccgggattgaaacattccaacccagtatcctgctctcggggccactaactattggtcttcctttgctcctcgtcttctgttcccttttctctctatcctttgtagcacctggtttttcttgcggcctatccgttttccgtgtgcgggcccctcaacacttcaggcgcggggaaaaacaaaatgccgccagaaaagatgcccaaccagaggggaccatttatttgtgtggng

SEQ ID NO: 656240 - DNA, 1188 bp, Homo sapiens
gtgtgttggccgcacatttgttgctccggcgtagatgctgtgttgacttcttttactcgctctttgttcctatgctcctccctctcctagtgtcccgccatttttcccccccctttgggtaaggtggtggaactacccccttgtgtggggtccgtctctgtcctctagcctctagataatgtggcgggagttttgtgggcgtccttgtgggtcggttccccacgagatggcggactacccactgcgattgggttgtgttatctcctctcgctctcctccctgtcgccgctcccctgttgtgtgatgtggctctcgctatggtctcaacacgattcggcagaagtcctggattgtatttgtcgcgccccctggtgtgctaagaccacgactcttgggtggagatttctgatttctcccctcgtgtgaaccccgctgttgtcccgctggggggccccccccctgtgagggccttttttttgtgtgttctgtggtgcaaaagcccacaccccgccctgctcaccagtggtggatagggggccacttttggctggggtcacagagagtggccgcactcacacacacagggcgcctccccgcttccccttgtcccccccctctcgggttttgtgtctttctgggcgtgtggcccccctgggcctctctttcttgagaggagatctccccgtcttattatgggggcaaagagttccccttgtagaaataggatagtccgtctcaactgtttgtggggccggtccccttgtataggaatagcgcccccataacactttgtggggtcttctcagacaagatgggtgaacacccccccgtttgtgtaaccagagggcttttgtgttgtgggcgtgttccagagaacatccccacatcttacaagcctctctgatagtcaagagaccaagcggacagaggcgtggcgctccccccagtctccccagccccccatgtgccctgttgtttgcttgggggcccataagcatggcgacatgcgccccccgttaaggccccctgccaccatatttctccccctctcctgtaaacactcggggccaacatacctcaccttttttaactggcccattgtgggtaatccccgctgcccggtcctttccctttccgcggggtattttgtggccctgaataaaagtatcattttttttttttttccta

SEQ ID NO: 656241 - DNA, 891 bp, Homo sapiens
agtaggtatagccaaaccaccatggtagcatggtatacctatgtaacaagacctgcagcaatctgcacctgtatctcgtggttttattttattttttagaggaaaaagaaaaggtacgttccattggtatccattattgggtgcaacgtagactacgcttacgatagaggataaatcgcatagtttgtgtaaagtatggcccccgaatacatgtgacaaaaagaatacatgtcccatttgcaagagatttcctctaaagaaaagatgtattccactttttgtaaggcggccagtggagacgacatattgtgacaaaatttctgcatgttcattgtgcaaaatctttcacatttgcgctcctcttgtcccgaaattttgaccaggagtatacatccacgaagaatatctctgacatagagtattcgcaacatccacttggggggacacatgggttgctgctgtgaatgttactcaaagggtcaacggtatttgccatcgcgcgaaaaagctcaacacttatttacgattgcactttggggttttttgctcaccgaagcgctactaaccaactattagcgtaatgcagcgaatgaatggctgggcagaaatgattttccgcaagaatgttcgtgaccctgttttacatcacctgggacaggatacctttctgataagaaccgcgctgttctctagccaggaattgccataaagacgcatgctgtcttgtgaccaggtacggaccagttcgtggaaacccagcctacgttgcgggcatggaattctcacaacggaaatgtcgcagcaacaaggagggggcgacccaaagtaatcataccttgatttgtactcacatgtcccaccctctgacccacacccactttggggttgggc

SEQ ID NO: 656242 - DNA, 353 bp, Homo sapiens
  misc_feature (353)..(353): n is a, c, g, or t
ggcacgagggaggctgaggcaggagaattgcttgaacctgggaggcagaggttgcagtgagccgagatcacaccattgcactccagtctgggtgataagtatgaaacgccatctccaaaacaaaagaaaagcctaattccccaagaactgtcagtctttcacctgtctgctagctcccagggagaccccacttgccagggctgtctacatttgtcctgagatctcttctggtgggaacagcactttcctcaggaaagtttgttggtcatcagatccatgattgtcgaagctgcctgtggtgatggatcagctggggttaggttttttgggtgggggtggggtcttgcttgttn

SEQ ID NO: 656243 - DNA, 200 bp, Homo sapiens
cccccccccccccctgtttttagggggccccccaagaaaaccccccccgggcaaaaaaacccccccccctgggttgttttggattatgggggccccccctaaaagttttaaacccaagggaaaccccccttggatttaaaaaaatttgccccccttttttttttttccaaaagaccccctaataaaaattttaaagggga

SEQ ID NO: 656244 - DNA, 201 bp, Homo sapiens
gcaaagcgctgagggagctcggtacgccgccgcctcgcaacccgcagacctcggcccgccgccgccccgttccccagagaacccatggagtctggcagtaccgccgccagttaaggaggcacgagcctttcgagaatgtaagctcttacgtccagaggcataacaatcaagcgctgctcaaagattctatttgtgccagtt

SEQ ID NO: 656245 - DNA, 440 bp, Homo sapiens
  misc_feature (90)..(90): n is a, c, g, or t
  misc_feature (237)..(237): n is a, c, g, or t
gctcacacctgtagtaccaacactttgggaggctgaggcaggtagattacctgagcccaggagtttgagaccagcctaggcaacatgganaaacccatctttacaaaaaataccccccccaaaaattagccgggcatggtggcacatgcctatggtcccagctacttgggaggctgaggtgggaggatcacctgagcccagggaggtcaaaattgcagtgagccgtgactgcgccantgcactccagtgacacagtgtgagaccctgtctaaaataaattaatttaatttaaaaataaaaataaatttaaaaagaaaagaggctgggtgtggtggctcacatccataatcccagcactttgggaggctgagataggtgtatcactggagcccaggacctcaagaccagcctgggcagcatagtgagaccttgtctctact

SEQ ID NO: 656246 - DNA, 463 bp, Homo sapiens
attcgcggccgcgtcgactgattgctagaaactgaatccaggaaggtggatctaagctgacgcaagagcttttgtaaactgattacctttgccttagaaggcagagcacataccaggaaggggagctgggggcgggtcattcatgtctggattgaaagcggagtacgctggggcgggagggagaactggatccgagaccagggaggcaggagactaaggctcctacagaagaaactggttaaaagattccagccagtccatgctactctgcctcagtttcctctctaggaagtttggaagtggtccacgacccttaggaaacctaaaagaaatctccccaaggcagatgggtggtcatcatcagattgctccctgccctctactctctttcaggatatcagcagtatattcagcttgagaaatacctccaggatcatgcagccacagactgcagaaagacagc

SEQ ID NO: 656247 - DNA, 481 bp, Homo sapiens
agcttacctgtgtacaaacccctgtcagcttgccggcctgccttggaaacccctcgatgtatgatatgggtcttttgggtgataaaaatgtctagaataataatgatgatggttgacaaccctgtgaatgtattttttaaagcacgaattatcacataaaatgattttatatggtatatggattatgtgtgtgtgtgtgtgtgtgtgtgtgtgtgtagtgtgtgtgtgtgtaagagagaatctgtgcgcctcagactcccagagtgatgggattacaggtgtgagccagtgcgcctggccctgtgtgtgtctttaaaattagtcgttatcaattgtggctaactctaatcatttgaataaccctgcataagtatttaagaacttatagctaaaacaaacctaaaaatttcttaaatctagtgtactgtgacacaaatgatgaattagaggcacaaaaaagctcagtgattgagcacctatt

SEQ ID NO: 656248 - DNA, 193 bp, Homo sapiens
  misc_feature (101)..(101): n is a, c, g, or t
atgttcgatcttacaggatgcaggagattaagtgtgtggggctgtactaacagatggagaaatccttcatgtcgaagaacgagtcccgatcctgtgcattnatgtactgtggctgtggataatttaacgagaagggatcataaggaggctgtgtgagaagattggggctgctgaggaaaaacggctggtgtat

SEQ ID NO: 656249 - DNA, 373 bp, Homo sapiens
agattgaccagctgatccatgagctgggtgtagcaggagagctggagtgacgggcacaagccgggagccgatctcctccggggcaaggattttgtcttctccttgcttggtctagtacaccgtcgtgactctcgctttcctcccgaggcagagctcttgctgcttcgtggtgggattctgcgaggtgctccctggatctggggcatgcacccctgggtccctacgcccggggacctcactacgatgccggcttcacactcctagtgcccatgttttcactggacggtactgaactgcaactggacctggaatcctgttacgcacaggtctgcctcccagagatggtgtgcggaacccccatccgtgacgatgt

SEQ ID NO: 656250 - DNA, 140 bp, Homo sapiens
gtcactctgaggatcccggcacatgtgcggcaaaagagtgagcggagatggatcacagccgaaggagtaacggtgctgcaatgatgttagctgtggccacggtggatttttcgcaagaacattaataaactaaaaacttt

SEQ ID NO: 656251 - DNA, 1071 bp, Homo sapiens
ggactgccgcgtccacctgtggtccatctacaagcccaattgcatcatgagcctgacggtggcacactatccccagtgtagagcgtccgtctcaacacgccccgaaggagctcatcttgtggccggctctcagtcgggctccatccgtgtctggcgacctggaatctgccatagaattctgtgcgcgacactcatggtgactagcatagagtccgcatacatcttgcattctcttggatttgccagccgtactggccgagtttgtccgcctctggttcccaggatcacaagcttcaagctctgggacatcaggcggaacggctgtgtcttccgatacagggggcacatgccaggccgtgtcggttgtctccggttcagtgccctgatgtggccatgtggttgcgctgtcgtgccggcccatgaccacatccgtgcagatgctctgtggatctcactgccggcagaagatgatgctctgagttccctggttcacactggggtcctggtcgacgtggtcgagctatcactgccttacgagggtacctcctggacctccggcagctctgacaggacacatccgcttctggtgacctggaagtaagttcccagggtgcgtgagctggcgtcgtaagtggggacccttgggtcccgtcaggagacgttcctcttcaagccagacggtctgctgtcctgtgcagtcgggttgcccaggactcactgtggtgctctcacggctgggaaccctgagcggttgctttgactgtggtcctcgtcacctgggtgccaaggtgtgcggacttggccatctgcaattgaccacgtgataggttgctggcttgtcccagagcaactgtgtcctgcttacatagtcggctctgaacggcgctgttaccaagggactggcactggggtgtgccccgtggcatccttttctaggaccatcctggggcacctgggctaggcttactggccttgccccagggcgcccggtccggtgccatctttgaagcggccccgggaccctgcggcacagcctcggcggtcgaccgcaattcaaatgtggcacctccc

SEQ ID NO: 656252 - DNA, 327 bp, Homo sapiens
gacggggggagccagtttctcacggtggagtggagtaataagcaaagggaagaggctataatggtcaatgtgggaacagattaaaatcagagacatcattatgaactcatgtttagcttaatgtatttacagatggttaaatatgcataaatatgtgtatatacataggttagtacatacacatatatgtccattctatgtcagctgagaaagcgcagacttcagcacatcccagaaacaacaagcgggccagcagcctgaccttggtttctaataccatactccaataaatggaacctgagcttcttggagaaatgactgatttta

SEQ ID NO: 656253 - DNA, 315 bp, Homo sapiens
atagcgcgacagtccccgataagcccgacagtccccgatagcccgacagccccgatagccggacagccccgcatagcccgacagccccgactagcccgcacagcctgtacccactcacgtggcttctcagcgggctgcatggaatgtactaggtagctcaccacacttctaggctaccatattgtacttcactacattttcagggtaggggaagtggtgctggacaaccacaggagagagcgtagagtacccagtatatataacctaggctgccctatggctaaaggtcacagcccctgtacgggctaaaagagg

SEQ ID NO: 656254 - DNA, 281 bp, Homo sapiens
ggagaaggaaagcaaaggagacatcaggaaagcccgggagacagagcctgggtcttctagctaagccaccctcatcggtgtgaaagctgatctcaagacagggtacaccatacaatgtggctgtttcaacaacagcatcttagggagccttctattcaaaccggatctaagttgtactttgggtttgagatgattttgcactgtcacccaggctggggtgctgcggtacaatcacaaactcactgcagcctcgacctcccaagcccgggtggatccttcgc

SEQ ID NO: 656255 - DNA, 127 bp, Homo sapiens
aacatgcgaacggactgatcggaaaagaaaaaagaaaaggaaacgaaaggaagggaaaaggaaagaagaaggagagaggtgcgaagttttccttgaaaaggtgttgggatcagtccgttcgcatgtt

SEQ ID NO: 656256 - DNA, 619 bp, Homo sapiens
gggtcaacataaaaaaaaggtaaggggggaaaaaaaaaaagaaaagaaaattcgaggattatatagctaaaaataaattattaaaaataaaaaaatttggtaaggaagcaagttacaaagtttatctaaaatcgtgtttcttttcacaagaaataatcagtttgaaaatatttttgagggggaattcacatttacagaagaaaccaaaatgtaaaaacttaggtggtaatttatggaaacattatagataacttatagaacaattttttttaaactttactgggatcaaaagattcaatcttgtaaatatccaataccaattcaaatatatcaaaataaacatctgagaatagcaaggaaacttctgataaagaagaaaaatggggactctcactcttgtcagatattaaaatgtatcctgaatagcacaataattataattaaatacattttaaattagggaagaaatggaaaaatcagtggaatagagagcattgagtccataaatgggcccaaataaaactggggatttcatttatggtaaaagtgatattttatgccaatgcgaaaaagaaggattattgtgttccacagtttgatgtcaaaacagctgtttcgg

SEQ ID NO: 656257 - DNA, 596 bp, Homo sapiens
  misc_feature (573)..(573): n is a, c, g, or t
atgttacatagactattagttgacttgggttggtcatagtcaggtcgagctctatttcctgtaaatagaaacacacctccctttctacactgaggtgatttgttattcttggctgctaagcagatttctagacacgccaccctcctatgggaggaacaacaccctacactgttaagttctttagatcttaagggaaaatatccttgtctaactgaaccctgggtctggctggtgtctgaggccaaccacacacacttcagcttgtggcaaaccacaaagtcattacctccactgctctgtccaaaatcgggagactggcagggggtccgactggacaaacaccaccctagtggcctcaaaactgtcatactctagggatgtttccaatgtcttatagccgcaaacttgggctgggcacccagccgcaaacctctgagataagagccccaggaaataagtgtcatgtgttaggcttagtcaatccttgatatcagcaaggtttctaaaagaattcttggcttgaccagctctgcccatctacccaatttccaagtaaactatcttctctagaanaagagtgcacctggaagggacgt

SEQ ID NO: 656258 - DNA, 144 bp, Homo sapiens
tcaagactgctgatgcagaggacatcgtgaacacggccctggccctgacgagaaggccataatgacctatgtgtccatgcttctaccatgccttttcagtgagctgcagaagtgctgaaactggccgccaacctggatctgtaa

SEQ ID NO: 656259 - DNA, 379 bp, Homo sapiens
ctggtgctgtgcgtcgccgcgagacggctgatcgtcctgaccgtgctgcttattatcggctcgcgtggcgctgttccgctttgtgccccagcagttctttccggcgtccgggcgactggagctgatggtcgacttgaaactggcggaaggcgcgtccttgagcaacacggcggaccaggtcaaacgcctggaggccctgctcaaggaacatgccggcatcgagaactacgtggcgtacgtggggacgggctcgccacgtttctacctgccgctggaccagcaactgccggccgccagcttcgcccagtttgtggtattggccaaaaccatcgaggagcgcgaaagcctgcgcacctggctgatcgagaccctcaacgaa

SEQ ID NO: 656260 - DNA, 621 bp, Homo sapiens
ggccctgccccaattgttcagcctccagacgcgccatgtgggccctgctgggccgccgtactgccctgtgtggctgctgtgctctccctgctgtgtggcctgcggactggtcgtgctcctgcgtgagcagcctgctgccgtccatgccacctgcgctgctgctgctcagcctgtctgtcgcgccgcaggatgccccgtgtgacatcttgtgacggtgcgcctgctgtgtctgcccgtgaccgggcagtgcgtggccctcgctgcgtgacgtgcaaccaggcatgtggccctgacatcgcactgacaaccggcgaacgaccgcaacgcagcgcacggacgcccctgatgacagcacttgcacgggacccggacgacaccgaccccgcacgcgaacgcggacgacgattggcatagcctagcgtcggcacgcacggccacttccattgccatggccattgagaccgagcgagtacccacccagagaccgacacgattgagtagttcataggggatatacgaacaccacttgcaaacaggtgtccaaacgatggggtgagcaacacagacgtgcgacacaccgtttcatgacaacagaaatgacaccatacagaagcgcgccag

SEQ ID NO: 656261 - DNA, 194 bp, Homo sapiens
cccctcctatcatgcattttttttttttggagaaggagtctcgctcttgtcggcccaggctggagtgcaggggcgcaatctcggctcagctgcaagatttggcctccggggttcaggaattctaatggctcaagatcctgagtaagtgggattacagggcgtgcgaccaggtccagtacattatttttggtggg

SEQ ID NO: 656262 - DNA, 244 bp, Homo sapiens
cgttccgtcgccgctggtccaccgaatttcacctctatgccggcgcacttacgatatgccccccggccgtccctctataatcttgagcctcggttccgtataaacctagtcaaaatagaaccgcggtcctattccattattcctatgctgcgtgtatccagtgcggctcgggcctgtctttgaacacgtctaacttattctcaagagtaaacagcttcgaggccccgccggggacactctagcg

SEQ ID NO: 656263 - DNA, 743 bp, Homo sapiens
agcggggcgaccagaactagggagctggtggagaaggtggcggccgctggaaggaggcccgggaggtggctgaggggtccaggcggcgggacgactctggccttttgaagaccggggtgggtgctctctaggaaactctacagagaagaatgtcagatgcagcagaagctccccgagaagcaacaggagaccatggagaaacagaaatgaccagaagaggaggaacctaatccaaattatacagaagtagaagatccacaacaggaatcacaaagatgacacaatagcatggagagagtctcaggaggaggagacggaaaacgggcgaggcggcaccggggcacggaggagggcgcacagcaggaggcaggggcacaggaggacaaaaagattgtcatggaagaaactgaggaacaaggctggagaagtccaagagacaggcggcttcaggaactacaggaacgaaagcacagtagagccccaagaagtcacagcgtccatgatccgtctggagacaaccagattactgattccagtcaatcacatcaggaattttcccaaaaagccaaagaggtagcaaagtcaaagctttccttacaattggagcgatgcagaaaacagatgagctttcacagacacctgagcacacaaacttgacttcctgacttcggatcaaatccagtctgaggaacacgcagatttaggccccgaaacagcagcctcaggagaggttgaggagaaaa

SEQ ID NO: 656264 - DNA, 102 bp, Homo sapiens
ggatttgctggtgcagtacaactaggcttaatagggacatgaaagagccatgatcgcgccacctcactccaggctgggtgacagagtgagaccctgtctcca

SEQ ID NO: 656265 - DNA, 2880 bp, Homo sapiens
  misc_feature (831)..(831): n is a, c, g, or t
  misc_feature (2874)..(2874): n is a, c, g, or t
agcggtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggactttngtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagcccgacgcagttgctaaaaatcttgctgcactgttgaatactaataatgcaacatttattggatgtttttgcattttgatgaccttcatgattcatttataagtctttgtaagtgcttaagtgaccccctcactagtgaaaataataaatgttctatatcatttattattatttgtgtattctctacatgatatatttttttaaggaagagtaactccacatgtcagaatgagtgatattatcctagggcaaagcgcaaatagggcagtttgtttctactctgcaaatatggcatgtataggaacaaaactcttttggagtggctggtcattgttttgccctcttttggtacctgagtacctttctggggttttgtaaatcgtgtgtcatttgtaagaatttcacgttaactctgcgttacttggtgttcacctgtggtatccttgactgaccataatgatttagtttgggtatgatgtgtctgctttgaaatgccttactggagtatgtcagatcctgctttaaagcattccatatatctgctgggacaataagttgcttctccttggaaatatgctctagattcagaagcaaaaccgattttgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaaactactctttcggttttattttctttagcatattgagtatagaaatctgaaacttatttaaaatttatactgcttttgttgatggctcattttggctgtgtatcctcacttatgtactgatttctgataaaggcttgacattattataacacgcattttgtgttccagtttaataaaacggtttctgagtcttgtctgaaaaaaanaaaaaa

SEQ ID NO: 656266 - DNA, 2786 bp, Homo sapiens
  misc_feature (831)..(831): n is a, c, g, or t
  misc_feature (2769)..(2769): n is a, c, g, or t
  misc_feature (2786)..(2786): n is a, c, g, or t
agcggtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggactttngtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagcccgacgcagttgctaaaaatcttgctgcactgttgaatactaataatgcaacatttattggatgtttttgcattttgatgaccttcatgattcatttataagtctttgtaagtgcttaagtgaccccctcactagtgaaaataataaatgttctatatcatttattattatttgtgtattctctacatgatatatttttttaaggaagagtaactccacatgtcagaatgagtgatattatcctagggcaaagcgcaaatagggcagtttgtttctactctgcaaatatggcatgtataggaacaaaactcttttggagtggctggtcattgttttgccctcttttggtacctgagtacctttctggggttttgtaaatcgtgtgtcatttgtaagaatttcacgttaactctgcgttacttggtgttcacctgtggtatccttgactgaccataatgatttagtttgggtatgatgtgtctgctttgaaatgccttactggagtatgtcagatcctgctttaaagcattccatatatctgctgggacaataagttgcttctccttggaaatatgctctagattcagaagcaaaaccgattttgctttcaccattaaggttgcattttaatgcagttattgttttaaattagagaataaaatgtaaaaccaagggaggctttagaaccctttattgaatggcatggcaaacttttaaaactgcttttgctatttcactagaactatctttgataaaggatatagctaaaaaatgtcagcccaaactgtgtgtaattagggttgtttattaaaattttctctaaatgtcatacagaggcttaagatctgtgtatgctgttgggtcggagtgccagtcactgctttggaagtctgtgttctggggctgcagaatgacaaacgtgtcatgggattaaaaccaatcaactgtgaattgtgaaattgaaactactctttcggttttattttctttagcatattgagtatagaaatctgaaacttattttaccgattctgataaaggctggcattatatacacgcctttgngttccggttataaaccn

SEQ ID NO: 656267 - DNA, 132 bp, Homo sapiens
tgctgatttttaaacagttgaacttccttgtactacagtttttgtattgacagccaaatttgtctttctgtacatacttggaagagccatgcagcaagcagaggagaggaacagaggagctgtgtggcttga

SEQ ID NO: 656268 - DNA, 322 bp, Homo sapiens
ctagcaggatctcaatacagcagctatccaaggcaatagagatgagaacctcaccgattctaagaatgagggccagcacggcagcacaccatatcatgacagatggtgaagatgcggattacacatcacttgacaaagcatcagattccacacggcataactcaacatcagagtcctctcataagggttatcattacaaacattaggaatctaggaatctgccttgaacatggactcactatcccgaatatcactcgggcgatacacaaagaatactgaccagcgtaacttggtgactcctgtgtccagcgattcctgggga

SEQ ID NO: 656269 - DNA, 1883 bp, Homo sapiens
  misc_feature (831)..(831): n is a, c, g, or t
agcggtcttttttttcccttttttaaataaatgtcaatttgatatcaagtaaaactattgtcattattgatcagaaaccatacattctgaaaatgaatccagttttcccaagctggcagaagtcagagatcatttttcaccttgatctgtgttgcgtttgtacttagtgaatggcagtgtggttgattggaagagcttgacactgatgtttggaaaaattctttattctagtggtcattttcaaacttgtcttctgtagagaggggaaaaattatgtatttgcagctaaagcgaagagactggcacaataattattaattgtgttagttcatttctatattaaatgaagcatcttcacaaatcaggtttgaagccattaaaagcaaaattttccctagtttaattaatttaaaattctaaattgcctgactacttagaatcttagaaacgccctgctagactgattttattatagaaatgttaacatgttcctcaacattttctcaagaaaattttcagacatatatcaaagttgaaaaaactttgcagtataaccactgctagattctgccatcaacatttgactatacttgtattgccatgtatctgttcatattctctatccctcttttcatccatcgatccatcagattttttttttaaagaacattccaaagtaaattttaggcaatacactgccctaaattcttagcatgggtgtcattaattaaggtttagtattcgtttaaatatctattttgaaagtggtgtatgaagttgataatctgagccaattaacatacttttttttttttcctcctgtggactttngtcttccagtttctctttttgtgtgtacttagggtgagggaggacaattcctttcaaacacaagtttattttagaattggtcatttttaagtgcttgtcataaattttaaagtttcaatataatttttcttttccccacttctgataatgtatttttgccaaactatgcagcttcttcaaaaaactgtaaattactgattggggtttatgaaatcagcgaatacctcatttcaatctgttgctgcttttctccctcttgtcacttctcctttcactactttcagctgctctaccagaaggtagaggggagtaaagggtcaaacccctatataattagctgttttaaacaactctaggagagcagattaagtagcttagtaagttgaaactattaatttttctaaagaatttgatttgaattccttgagaattgtaattatccacacttcctccagctataattagcagaattaaaaatgattgtactgtacaatgagttgttgaaattgtaagccttagtaaccatctttagctttattgtagtcatgtttagaaaaaattatttttacatatgcctttatttttatgcccactttttgtggataagattctttagataaaatctaaagaattttaagtgactttctccaggtcatgaagattcaatgggtagaattgaatcagaattgaaatgttccagattcatattcttgtgtgtgtttgataaaattcatggcttccaaagtaactgaacacttcctttgggcccttggagggaaaatccatatttttactaattacacttttttttttagacatctggcagttctttgaacttaaacatattctcatggccatagttccaaattaagccgggcttgttgcaaatcttgtcgcccgtcgacacaccacaacgggccttctggggagtcgggttgcgacacacacgaacactaaactggagaggaaacccccccatgtaaaagtcgtgtcacacacggcgtgcacccacttgagaagaccccacacgtaattctccacgacaaccatcc

SEQ ID NO: 656270 - DNA, 108 bp, Homo sapiens
gtgagtacaggaacaggagaagcccctgggctgtgagcacccaggtgacaggcaggtggacactggtctgccacatgttgccctcctctgtgccctcctctgtgctgt

SEQ ID NO: 656271 - DNA, 211 bp, Homo sapiens
atatggatctgctgcaccactttgtcgcgcgtggtgcggcgatcggcgtgacgatggcgacgtcgtcgccggcagtgcgttcagcaggctggatttgccgacgttgggctggcccgccagcaccacatgcaggccttcgcgcaggatcacgccctggcgcgcctgggcgatgagatgaccgaggtcgccggccagcttttccaacgtcggg

SEQ ID NO: 656272 - DNA, 115 bp, Homo sapiens
agtgttcttccgatctgattgtgtaaaagcgtgtaacacctcttctctctcactctcttcttcctgcttcggacatgtaagatgtgcctgcttccccttccccgtatgaggccaa

SEQ ID NO: 656273 - DNA, 326 bp, Homo sapiens
cctggaaccctctatggaagtcaattgtactacttaatactaaaaaagtaggatcctcatcaatagatagatacgtaaaggaatagtcaaactacatctacaaagtgtcagtatcaggctgcggcttcaaagccgaagtggtggtaaggatatgaagtggcattttagttgtcgtagtaagcatactgctacggaaagtagatccgatgattacgtgcaccccgtgaaaccctgtagccacaaagacacgtggatccttacactccgtcggaggtagtgcatggtgcttcgtaatattctgaggcttggaggagagagggtccagg

SEQ ID NO: 656274 - DNA, 418 bp, Homo sapiens
gagaaatgctgtcgactgtgcgaatccgcagacgatggagaatgccacttactacggacatgaggagtctgtcactgagagaatgttacccatagagcagtcacgactatatgtagagacctgctgttcctatgctagcccacactggatgcttgatgtgagagagcctttatctgagacatgtgtcacgactaaccgctctgtccaatagagagtgctcacattatgctgatgacggggagaataagtcatggctgatgactgtcataaagctagcccccgtgcgtacggctgaactggaggaggcatagctactagctgaaggtatgactatcatcctctgcagatgctgcgagtctgtgtatgcagattgcatggccatagagctgtctgaacacacaggtggactcagtgctct

SEQ ID NO: 656275 - DNA, 121 bp, Homo sapiens
attgctgatggttactctagagtatcccttcacagaagtatgcatctctgactgctggtgcacactgaaacgaagacagctaagagttgagttccagccttcattgggtttccaaggtcac

SEQ ID NO: 656276 - DNA, 156 bp, Homo sapiens
aagtctgtgggtgccggctctcctgggagctgtagctcagtctgttccaccggggttcatttcttcttcctaaagactccaagacgttcccagcggaaaccatccgcttcctccaaggggaccactttggcacctctcccaggacacgaatgttca

SEQ ID NO: 656277 - DNA, 794 bp, Homo sapiens
tcttactagctgctcgtgtgagactatgccagcacctggcttgtggggccaggatggcattcactccagactgggaaatgcctgagaagtttccactggtgaccactatcatgtgcctgtgcacgttatgactgtgtggtgctgtgtgttctgggtgtgcgtgactccagaacaagcactgggtacctacatcgccaatcgagtgactagacaagctgacacctattacacgacctgcatttatacttgctgtcgctacaggctcagctgctgatacccagtgcagtagctgatgctgtcacctaaccagctcggtttccacagcatttgaactgaatagagcctccacgtggtccacacatgcagccagcctctttaatgtgagatgttgttacctgatacctggtgaagacctgatgtgcgtggaatcatcatctgcattgcttgtgaccctcaatgaagtgaggtgcatgtgtgtactcagtgcctatgggtgtggtatagattggtaaatcgcagtcctattgccatttggagtgctccgtggagctcctacatctatggctatgtttgatagctacctaccggtgaaggcatgaccaagggaagagtgtctgcaattcacttgccaagtgctctcgctttggccataggagcgtgatggctccagtgttgggatgatccgcttgtcagccattgcagagtcagggtaagctgcaagtactttggacacaagaaaccaattcgcgttgcccttaacaacgctgaatctggatcaattgcacaaagatccg

SEQ ID NO: 656278 - DNA, 215 bp, Homo sapiens
gttgcatgaccgaggcttctggcggaggtctcagagaaattttcaagtcatgatgtgagtgcaatggcacgatgtcagctcactgcagcctctgcctcctgggttcaagcagttctccaccttagcctcctaagtagctgggattacaggcgtgcaccaccacgcacactaattttgtgtttttttagtagagatagggtttctctatgttggtc

SEQ ID NO: 656279 - DNA, 777 bp, Homo sapiens
ctcggctttgcctggacagctcctgcctcccgcagggccacctgtgtcccccagcgccgctccacccaggcccagcttgtaccccacctccaccagtacctgaagaagtggggctctcaccctacctgcctctgccatatggaatggcctggtttgcacagatgggaaacccgtttgcggggtggtgtgtctgggtgggcacgtggggcgaggacctgcctgcgggacctctgccctggagctgactagtgcaagctcggcgtcctgcccatcttgggctcgaaggctggtttctcccatctacggaagccctcccaggaccttccgtgcaagccctctgtcccacgacgctaggctctgcctgtccctttggtgtccctcccggcgctcaggtcctccatgctgggtacccttctgggcacctcgtttggcttgatgccatgggttcaagcctggctgggcgccctggcagtcacgtccttggcctgtggatgctgtcctggcccgtggatggtgtcccgggctccacgtacccctctcagtccctcctcttggactccagccatgggcctgtgcgtcgagccggaactgctccaggacagagaagcgccgtgtgtggctgcagtccaggccacttctgcatcgtccagtgaccggggaccatcgcgccgtgtgtctgcgcttatgccactccagcccgggccagagggtgcagaagggatgcaccgagagtcaggatcacctgtgtcagaagtgccccccggggaccttctctcc

SEQ ID NO: 656280 - DNA, 838 bp, Homo sapiens
taattttgggggaaaaagggggttaaaattttggggccgggggggttgtcaaacccctgacctccaggtgatccccccgctctgggacccccaaaggggggggataacgggacataagcctttgaactctggccgggaaaagggccctttcaccagaagtgataaccttaaagtgagaacctctgagggggggcccaaatatcacgagtaaggggggctccaaaaagcgagggaggacccatgtggggaggcagagagaccccagcgagttggcggggtcgcacagaaggaaagggccagaagaaggacgagggtccgaagagggacccccgtgcgcgagacgcatgggagagacgcagaccagagcgaagaaagacacaacccggcgcaaacccttccacctggggagttgggacgccccccaagatggcggggagaaaaaataaaaggccggcgcctggggggcacccagccggggcaaatcttttatatggggacgccggaagccaaagaagccctgttccaggggagggcaagctcctttcctagggggcgcccagggtgggcgctaaaaggagaaggtgcgccacaaaggctctcgagaagggcgcgggactggggaacaatcaaaggcccactataaaagcgttcaagtcttacgaacaaatcggttatgcccagggaaatggaaggcggccaggtgggggtgcccaggcggggggggggtggaacaacaggttgcctggaaagccaaaggggcctcaccaaagagaggcgccaggaagaccggtggaagcacgggagtgtgcgggaccccaaagagttgggtgaggaacga

SEQ ID NO: 656281 - DNA, 602 bp, Homo sapiens
ggacgcgtgggcacctgtgatcccagctacttgggaggctgaggcaggagaattgtttgaaccgggaggcggaggttgcagtgagccaagatcacaccactgcacaccaggctaggtaacagcgagagtccgtctcaaaaagaaaaagaaaaaaaaaaaaatatatatatatatatataaaggaaatttccagtctgtgttattgcagctttgaagttttggaatggttttggtaaatgatgtagtaaaaggaaattgggtaacccagaagattcttttagaaaacaggaccctggtgctgggtgtggtggctcaagcctgtaatcctagcacttggggaggccgaagcaggtggattacgaggtcaggagttcaagaccagcctgggccaacttggtgaaccctgtctctactaaacacacacacacaaaaattagcagggcatggtggcatgtgcctgtagtaccagctactcgggaggctgaggcgtgagaatggcgtgaacccgggaggcagaggttgcagtgagccaagatcatgccactgcactacagccttgggcgacagagcaagactccatctgaaaaaaacataaaaaaaaa

SEQ ID NO: 656282 - DNA, 137 bp, Homo sapiens
cggcacgaggagtacccgcactgcgaggagaagatggttatcatcaccaccaagagcgtgtccaggtaccgaggtcaggagcactgcctgcaccccaagctgcgcccctccggtcagcatgaggctcctggcggccg

SEQ ID NO: 656283 - DNA, 819 bp, Homo sapiens
ggcagagtgcgatggaacccagcggaatgcaggcgagctgagttaggtagtcagacgagggccgagaccggaaggcgttgctgtgccagcgattgctgctcacggttgctgcagccaggggaccgatctcttctctcgcctgacagcttcttccttcacctcacatgagcaaagaatgccagctcatgtctgacggctagcaatcgcttgacggcgatctccatccagggaagcgactggcgtggcttgaggacatgttcatttccgatgaatgtggggttcaccaaggacgtgggcacagatcaagtttctggtctgcgcagactgtgaaattgcgaccaaattggctaggcacttgactacgatgacaagaacgagtatctatgtggcctatggtaacgcagtttcccatgagtaactgaggggaggggtactcagctccatctccaaagattaacgctactccccacaacgaactggtctttaatgtggtatacactgttccgctgtccttcttgtctgtgctaatataaatactgagtaccagcatgtccatttgaacatgcagagggttaatcctgcttcctaaagcctcaagtacatgccatcctgcttagttcactttgtatcacatttcctaagctcccttttcccccagttttgggacactgtgcttacctccaaaaatctcatctcttccctggcattctccctaggctctgtattgcccaggggctcccgcttttcttgctctagaggagcagtattcaaccttttagctatgatgacacataacaaaaagatgttaatgtactaata

SEQ ID NO: 656284 - DNA, 932 bp, Homo sapiens
  misc_feature (711)..(711): n is a, c, g, or t
tagagtcaagatcttttatttcctgatttaaaaaatcgtcaccatcatagacctccgggcttctctggtatctagtgttctaattggctcccagcaggtgccttcacacagccccttatattccccttctgggtgccgtgcccagtgagcctgaggtgtgacagatcaattagcttggtccctccaaacgtgtgggagcaggactaaaacttcttctgggcaggcagagagctcctacctcggccagggtatcgagcctgggtccaccactcctacagtttcttctggctcctagggctatttggtgggcctatgggcatccagcgtggctctggggcatgatgtggaggtggcttacacagcatcaaggcacaaggatctccaggacagcaccagccaacagggcattacatggaaagacaaatgtaaaaccagaagtagagagggtggcccagctctccggtgcgggaatccgtcgcggggctcggtcaggaagtagagcacatccccatagatcgggcccacagagaccacaagctgtagaatgaagcggaggggatgctggcgcgagaaaggcgatacaacacccacaggctgagtggtccccaaaggcaagctgtgatggttccatgcacactgtgaagttgtcacccaggatgtactcggatgtatcccttggaataatcttaccagagtgagatagaaggctangactcccagcaggtctagaagtagagaacgaaccagcctgatcacaaggtgatgacccaaaactgcaacgcagcagaggtgaaaaggtagcggcaaggtcccaatgggaaaccggagcagacatgaaaaagacagtgggcacaataaacctggacaagaaggccggcagatggcagaggggacacagaaaggtcattagagagaaaagggacggccagaga

SEQ ID NO: 656285 - DNA, 135 bp, Homo sapiens
ggatcgtggactgcattgtcgcatcccaaggagcagggcgtgctttcttctggaggggcaaccttgccaacgtcattcggtacttcccactcaagcctcaattcggcttcaaggtaaggacaagcagttcttccg

SEQ ID NO: 656286 - DNA, 261 bp, Homo sapiens
agctcgtccatagaagcacttagcgttgtgcctggcacatagtgtatggtggataagtgggacttaagactaaaactcatgccctgatgtgtttttgcagtgatgttttgttctggagtacttcacaagagacaaggtccttggctgggcatggtgctgaagccaataatcccagcactttgagaggccgaaagggggggatcacttgagcccaggagtttaagaccagcctgggcaacatggtgaagcctcatatctacc

SEQ ID NO: 656287 - DNA, 101 bp, Homo sapiens
tagggaaaaattggcgttatatttattggaccatatttggataatcttcattcttgagcaggaggagtttcagtagatttctgggccgtggccatatgcaa

SEQ ID NO: 656288 - DNA, 793 bp, Homo sapiens
  misc_feature (345)..(345): n is a, c, g, or t
ggcccacccaggctgtcggccatgtggctgcagacgggcagggggtcgcgtccctgtatcaaagccctgaaccacagtgctcttctcacggcagccgtgaaagcggaaatgagcttgtggagacttccctgggacttgctgtccttggtccaagggtctggccaggtgtcagggagaggtgtgactgggtgccatcatggaccgtgttcctccggtgaaaccgggttcccgccatggaccgggttccggccatggaaccaactcgtgccctggaccactccgtgccctggaccggtttctgccgttgacgtgttccgtgcgtgaccagttcccgctggtatactngttcctgccctcggacggtgttcccggctgtggacgtggtccctttggggctctaaggtgcggaatgggcccagagctggtcccgtgcccagcgccctgctagggcttggggtccttggcctccaggggccttgggacttggtttcccagatttccctctggggttgtccacaggctgattggacctccttggaatgcggggcaggggccaccatgcggaaagtcgtgtctggactcccggaagcccaggaccaggctcagtgtcctcaagagaccacgtggttgactgacttcccaggactctccgtctgtcccttcagagagcaagcgggtcctcctccagggccttagagatctgccagagagtgttggacactcacggcctagtgatgggggggccggtctgttacaatccgggtcttacaccacgtgggattgccactgtgtc

SEQ ID NO: 656289 - DNA, 164 bp, Homo sapiens
ccgttcgaccttggttactgaggtatccttgctgctgcggtgccctggcgggggtctgccgggaggcggattaccggccgtgctagccccgcccataccgatcgatccacctgccaggtggaccaggccaatcctccaatttggagaaccgcatggccaacccg

SEQ ID NO: 656290 - DNA, 557 bp, Homo sapiens
tgtaataagcacaggcacgtgatgactcgctgctcctcggcggctatttagaccgagtcttgagtatatcgtcacatgtgcggcggtgctgtcgtagcatactgccatgcatgtagagtggtgcactacaaaggaccatgtctcatacattccactggaatggagactctggtcgcagtcaccttgacagggtcctgaaaactgcttgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacgactttaaccggtggcatcatg

SEQ ID NO: 656291 - DNA, 386 bp, Homo sapiens
  misc_feature (133)..(133): n is a, c, g, or t
  misc_feature (152)..(152): n is a, c, g, or t
  misc_feature (159)..(161): n is a, c, g, or t
  misc_feature (242)..(242): n is a, c, g, or t
  misc_feature (350)..(350): n is a, c, g, or t
gccttcccatcaggagcctgtacctggagaaggtgacaccaagacacagggagccccatgacccctgccatggtgcctctttttgctacaaagtgggtttccagctcagaagcagggctgccgggggtgctangaccgcacaggtggggttngcagggnnnattctacacatgtgcctgggagtctatttcaggcagaacagactgtgtcccttgagagcagcaggtgtgaagtgaaacctncctgcctccagacggcgggctcagggcgaggcacttagcgtggagggcgtgctaggctccagcccacagcggtggccacccagctgacatgcttcggaggagtccatngcgctgactcagcgctttctgtgccgcagggacacc

SEQ ID NO: 656292 - DNA, 340 bp, Homo sapiens
  misc_feature (269)..(269): n is a, c, g, or t
  misc_feature (323)..(323): n is a, c, g, or t
ctttggaaatgtaaattgttacaaacttactttagagcaaatttagtcatccttcaaaaatttaaatgtatacttatttcctaagaattcgtttggctcacacaattgtgaaaagatagatgtacaccagtgttcattacaacaattatgcaacaaatctattatgtgccagacattattcggaactctgggaatacataagtgaacaaagcagattcctgatctcaggacctggggtcaggggtcaggagaagccaaaaaacacgctngagaaatactttatgcagtgtggggggagtgctaccagcagagcaggggatggngatgtgaaatcttgtgt

SEQ ID NO: 656293 - DNA, 908 bp, Homo sapiens
gcttcagtcagtaagagggaggattaccttcaggagaaggcaacggaagaaaactggctgctatctttatagttccactgccctaaccaagtgtccacgattctaaactgtgctacgctgtccatcccttatgtaatagtggtttcccgcccaaagtgagactttccttttaactcggaagcaagggtatagaggtagtccaggtgggaacgccagaagtgctgattgcccagccattgggaccacctgttcttgcccccactagcctctagctgggaggccaaagtaacgcgctggcctggtgcgctgtctgctcggcttgaggactgtgcgcagggcactggtcctcccatctccctctggccaaagatggcgctttcgcccgctgtgtgcctgtcaccacccaccagcagctcatgccctgggcttcccaacatggcagaggtagcaggcaaacgtctcttcaacaaaaaacaacacaaaaactcgaaggcaaccctaactccggatcgcgcgcccaaagcacgccaccggccacagggcccaccatagggccccacacgctcgcacacgcatgaaccccaagcagcatcctgcgctcccacagcgcggccccaacatccagcccgggcaccccaaaataggggaggcccgcaatagaactcccgcgataaacgcccgagggtatcaacccctggcgccgctcaccagggacgcgtcgcggccaacgccccccgcccacagacccaagactcacaggcacaccacgatgcaacgctacaccgactcacgacacacgacgccgacggcccggggaaagacccagaccaacaacacacgacccaagacccagcaggcgagcgacgacgcacgcccggccccacagacgcacaccagcgccaaacata

SEQ ID NO: 656294 - DNA, 944 bp, Homo sapiens
  misc_feature (2)..(2): n is a, c, g, or t
  misc_feature (272)..(272): n is a, c, g, or t
  misc_feature (434)..(434): n is a, c, g, or t
  misc_feature (444)..(444): n is a, c, g, or t
  misc_feature (465)..(465): n is a, c, g, or t
  misc_feature (477)..(477): n is a, c, g, or t
  misc_feature (482)..(482): n is a, c, g, or t
  misc_feature (540)..(540): n is a, c, g, or t
  misc_feature (554)..(554): n is a, c, g, or t
  misc_feature (560)..(560): n is a, c, g, or t
  misc_feature (623)..(623): n is a, c, g, or t
  misc_feature (629)..(629): n is a, c, g, or t
  misc_feature (650)..(650): n is a, c, g, or t
  misc_feature (668)..(669): n is a, c, g, or t
  misc_feature (783)..(783): n is a, c, g, or t
  misc_feature (905)..(905): n is a, c, g, or t
tntttccgggtccgctcgcgttcactactccttctccgccttcattcacgccttccacgctttctcttgtgtctcattatccctgacgcgccacgggccatgtatcacacttgtctcccctccccttccccttccccctgccttaccgattgcccgctgcggtactttcaatccttttcccctgtgccacagccgcaatatgcaatctcacacttacttaaccatgacatcctgctggcccccacacccgcgagacactttaaccggccaanacgcactttaccaactccttcttttgttctcctccttgttatgttttgtatttggcgccatttacttttgttccgcacctacgattccgcgtgttttacggacatcacctttgtccacctaggccacgtattatcctgggtatcacgtgttacgcgcttgcngaaacctganattagtggtttggacactccncacctccccgcnctgcnctatggtttcgccgtccatgtgctttttttttccgccccacacgtaaattaccctgangactgcactttcancatggnccctacaattatgttggacatcactttgattacaaagtgaatttttctaatcaacaacatccncagganacgtcggaagctctcacaggnacatgccccaacctaaanntaccgacccacccccccaatccctctatttccactgaccttttcgtacgttcacttgccacttatcattcgcctcgcgactgaccccccggctggtatgattttccgctttttntatgccgttttcagtggacgaatgcactacacacagacagacacacacctcacctcctcatcgcgacggtccctgcgcccggaagttctcttttctcactcgcttactgtattgtcttgtanatcgtaaactgctcattttggcccttcctgttgccttaa

SEQ ID NO: 656295 - DNA, 1098 bp, Homo sapiens
gaacgctcgtcagctctcggagcccggcccagcttccataaaaatgtctacggtacactaaatccggtgcaagctcagctatggcaaagtgtagatccacctctacatgccaccaagatgcatagtggcgtctgtctagagccctagtatctatacctgggattgctgcacgacgggattgcttcgtataacacagttgattaagcaggacagtgcaagaccgcaaggggtggtggatgaaagtcaccagtggatcgagcatgttgtgatccgcaagtcggagcactggtgacacgagaccggtatattgaccttacgtcctaccagaggaaggtacccagagataggaaattcgttgagcgtcagtgactgaaagttcaggccttatcgtgggccacctggagagccgggtgaatctaggaagcgctattgagagacacctgactcagttgatgaacgacgtatctgagagcgtcatgagagcgttccagtgacacggggcgtggtgaaaccggacgaggcactctcgtcgagttgaggaatcatcctgggtccagcaagccaaggcagggagtctggcaggaaagttacctggagtctactaaggaaaatgtatcaacagacctgactctgtgacgaacgggagagttacttttcgcgagcaacaattctgaggtgaacttcctgtcacacgctgactgagttgggccgctgaggcagagacgggctatgatagcagccacgtagggaatggggcatctgtccagtttgaactttagtgaatgcctgatttgtacgtcgagaggcactagctccggagattcgtacttattgaagcgacttggcatgttgagagtagcgcaaacgggcatacgtgaattgctttcccacataggagggttaatcaagacattcggtgtgacaccagatgccgagaggaccgatgggcccccagactttcccagaataacgtgataaagggaatgggtaaagcaaaaacagttcatagaggagcacttaattcggaggattgttgtggaacaaccgacacttcagggacaacggagggttcaaacagcggagatcctggggaaaatc

SEQ ID NO: 656296 - DNA, 289 bp, Homo sapiens
  misc_feature (27)..(27): n is a, c, g, or t
  misc_feature (51)..(51): n is a, c, g, or t
  misc_feature (108)..(109): n is a, c, g, or t
  misc_feature (204)..(204): n is a, c, g, or t
  misc_feature (213)..(213): n is a, c, g, or t
  misc_feature (221)..(221): n is a, c, g, or t
  misc_feature (228)..(228): n is a, c, g, or t
  misc_feature (256)..(256): n is a, c, g, or t
  misc_feature (269)..(270): n is a, c, g, or t
gcaaatttctcattatttaagtttggntctggaaaggacatgacttctganatagccgctgctgggttttaaaagctgaggtctctcaaagtgtggaggagacgttgnngtcagggggaagccaagtgccgggaagatgtctattttttttttttgtgtattacaaatgtaaaatcatgatgtttgttttgactgctgatgcgnttgtttttnaaattttnttgtggnatatacagtattgtcatacagttgaagngaacaatgtttcnnaatgtaagtgtctgaaatg

SEQ ID NO: 656297 - DNA, 416 bp, Homo sapiens
  misc_feature (17)..(17): n is a, c, g, or t
  misc_feature (20)..(20): n is a, c, g, or t
  misc_feature (31)..(31): n is a, c, g, or t
  misc_feature (33)..(33): n is a, c, g, or t
  misc_feature (43)..(43): n is a, c, g, or t
  misc_feature (55)..(55): n is a, c, g, or t
  misc_feature (67)..(67): n is a, c, g, or t
  misc_feature (273)..(273): n is a, c, g, or t
  misc_feature (324)..(324): n is a, c, g, or t
  misc_feature (350)..(350): n is a, c, g, or t
  misc_feature (393)..(393): n is a, c, g, or t
ctgcttcaaagggatgnccncatataggaananctccagtctngagctcccactngagcaccaaagnagaaggccagtgatttctgcatttccaactgaggtaaccagttcatctcgttgggactggttagacaatgggtacagcccacagagggtgagcagaatcagggaggggtgtcccctcatccaggaagcacaaggggtcggggaactccatcccctagccaagggaagccctgagggactgtgccataagggacagtgcactctggnccaaatactacacttttcccatggtctttgcaacctgcagactgggagatnccctcgggtgcccacgtcaccagggncctaggtttcaagaacaaaactgggaagccgttgggaaagccnctgagttgatgaagaagtttttt

SEQ ID NO: 656298 - DNA, 665 bp, Homo sapiens
agcggaatcgcactcacacccgggcgcaggaggcgggcggcccgggcgccgagcgggcccccatggacgcccgccagcacggggcgctgagaccgcccgatgttcgcatgcccagcccggtccggctgcgccacgccgagggatctctggacaggacaagactccgaagctactcccccagaaacaacaatgccgggacccacaaacccagcttggacaaaaaatactgaaaaagaaaaaagaaaaaaaaacaggaacagcctaagagtgtacgacagtgaggaagcgatagagtagggaagggcgagacgggcgagcaaggtaggagctgaaggggggagccgcgaaagcacggaggagagtgacacgcacatagaggagatgtatataaaagataagagaaagacggacgtgagcagagagcagacaacagacgactgcggtcatacgccacacacaatccgagaataaacatacgcaccataatgactaaacctcgatccaccaaaacaaataaaataaatacatcaaataaacttagtcaaactaaacatataaataatatcacgaacactaatctctgcaggactaatttcaattcaattatacatcaaaacaaaaaactaaagaaagctaacactttaaaactaatcactaaaccgatg

SEQ ID NO: 656299 - DNA, 259 bp, Homo sapiens
gtcctatcataaaattaatgttggaataacttgaagttgttgataatacttcatgacaactaaagtctgacataaattacttgtttatgtccaatagctactacatttgatagaacagtttgaggacattcattcttgacgcagcatcttacatggttctcagcaagttgggatagtaaggattattggcttgtctcgatgagtggagcggcatgtttgtagcatacagttattcaatatcttgtctgatgccctaaaa

SEQ ID NO: 656300 - DNA, 1003 bp, Homo sapiens
tggtgcagcgcggcggatcccgcactcgctgctggtgcccgtggccgcctcctcgggcagccccccgggctcgggctggcggacagtggggatgctggggagacctcttcccggtgggctaggctgtgtgtcctgaacttgatcgcgcagatagatgaggcggatgagcccataaccacttgtgcgcggccggaccgcttcagggcgcaggggtggcggactccagtaaggaccccggtgctgggggcccttcgaaccaaactgttgtggcaaatcttggcggcacgcggggctgggctcattcaacgccccctggtgggaattgggcgcgctgcccaagcggcagcgcctgtttttttacccaccaggaaggtttggtcatgggttgtgccctgaaaccaaaggtgttaggaagacttgatatgtgggacataaggatctttgggaacgagggaccacacataagcggtggctaggaaacccgatgagcacgcaactgatgctgagtagtgttcagcccctcgttagcaccaaggcgtgtagggacacgaaaaagagtgtggacgatgacgcagcgtcgaggaaccagccacctcgacagtggagaacaattatagaggacagcaaccagactccgcgcggcagggtaggaactaaacaatgtggactcccgatgggtggtggcgcccgccattaccaatagagcaggcagggggtgtgaacccaacaggtgtgtgcgcggtgacatgctaagagtatagacaccctccgcgccgccgacagtattgagtggcagctcgccacagaaaaagtggcacgatagacgggcagtctaacatcagacgacgcgcgacagcctcgggtgtgtggcacataacaaaaacaccgggggaccaccagcgttgaggaagccacgccttgcagagggagcagaaggcgaggcaggtgggtggacccacaacagaacgggaataaattcgctcgccaggcgcagcataacaac

SEQ ID NO: 656301 - DNA, 256 bp, Homo sapiens
  misc_feature (69)..(69): n is a, c, g, or t
gccctcagtttttttcccttttttttttgggggtaaggggggagggggaggggggggtaggtccccccncaaaaaaaagggaaaggggccccccaggggggaccaaggggtgggggggccccccccttttttcctccatgggggggggccaaatttttccccaaagcccagggggggcaaaaaggattttgtttctgggtttgtttttgggggttggggggggacagttatggaaaaaaattttccttgcccccca

SEQ ID NO: 656302 - DNA, 449 bp, Homo sapiens
ggtgactctaaggatccccactttgggaggccggggcaggtggatacctgagcttagaagtttgagaccagcctgggcaacatgtgtgaaacccatctctaccaaaaatacaaaaactagctagccatggtggctcacgcctgtagttccagctactcaggaggctgaggtgggagtatcactggagcctgggaaggtggaagctgagatcacacaggttacaccactgcactccagcctgtgcgacagagtgacactccatctcaaaaaaaaaacaaagttttagatctaccgagacattgcaaaaagagtaccagagttccggtatacggcctcacccaactgtatacctatggttagtatcctacattactgcaggatatttgtccacaactaaggaacccaaatttgattacattactattaactaaatccccctaagttcagag

SEQ ID NO: 656303 - DNA, 360 bp, Homo sapiens
tttagacttctatcatgtaatacaaaaacagcactttagggccgagtgcggtggctcacgcctgtaatcccagcactttgggaggccgaggtgggcggatcatgaggtcaggagttcaagaccagcctgaccaacatggtgaaaccccgtctctactaaaaatacaaacattagctgggcatggtggcacatgcctgtaatcccagctactcagttggctgaggcaggaggatcactcgagctcaagaattcaagacctgtgcaagagagagagactttgtctctattaaaaataaaaatgattggccgagcatggtggtgcacaccagtattcccagctactctggaggctgaggcgag

SEQ ID NO: 656304 - DNA, 93 bp, Homo sapiens
tctgaagacaccgctgtctatttctgtgcgagagtgattgggaccactatctttcagggggtaattgggtcctttgactactggggccaggga

SEQ ID NO: 656305 - DNA, 401 bp, Homo sapiens
tctcgtaatcagacccagtaactcgacggaatgtacccatctccactgcatggctacggatcatcacctacctttccccagccggacaaagaaccatggtccccaaccaagtgcaaaggccctttatgaacaaaggaagaacttctgcacggaacagtgtcagcagtgtgtcagatatatctcaataccgtgttgaacaccttgactccctttgtcctggctcggaaagatgctatgatcacagttgatgcatggaatcaggaaattgcagcttgcttgatgccaagggcaaagtgtggactcaagatctgatccttcaagtggatgacgcgctgtgaacctgatagatttcaactccacaaatgcaactggaaaattcacctataaacacaatccaacaa

SEQ ID NO: 656306 - DNA, 273 bp, Homo sapiens
  misc_feature (244)..(244): n is a, c, g, or t
  misc_feature (249)..(249): n is a, c, g, or t
agatttggccgggccctaagacattactggagggaaggtctgctcatctcccagtgaaccaaggtctctggtcctccataggcagaggatcctgcggccggctcgcaatgtatgtgtccctgggtacttgagatcatggagtggtcatcactcttaccgatcaggcatgtctgccagtatctgttcatcaaagcacctcttgcaccgcccggaatccatgtaaccctgatggacactccccatnccccngaaagcacaaggctggggtcaagg

SEQ ID NO: 656307 - DNA, 114 bp, Homo sapiens
ggatcccagttgacggatgactctcaaagatctcccaatataacaaggtgtaggtcatctcacaccactgtcatcacttctggaagactatccacagggatggagggctgcagt

SEQ ID NO: 656308 - DNA, 456 bp, Homo sapiens
ttggtccactaaagaccgaacttatgtgtatggtgagtataaggtaccaatatttttaattttatagcattatttattgaatactctgtagttgttctagaattccaactctgtcacatgcaaagtttccttgtatatattcaattttgcaccaaaggtacactatcctgcttactatctcaatataattagactcaataattcttatttttcttctcaggagtggttttgccaacttgcacctttgttcttttatatcagtttgagaatcagattttaagtttcaacaaaaataagcctgtttcaatctttattggaattgtataataataataatttaatttgaacagaatggacctatttcagtgactgagtcttactattcatgaggatagccttttttgtttatatttaatatctttcaataaagttttgtaagtttgtttaaaaaaaaaa

SEQ ID NO: 656309 - DNA, 852 bp, Homo sapiens
ggcctcccaaagtgctgggattataggcgtgagccatgtgcctggcctgtaacctctaattctgtgtttgctggctgtcctagagatcctgcagaattattttcaataaaatcattttttggctgttattaaaacttaaccttgaatgtgccttaaaacaaagaactcgtgtttgataaaataagcatagttttcaggaacagccatgcagtatataattttttatcaacattttatacataattggggacttatattaaaatgtaatcatttggatggcttatcaaaagggtacatggggcaatgcaaaatcaaattatccaggctataataaactcatcacctcaacttaagaataacattatggagtgctgtgtcattacaatctatgggagctcttctcctatcttgtgcgcgaccccccgcgctctcttttcacaatagatgcgtccgaatgtagaaggactaaaatacattatgttccctaaagtgacttatctcatagtcgcctttcttttgacacttcaaaaaaatgtgtttcatactctatgtagtcaaaggatgggttttccactcaacatgtcttctagaattcccacgcttctagtggtatatagcctgtcacttccatggaaggtatattccagtgggggttctccaccactttgttagggaatcctccctctttctcaccttccttttttcaacagccaacacgcacacacaacgttggggcgccgcccgagaagtttaacacctctgtggcggcgccccagaagagaagtcgtcagttctgaaacacgggcgacggggccccaaacggggcgggcgaacccaatggtcgttagcacg

SEQ ID NO: 656310 - DNA, 211 bp, Homo sapiens
ttacaatgtaatctacaacacattccgatctcatctgtagtaatgtctagtcaaattttctatttcttgagtaatgttggtaactctattctattaggaaattatatgttatctttagatttttcaattttgatgtcatatgtttgtgtgtaaaattataataataataattataatataaataataaattactcatgtgatttaatatca

SEQ ID NO: 656311 - DNA, 264 bp, Homo sapiens
aaaaagcagcacacacgatggaccctcagcatgaggctgctgctggaagtcacctattaagccatcgtggacagatgtgagtcgggcattcgcgaatgctgcgccgagggctcctgctgctcacgtggaataggcagtgttttctcttcttggttctggtagaaccaggtgctggcaccacctaccctccccggctgtgccccttgactggccaacgggctcagggaggtgtgggccacggggtaggccgcagtttcccaactg

SEQ ID NO: 656312 - DNA, 805 bp, Homo sapiens
taaacccccccctaaaaaaggggaaaaaaaaaaaaattaaaacaatttaaaaaaggggaaaaaaggggggggggtccacacaacacgaatgttgttgtggtttatcaggaggaaaactaatcgggcggccgacaacaaccatcatatcgcgaaggaaatatcgtccccccaatagcactagaacgtcggcgaggaaccgtgtggtgtcgccacaaaacattgtcttgcacctcgatgacaatccccccgaaaataggatgagaaggaacgacgaccaaagacacctccgggagggtcgatcaggggtcaaaaaaaccaccccacaaacgaatgagggtaaaaaaacgagaggggtgaaagactaaatgagtgggcgtcgggggcggtgcttactatctaaaacaagtggggcgacgccgcggggagatgaatgatataccccgcgagtagcgggataccaaaaagagacagcgatttagaaaaaacaggggcggcgacaccactgagcggataaattacgcgggcacacctcctatcgagggggggcacgagccacccccaacagaggggggagcaggcagccagcaggcgtgggagatgtgataaagcgagccgaaacacctcgcgacaacaacacacacctccggaggcagccaaaacaagagtaacttcttgccactagaagcgcgcatcaatagcaaacggatgattgttcagctaggagagagatgtgcgggcccccactggacaagaggagaacaccgcggcagcgctatgactacttcccgccacgaagagaagtaga

SEQ ID NO: 656313 - DNA, 700 bp, Homo sapiens
  misc_feature (700)..(700): n is a, c, g, or t
atggaccacttcccctgtcacctcgcccatcctctcctctcacggtctccggtcgcacgcccgatgtccggcgccgtcacacccatctcaccaggcacacctcatacacgaatacgatctcatcccactcacacacgggaacttgcccctcggcgcccacatttcggcaccagtccacactctatatacaaatgttcatggcagctttattcacaatagcaaaaaatggtaaacaactcaaatgtccatcaactattgaatggaaaactaactgtggtatgctcatataatgggatactgttcaacaataaaaaggaacaactgatacagacaatgacatggatggatttctaatgcattatgctaagtgaaagcagccaggcacccaaggctacaaacgaaaattcctgcacttatatggactctccagaaaaggcaaatctataggaacagaaaatcgatcagtgattgccaggaacagcagactgaccatgaaggagatgagacaacttcttgatgtgatggaaatattgtatatcttaattatggtgatggctgtactgcttaaacatttgtcaaaactcatcaaactgttcatttaagaagggtgccttttattgtatataagttatactttcctaaaactgattaaaaaataaaaacaatgggctgggaaagggaagaaaaaaaaaaaattaan

SEQ ID NO: 656314 - DNA, 227 bp, Homo sapiens
ccagaggattccggtcgctcggacgaaccacaggtcctaaactaccaaacctgcattataaatttcggttggggcgacctcggagcagaacccaactccgagcagtacatgctaagacttcaccagtcaaggcgaactactatactcaattgatccaaataacttgaccaacggaaacaagttaccctagggataaacagcgcaatcctattctagagtacatattc

SEQ ID NO: 656315 - DNA, 467 bp, Homo sapiens
agccaacatttctaagtcctttcctttgccctctgctcccttagaacttgccccagaccccaaatcagggaggaagatttgaacctgcctcctgtctccttgctggctggtcttgcaataaagtctttcttttctcaaaggcagtaccatggtattgcttccgtgtacattgagcagtgagcctgaatcaggaaaatagggtcaggaggcagggaacataaggccaattcacacttcggctgtaacaggaaatatccactccatagggcgtatgctgtaagtgactttgtaactttacttcatcctctgcatttacgtagagggtaagtgaagtaaacaatggaatcatctaggggatatttaaacttccaaaaattctgtaacggggcctttgagcccctatgttcgggccgctcccacactgtggaatgtaatttcgttttcaataaatcccttcattccttcaa

SEQ ID NO: 656316 - DNA, 899 bp, Homo sapiens
acatctgccggctcaggacgggtcgtgctcatcccttaactttttaactttatgtgtgtctatttatattttattgtgctatgtcttgaaatgttgttgtagctattactttgatggatattacttagtattcctactttaaataagagtagttggcacaccacacagctatagtgttataatattctgtttgtttgtatcctattagcagtgaggatttttttttacctttaggtgatcatttattactcattaatgtccttttcttcctgattgaagtactccctttagcattcctttaggacaggatttgtccccagtgccttatttagttcacttggtgaggtcatgttttcctggatggtgttgatgctagtagatgttcttcagtgtctggacattaaaatcttgggcatgcagcaccatatgagaagtttaaaacaataaaatttaaacgagagaaaaggcttggtatcaggatgattattgcggcactattcacaatagcaaagactgggaaccaacacaaaatgtccgacaatgatagactggatttacgacacatgtggcacatatacaccatggaatactatgcagccattacaaaatgatggagttcatgtccttgcagggacatgcaggaaggctggaaaacatcattctcagcaaatatcacaaaggaccaagaacccaaaaccggatggtgctcaactaataggtggcactgaccactgagaccccgtggccaccggaaggggacctcaccacacacggcacggtgaggggtggcggagagcgggacaggcagccaccgagagtcaccgatcgcacagacagccagcgccgcgcacccaaggtcgggttcatctgttccaaccgcggggcgtgggctaacaaaa

SEQ ID NO: 656317 - DNA, 501 bp, Homo sapiens
aaaggtcagtgtgccagtaaaagtctgatggacaaactactaacttaaaactgcacacgcaacaacgcaaaaccgcgtggtccacaaaacatactcatttccttctgacggtttcacgatgcatgtacatcattaaccagtcttgtactactaaacttaaatggccaatagaaacaaacagttctgagaccgtgcttccacgcactgattcagagtggggtggcaggtcattagggataatcattcatttagccttctgagctttctgggcagcactggtgcaccttgccagctccagcagacttctagtccactgcttggatgacacccaccgcaactgtctgtctcatatcacgaacagcaaagcgcaccaaaggtggatagtctgcagaagctctcaacacacatgggcttgccaggaaccatatcaacaatggcagcatcaccagacttcaagaatttagggccatcttccagctttataccagaacaccgtcgaag

SEQ ID NO: 656318 - DNA, 439 bp, Homo sapiens
  misc_feature (161)..(161): n is a, c, g, or t
gaatacccactcagtttatcccaaaacctgaaaaacatggcctcaaaggaagaaaactttccctttgtccttatgaatcccatgtcccaatcatctggttttccttccctcttttttaacccaaacagccttaaaatccgaactctgggcccaggcgcggntgtcacgcctgtaatcccagcactttggggggctgaggtgggtggatcaccggaggtcgggagttcgagaccagcctgaccaacacggagaaaccccatctctactaaaaatacaaaattggccgggcgtggtggcacatgcctgtgatcctagctactcgggaggctgaggcaggagaatagcttgaacccgggaggcagaggttgcggtgagctgagatcgcaccattgcactccagcctggacaacaagagcgaaactccatctcaaaaaaaaaa

SEQ ID NO: 656319 - DNA, 232 bp, Homo sapiens
agctgggattacaggcacctgccaccacgccggtctaatttttgtatttttaggtagagtcgtaggtttcaccatgttggtcagcctggtctcgaactcccaacctcaggtgatccacccacctcggcctcccaaagtgccgggattacaggcgtgagccaccatgcccagcctctgtggcatattcttcagcaaagtatatgaaccaaatcacaggtggatgaacaccaca

SEQ ID NO: 656320 - DNA, 345 bp, Homo sapiens
gctcgaccccttttgcctaaagaggcctcagaaagactttaacacagctttagcaggagggtgggagaaggcaactagaagcagagggattaatttgaaaatctcccaatgacacaccaatagtttccccatcccaatgtacatgaagtaattgtcaggcctctgagcccaagctaacccatcatatcccctgtgacctgcacatatagatccagatggcctgaagcaagtgaaggatcacaaaagaagtgaaaatggctggttcctgccttaactgatgacattaccttgtgaaattccttctcctggctcagcagctcccccattgagcaccttgtaacgtcg

SEQ ID NO: 656321 - DNA, 111 bp, Homo sapiens
aaaaagaacagaaagaaaggccaggtgcagtgagctcataccgttattcccaacatttggggaggccgaggcagacagaatttgcttgaaccttgggaaggcggaggtttg

SEQ ID NO: 656322 - DNA, 169 bp, Homo sapiens
aggacagtaagtcacctagtgctagacacatcacggcagatcggaccataggtgaccataggtaaaagattcctacttgcccaagacagggcctgaggtggccataaagatggagaggatgatgtctcaaggagcaaccctatactctgttacatgtctagaggacacc

SEQ ID NO: 656323 - DNA, 820 bp, Homo sapiens
  misc_feature (665)..(665): n is a, c, g, or t
agtgggcggcaccgccaggcgatgccagcacttccctgcgactgctatcccgctgctccgggcggcactggggccatgagacctgtccgtgatgatccgctgtgaatgaccctaaggccccacccctcctgtccagctgggcaagaactggacctgccgcgcaatactagggcagccggcagctcctcgagaccctctcatgtgcccacctccgtacaactggaggggctgcccgagtgacccaccatgcgggatgcaattgcgatgccgtagggaagaggtgaataaggacttcggcgtacgcatgggtagggagtgattgtggggacgaccagtttctccgcagttagggtagcgggtcgtggtgtgtcgctacacgtctacacgtgctcgcagcgcctcatgggcaggaggatccccatgggtatgcccgtgtgatgcggccctccgacgatcgtgcgcgctcgcttgtcctccttctcctcgatggtgcgaagagggttctcttgtgcccgtccccgatgagagcgccttgatagcgacctgttgctcatgtttgtactcgtccatggctgtgtcctctgaagtgtaccccgccttgtggggcccctctgtgggcatgccccccagtcagagctgcagagacgcaccatcagagactcagntgcgacagacggctgggccgataaggtgggggaggaggcatcacgccgagggccctcctttcacaaggcctgcacggggacggacggaagcggggcgcagaggccgcacaaaggcaggccaactcggggaccaaccaaaacgaaagcacgagaat

SEQ ID NO: 656324 - DNA, 957 bp, Homo sapiens
  misc_feature (951)..(951): n is a, c, g, or t
gctttcagctggcaagcatctagtgaagctcagaatgcctccatgggtttaaccagatctaagaatctccaaactatacactgtcaccttcagactgttacctcatactccatttcactgtatgctacaaatattttttatgttcaagacacacagtacagaactgcggtggatctgtcctgttgactggtgcatgggctatacaccacggataacatcaatttcctctgaagttagttactttacctatatagttcgttaattatttcacgtgccccattgccgaagaaatcattacatgcttaaataaatacttctccatatgccgggggatgacatccagtgaattatctccgtggtgtgccactgaaacatcaataatggtacttgaatgaattaaacacatcgcattcgagaatactaacttgtagatatgcttcctttatcgcgaaatctctaagagcttcaggagttgcagctctggagaaaagtggccgcatgtttcattcctttttgcccgtgatttagtattgaatagaaacctaggccatgccatgagacttagggatttaaaatgggttgctaccagctgttgcagtcacccagtgaagagcctatgtgcattggtcgtacgagtcatgtgacattggacctcaaatcgttcattgatatagaatagctgacatttgactaccaacctctaagtcgctgctccccacctctgtatcttaccggcattggggttcggttactggcccggactgggcacgattcagggtgcggatccaaaaatagattccgcaaatccttaatccaggggggtcacaaccgtaaatgggcactctcagacagggtcgcccaattgcatggacaagtggcacgagatcaccaagggatggaacatgattgaggggccaaaccgcaaaccccgtaaaccccgcccacaccctntcagaa

SEQ ID NO: 656325 - DNA, 752 bp, Homo sapiens
  misc_feature (14)..(14): n is a, c, g, or t
  misc_feature (144)..(144): n is a, c, g, or t
  misc_feature (218)..(223): n is a, c, g, or t
  misc_feature (228)..(229): n is a, c, g, or t
  misc_feature (231)..(232): n is a, c, g, or t
  misc_feature (248)..(249): n is a, c, g, or t
  misc_feature (253)..(253): n is a, c, g, or t
  misc_feature (266)..(266): n is a, c, g, or t
  misc_feature (276)..(276): n is a, c, g, or t
  misc_feature (284)..(284): n is a, c, g, or t
  misc_feature (287)..(287): n is a, c, g, or t
  misc_feature (289)..(289): n is a, c, g, or t
  misc_feature (295)..(296): n is a, c, g, or t
  misc_feature (301)..(302): n is a, c, g, or t
  misc_feature (305)..(305): n is a, c, g, or t
  misc_feature (327)..(328): n is a, c, g, or t
  misc_feature (335)..(335): n is a, c, g, or t
  misc_feature (338)..(338): n is a, c, g, or t
  misc_feature (343)..(343): n is a, c, g, or t
  misc_feature (350)..(350): n is a, c, g, or t
  misc_feature (365)..(365): n is a, c, g, or t
  misc_feature (369)..(369): n is a, c, g, or t
  misc_feature (439)..(439): n is a, c, g, or t
  misc_feature (447)..(447): n is a, c, g, or t
  misc_feature (449)..(449): n is a, c, g, or t
  misc_feature (453)..(453): n is a, c, g, or t
  misc_feature (480)..(480): n is a, c, g, or t
  misc_feature (488)..(488): n is a, c, g, or t
  misc_feature (490)..(490): n is a, c, g, or t
  misc_feature (546)..(546): n is a, c, g, or t
  misc_feature (567)..(567): n is a, c, g, or t
  misc_feature (574)..(574): n is a, c, g, or t
  misc_feature (576)..(576): n is a, c, g, or t
  misc_feature (578)..(578): n is a, c, g, or t
  misc_feature (581)..(581): n is a, c, g, or t
  misc_feature (583)..(583): n is a, c, g, or t
  misc_feature (639)..(639): n is a, c, g, or t
  misc_feature (690)..(690): n is a, c, g, or t
  misc_feature (738)..(738): n is a, c, g, or t
acaaaagggaaaangtttcctttacccatgatccaggctagctccaagaatcctaaaaacgatgttttaatttggaatctgggatggggggttttgtgggttaggatgtgttctgtcacaagggctactctacttcctttaganacatgagcgaaaatgctttgctcaacaacctagttatgtatgtacaaatggtgatcatggtccttactgataannnnnnttttnngnnatttttgtttcggggnnggtnttggtaagaggtnttggtgtttnagttaggnttntnattttnnttttnnggngtgagaaatggaggtgcagaannggtaggnttnggggngggattncttttttggggtggngggnagatggggaggtgtgagtgattggggatgtctggtttgtgggtcttgactgctattgtggagtgggagancctatttnanagtntttgtgcgatgggggtagaggggagancttggggncngcgcttgggggttttggtggggggatgtgaccacggttctgtgaatccagattttnagttcgcatccattggctganttgttgntntnagngncatcatcagtcgttccaatacccaccttcaaaatcagaatgtttagagtctaaaanacgctgcctttcagcattttttttgtactgaataaacaagcactattcttnagaataaggggtaagggttttactctcagatttgcttctcttatggantgatatcgtacaag

SEQ ID NO: 656326 - DNA, 696 bp, Homo sapiens
catgctcgacttcttcaccatttactccaagggcgggctggtgctctggtgctaccagggacgttagcgatcatgcaccggacccgtgaacgcgttgattcgttccgtgctgctgcaggaacggggaggtaacaactccttcacccatgaggcacgcacactcaagtataaactggacaccccagtttgagctggtgttgggtggttggttttcacgaagatcctgacactgacatatgtagacaaattgatagatgacgtgcatcggctgttgcgggacaagtaccgcacagagtatccaacagcaaagtgctttaagtttattaaatggcactttggatttccaaaaggagcttcctgcggctccttcgtgaagcagaggagagcagtaagatccgtgctcccactaccatgaagaaattgggaagattctgaaaaggccaagaaacctgtgaggtccatgattgcgacacggggggaaaagccaccggaaaaagcacacagaatagcataacataaccgggggccacgaagggacaggttcttgatggtccttgggctaccagcaaaatcagctccctgcagaacaagtcaggtctgccagtgggttcctgagaacggagtagcaactttccaaagagggagctgatccgccggaaagcgcgaggagtccatgcagaagcatgggagggcgag

SEQ ID NO: 656327 - DNA, 1257 bp, Homo sapiens
gtgcgggcgcatgggtgtcggctggagcgagagggtgctgagactccagaattggaggcgtgatgaatgactcatgctggtagttcggtgggggcctgctggcttggagctcgaggaagaagtgggctgggtgccatgggggaaccaagacaggtctctagaacaaatggaactccacgggagagatgtccgaatcgagggaagttaatggtactgtcaagtgacaggacagcttcgcaaaacatagcgtagtgcaagcaggcgcgctggagagcgcacgatgacacagacgtcatcgatcaggcacacaacacacggaacactgacagcagcagcccaggtacaactgcgtcaacgcaagcctcaggaagcaagccgagaggaaggcaacgcatcaggaggggatgccgcgtcaacattgacgactctagggcagatacaagcaagcatgaaagcgtagaggggcagctcgcctagagacagtggtgccaatttggaggagccatgatgggcccctgcttggcgaacaggaaggtggtaaaggcgcccgtggcccgtgaacacaccagtacacgtggcattgaaaggtttcatacgctcaacggcggttcctggcccagcatagttggagctcagggaccctgcgatatgggcgctgccccacggcctgtggaggggaaagataacgcataggagatcgctagatggcctccgtcgaacgtaatccgtgacgtaaccgatgggggcattgagagtcgggtgggaacctggggaatcgagaagggtccccccgtgggcatgggcgaggaaaaccggaacgcggggcctaggcgaaaggaacggcaacccattggcaatggcacttgggtcagttggccaaacggcaacccaaagctaaccaagggcccgggcgggcaggttcccataggccatgtcaaattaagaaaccgaacggctgtccattacccgaagagggaaacacgtcggttccagatgcaacccccagggggggaaggccccgcaaggggaactttgcgcttgaacccaaagtatacacatgggccaccattttccaagactccgattgggcccgcaaacccgggggaaggggcagtccaaagtttcatatacgtatactccaagaaggtacccgagggaactatcgatcaggggggaagtgattggagatgcacccattttgttgttcccgggtatgacgaaacgtcgccatgggaaacttccccacgggcccatgtg

SEQ ID NO: 656328 - DNA, 244 bp, Homo sapiens
  misc_feature (107)..(107): n is a, c, g, or t
  misc_feature (207)..(207): n is a, c, g, or t
actgggagtttcagagagagatgtgtcactcggcacctatgcagccgggctgcggagccacaggaacaggagtttgggaagagcgcttggatgagggactacagcangtggtggcagctccagagacccttagacgcccaggtacagatatgctttgtgaacgaagacccctgtagctctggagttcagcccacgaggtaagcccangacaacaggatgaaggaactttgagaacgaagattcc

SEQ ID NO: 656329 - DNA, 126 bp, Homo sapiens
  misc_feature (64)..(64): n is a, c, g, or t
ccggagatgtaaggcagtaatggcaatgtccatgctacacccaacctcctctcacagcacaggncagagtgaccaagcagtggagtcctagagaaagtgggattcagttcgctggtgtattcctgt

SEQ ID NO: 656330 - DNA, 397 bp, Homo sapiens
  misc_feature (25)..(25): n is a, c, g, or t
  misc_feature (43)..(43): n is a, c, g, or t
  misc_feature (340)..(340): n is a, c, g, or t
tgccacaggcacacaccctcccacntgttaatataaccctgtntgtgtaagttccatacttggtctgagcccactgttgtctctaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagccttctcacgcccagagagagaaaaagttaagctgctgaccctgaaggcaagggagagcaggctgcacagctgtgtgtggaaccaccgggctcaangcatccaaaggcagggcaggacaagtgtgagagagctagtgtaagctgttgatgaga

SEQ ID NO: 656331 - DNA, 259 bp, Homo sapiens
cggcgaggacgttgcggaaatcccgggtgtagactcgaacgcatggtagagcacgcctcgataggtcgaaaaccagaccatgcagatgcatacccttgagcaagatcatgctcgtcgtgcgcaactgctcgcagagctgctggcaccatgccgcagcaacacagacatacaactgcacccgcactggtgttgatcattgatgaaccggcgctgtctggccatgtcctgcgaatggacgcccccagaaggtcgcagccgc

SEQ ID NO: 656332 - DNA, 271 bp, Homo sapiens
agtcccgcttggctgcgtgtgtacggcacttgtacattcaaattcgagtggcgccggcacagcgtgctgaagtcaggtaccggccaagcaagcccacacaaatgcagcaccgactcggcaagacccgtggtctgccgcagtgccaagccaaacaggttcttgagcgtcaaacaaaattggattgctgcatcagagaactgtccatgcgtccgcgttccacttgccgtggcaaaccagcacatacccttgtccagccacaccgtcaaagagc

SEQ ID NO: 656333 - DNA, 931 bp, Homo sapiens
atcgagccctcgccgaggctgcgccatgggcccgcgcgccgccgcgcctgtcacccgggcgcgcgggcgtgagcgtcatggccttggccggggcccctgcgggcggccatgcgcgccggcgctggaggccctgctcggggccggcgcgctgcggtgtcgactcctcgcagatcgtcatcatctccgccgcgcaggacgccagcgcccccgcccggttcccacgcggccccggtggcgccctgccgccggccctgcgaccctgagctgctgctcttcgccacaccggaggggcgcccgggcccacacccagtgcgccggggcccggctcggccggcccggcccggtgacaagcggagggttggacctgggaaaagttgaccatcagtaccctggccgagaagcatgtggggccaaggctcggggcaggaggcctgccaatccaagggaacacagggtgtgaaaactcccccggggggagaagttcagcggctaattagagaacctcaactgaatcttgacgcaaccaaaggcgctttccctggggagctggttgaagccaactcgggctgaacgggtgtcagtccgaaacctgaacgtgggctgccggaagggttgcttgaagggtgcagacaaggggggggcattcctaattgacatttcaacccaaaagcgcttcctttgagggggggcattccagggttcattttggccgaaaggaggtccaaaggaagcccacattccagtgggggtgggggccggccacacacccaacaagggggggcggttccggcgggcaggggccttgagcggggttgaccccaaggggaccttccggaccaggcttgcgcgagacgcgcgagcagccacgttgtgccccaccctggttgagtatctcggtcccccgccaggttggggcctagtcccccgaggg

SEQ ID NO: 656334 - DNA, 260 bp, Homo sapiens
ctcagatcgggaagtaggtcttggtggtgaggaaggacaggaacatcctctccagggcctccgaaccatactcgccagcgtgcgcgccgaaccttaccccaggcggccttgccgtaggtcttgtcggcagcacataattggtagcttcaataaacatctgctgaatttaaccagcctgttgtcttgaaggatgagtcagaagaaccagggacaggcagctcagacccagaaggagctcttgcgtcgcaaaggcagggggg

SEQ ID NO: 656335 - DNA, 116 bp, Homo sapiens
ccaatcatcggccctcggggtatttctgatcgttagtctgcctctaagtctagccaacatgggccgtcccgcaccactcgtcgacctaccagcttgctaggccggagctgatcagt

SEQ ID NO: 656336 - DNA, 218 bp, Homo sapiens
gcctcatgagtgttctacttggctcacaaccagaagccttaagtcttgtgtgtttctgtgtcaggactagacccagatcctggctttgtctgtacagtgtcctgagacttcaggcagaacgagtgggttgtacataatctccgtgccccttcaaattcttttcctgtctgtgacatagtctttgtatggcaactttaataaattatgctaacatcaaa

SEQ ID NO: 656337 - DNA, 441 bp, Homo sapiens
ggcaaatctgtccagctcctgaatggttcatgggagtcagggcactgtgtctctagtcttatctcgtgaaagctcatggccagtggcagcaatgtcatgcctcaagatcttgatgatgttcgtcagagcaggcagagtacgtttatccaaatgggtgatccattcatactcgtctttctttcaacgcgaaggtctagtttcaacgtgggtcaggtagtcatcattctcctcagataagcgcgatactgtggccaatgcacgaatttattcgttgagtcagaagatcagtgagatggcaccatcttgattgcagttgtcttcaatatagcttgtgctcctgtgcaaagtcagagagtttcctgcccgagcctggggtttccaggtccgcagtggacatgctggctcgtcgggagtgtcgtctctggctacttaaggcctcag

SEQ ID NO: 656338 - DNA, 171 bp, Homo sapiens
cgtatcatatggatactcctcttaatactttctcttgcctaattgctgtggatgagcttagtattatagttgaatagaagtgatgaaagcacacacccttgccttgtccttgatctgagaggaaaagtttccagtactttcaccattgcattatgcatgttcaccactggg

SEQ ID NO: 656339 - DNA, 142 bp, Homo sapiens
gatgattcggcaggtgaaatagtaaccactctcttaccggatacccgacttccatggtccaccgtacctgctagtactatatacaagccaagcacctatttctaggggtactgactgagcgtacggcatcagagcgccttaa

SEQ ID NO: 656340 - DNA, 670 bp, Homo sapiens
acgaaggctgggttcgtggacagacgtaggctgtcaggcagtgtacacttcgcctccacttctgttcctccctgccctggtgctgctccaggtcacatactcgtacctgagccggcttcagcctgtccggcagaagtctcccggagccatggactagatactcttatgtgaagtctagcaagctcgtgctcaggtgaaccgaggtgaagagctgggtcctgcagctctggtgggagcctcctcagttcttttcggatgcactccaaccccgcgaaatccggtggaagccgtggtgcagagagccggcttatgtggcctcccaggcttcgtctgaccctgtatgggactggacggaggcaggaccgggttcctggagcctgtgcagacgaggggcaggccaacccgtgactgacaaccctggaaaacaggatagacggggggtgaccgtggacccgtaacccacgagtttagggtaccctgtaggcatctctccaggcctctggcctgtattgccgacaactgagcacaagataagaacgagaacccagagacgcatggcagaaacccagttgatacggtggcaatctggtgaccaagtcacaaccttggtgacatttccggaacccataggcatggacctggattagggcactattcctgcacctcaaag

SEQ ID NO: 656341 - DNA, 317 bp, Homo sapiens
cggtcgcaggggtagggctttactgcataagaacaattctgtatattatcaaacacacagcagttccatttctcatctgaggggggggcatttcctattactgactgtgtctcatcatctctaaagtaaagagagtcaataactcactgaacgtctaagattcttttcagctctgaaattccatgactctaaatgagtagccggtgcttatcgtttatacagtggttttcaacacatcacatcacacacactagcaaaggtcggaggggaaaaaaagcaccttgagaacatcccatcccaactgccaagcgccatcg

SEQ ID NO: 656342 - DNA, 151 bp, Homo sapiens
  misc_feature (90)..(90): n is a, c, g, or t
  misc_feature (98)..(98): n is a, c, g, or t
  misc_feature (144)..(144): n is a, c, g, or t
agcctcaaatgcagtatttttgttgtgttctgttgtttttatagccagggttggggtggtttttgagccatgcgtgggtggggagggagntgtttaanggcactgtggccttggtctaacttttgtgtgaaataataaacaacnttgtctg

SEQ ID NO: 656343 - DNA, 157 bp, Homo sapiens
gcaaatgcctaagactttcccaacagccttagctgccagtgctgggtcactaaccaacaaggttggcacccagctacccctactttgcagggttaagggcccccaaacatagccctcgctcagaggaagttaggggaaccatgagtgttcagcttga

SEQ ID NO: 656344 - DNA, 696 bp, Homo sapiens
tgtgtgtgtgtgtgtgtgtatatatatgtatgtatatatgtattatgagagacagagagagagagggagagagagacaaatatacagacatatatatacacacacacacacacacacatacagagagatatataaaatagatataacaatatacaggatactattaaacgattatattataatactatagtcgtctcatgaaacaagtggtagtcgtaattataagccaaagtgtcagttagggcagtgtatgtccaatcttctattccgtgtgtacagggcaaggagcttccagttctataaacgttggtatatcgtgttattctagcagggtagcacagtgtggtgttctcagtagagtgtagtagcgtgggagcagtagactcgctctcatgtcgtgttctgcacccgtggaggggcgagagtagtcgatgaaggtccctcccctcgccgtggcgtgtgcgtaggacagcacgaggtgcatacgcaggacaataatcgtgcacacgcaagaacagtgccgagtacgtagcgtacgccattatgatacacccaaccgaggctaagctgaatgtcatcattacacacttcaaacgaaggcccctctactggcggctgaggagcatcattcagcagtggtcaggagcgacttgaacttcttatacagactaacaacattccgaaacagaactagac

SEQ ID NO: 656345 - DNA, 158 bp, Homo sapiens
attcaatctgaaaagtcttcactgtgaagatcatcaatatttctcaacatagttcgaagactcctgagctttgggaacggtctgggttctcgctgacagctaaaaacaaaataaggccattattttgccataattgtacgacctgtagcagtgtgctt

SEQ ID NO: 656346 - DNA, 908 bp, Homo sapiens
  misc_feature (84)..(84): n is a, c, g, or t
  misc_feature (155)..(155): n is a, c, g, or t
  misc_feature (164)..(164): n is a, c, g, or t
  misc_feature (207)..(208): n is a, c, g, or t
  misc_feature (210)..(211): n is a, c, g, or t
  misc_feature (214)..(214): n is a, c, g, or t
  misc_feature (218)..(218): n is a, c, g, or t
  misc_feature (222)..(223): n is a, c, g, or t
  misc_feature (225)..(226): n is a, c, g, or t
  misc_feature (238)..(238): n is a, c, g, or t
  misc_feature (245)..(245): n is a, c, g, or t
  misc_feature (257)..(257): n is a, c, g, or t
  misc_feature (264)..(264): n is a, c, g, or t
  misc_feature (268)..(268): n is a, c, g, or t
  misc_feature (278)..(278): n is a, c, g, or t
  misc_feature (283)..(283): n is a, c, g, or t
  misc_feature (311)..(311): n is a, c, g, or t
  misc_feature (319)..(319): n is a, c, g, or t
  misc_feature (322)..(322): n is a, c, g, or t
  misc_feature (361)..(361): n is a, c, g, or t
  misc_feature (364)..(364): n is a, c, g, or t
  misc_feature (373)..(373): n is a, c, g, or t
  misc_feature (382)..(382): n is a, c, g, or t
  misc_feature (397)..(397): n is a, c, g, or t
  misc_feature (412)..(412): n is a, c, g, or t
  misc_feature (424)..(424): n is a, c, g, or t
  misc_feature (426)..(427): n is a, c, g, or t
  misc_feature (430)..(430): n is a, c, g, or t
  misc_feature (449)..(449): n is a, c, g, or t
  misc_feature (451)..(451): n is a, c, g, or t
  misc_feature (459)..(459): n is a, c, g, or t
  misc_feature (461)..(461): n is a, c, g, or t
  misc_feature (464)..(464): n is a, c, g, or t
  misc_feature (467)..(467): n is a, c, g, or t
  misc_feature (475)..(475): n is a, c, g, or t
  misc_feature (493)..(493): n is a, c, g, or t
  misc_feature (504)..(504): n is a, c, g, or t
  misc_feature (507)..(507): n is a, c, g, or t
  misc_feature (586)..(586): n is a, c, g, or t
  misc_feature (617)..(617): n is a, c, g, or t
  misc_feature (643)..(643): n is a, c, g, or t
  misc_feature (645)..(645): n is a, c, g, or t
  misc_feature (792)..(792): n is a, c, g, or t
  misc_feature (800)..(800): n is a, c, g, or t
  misc_feature (895)..(895): n is a, c, g, or t
tcctttcttctgtagctcgcgttgaagccgcacgtccggccccgatcccggcaccatgagcttcggctcggagcactacctgtnctcctcctcctcctaccgcaaggtgttcggggatggctctcgcctgtacgcccgcctctctggggccggcngcgcgggcngcttccgctcgcagtcgctgtcccgcagcaatgtggcctcctnngnngcntgcncctnngnntcgtagctcggnctcggcntggactatagcnggcagcnggcntccgaagggntgganctgaacaaggcggcggcgcgcaccaacnagtacaanatnatccgcaccaacgagaaggagcagctgcagggcctcaangancgcttcgcngtgttcatngagaaggtgcatcanctggagaagcagaancgcgcgttggangnnganctggccgcactgcgaaaancnaagctgancngtngcncgtaggcnagctcttccagcgcgaancgcgaactgcngcncagtggaggaggccagctcggctcgctcgcaggcactgctggagcgcgacgggctggcggaggaggtgcagcggctgcnggcgcgctgcgaggaggagagccgcggacgnaaggcgccgagcgcgccctgaaggcnanagcgcgacgtggacggcgcacgctggcccgcctggacctggagaagaaggtggagtcgctgctggacgagctggccttcgtacgccaggtgcacgacgaggaggtagccgagctgctggccacgctgcagggtgcgtcgcaggccgnggccgagngtggacgtgactgtggctaaaccagacctgacctcggctctgagggagatccgcgcccagtatgagtccctggccgctaaaaacctgcagtccgnggaagaatggtaa

SEQ ID NO: 656347 - DNA, 439 bp, Homo sapiens
ccagatcgccctctggtcctgactgtggaacacaaggaaaaagagcttattgtgaagcaaggatcaaaaggaacacctcagtctttgggactgaacctcgtcaaaatacagtgtcataatgaagcagtttatcaatatcatgtgactttcagccccaatgtggagtgcaaaagcatgaggttcggcatgttgaaggaccatcaagctgtcaccggcaacgtcactgcgtttgatggatctattctctatctgcctgttaagcttcaacaagttcttgagttaaaaagtcaaaggaaaacaagacagtgctgaaatcagcattaagattcagatgacaaagatcctggagccctgctcctggacctgtgcattcccttctacaatgttggttttcccgtcgggtaatgaaactttttagatatgaagcttgtgggggaga

SEQ ID NO: 656348 - DNA, 105 bp, Homo sapiens
ctgtttgcttgtcattagagaagagcaagacgagccagggaggtctgttggaaagttgaactgtcccagtctgtttatgggaagccgctctgcaaggaacccacg

SEQ ID NO: 656349 - DNA, 218 bp, Homo sapiens
catttagagataatgaactgttgtcacagaaatctcataaatgcttaggttttcaggaggttttagtcctggaaggtagataatttagaagaggaatttccgttattctgatgttggagcggccgcatattttttttttttttgactgttaaataaattatttttattttgcttcagaaatgtaagaatcattcaaatgtaataaatacatgatgaat

SEQ ID NO: 656350 - DNA, 119 bp, Homo sapiens
accctctttcatctactcctctgggtttgtatctgccagtgaaagcatccagagagagactcaacctcgacttaaacagtgactttttcaatatagaaaattaatctagaatctagttc

SEQ ID NO: 656351 - DNA, 147 bp, Homo sapiens
gattagaggatcccggcacattgacccagagtccagtgccctacggacgctttgtgcatccaggaatttgagatcctaagaaaaccaaagcagcaactgggtttctggaaaggactcaggaggcagggagacctcgtggagctacct

SEQ ID NO: 656352 - DNA, 144 bp, Homo sapiens
gcgcaggatcaaggtgaaaaggagaaccccatgcgtgaacttcgcatccgcatactcacgtctcaacatcatgtgttggggagagtgtgagacagactgacgcgagcagccaaggtgcttgagcagctcacaggtgcagacccc

SEQ ID NO: 656353 - DNA, 133 bp, Homo sapiens
gtctgtatccagcaaaattatcttttttaaagtgagggagaaatacactcataagtgggagttgaacattgagaacacatggacacagagaggggtacagcacacactggggcctcttggggggtccaggtga

SEQ ID NO: 656354 - DNA, 160 bp, Homo sapiens
atagctttagatgattctcagctatgcctcgcttaacctcgcattaccccccactattaacctactgtgagaactctctatagctagtaaccacgtactcctaatcaacatatcactctccgtacttacaggactccacatacctattcacatgccctat

SEQ ID NO: 656355 - DNA, 493 bp, Homo sapiens
cagcaccttgggaggccaaggtgggtggatcatgaggtcaggagttcaagaccagcctgaccaacatagtgaaaccccatctctactaaaaatacaaaaaattagctgggtgtggtggtgggcgcctgtaatcccagctactcaggaggctgaagcaggataattgcttgaacccgggaggcgaaggttgcagtgagccgagatcgtgccactgcactccagcctgggtgacagagcaagactccatctcaaaaaataaaaataaataaaaataaaataaaataaatgctgtaagagataataaatatggtattgatgaatccatgaactattcaggaaaaatatgaacattaattgaaacagaccagtgatccctgaacctgctgcccaacgcagaagtctccaagctacataagatggttgtactttctactctcgaacattgacagaaatggggagaaacagcagcacctactaatctagtcagataata

SEQ ID NO: 656356 - DNA, 1081 bp, Homo sapiens
gatggggtgtagatagggtgctcgtgagaatggctcacagtggagatgcctatggacctggtcgtctgactgcacaggcattgtgctcgaacgagtaataaccatgctctacctgaccacgaggggagatgaaatgctgcggcctggacactagtatacatcatctcaccctagattcacgtgtcatgttgtgtgcttgtccctccctgtttgaaaatctacatctgaccagtgcctgttgccgaactctcttgaccatcatcctcctagcgcactgtggcacctcctcaaggttctcttgaggtctggtgttaactacagggccactccgctacgttgatgggttccacgtggagacacatagagagtgatgcagatgacatcacatgcgactctccctggcttccctaaactttaccaatcttgtgcaccataggtgcaagtcacaaggactaaacagtatctgtccctctggcagtcgtgaaaggtagtgtctcttggggacagtctggcacgcttcatctggtagtacgtactgaaactcataacttgtggagtttgcgcgctaggatggggttagttcaaccgtggttacaacttggaagacgcatcaactactcgttcgccagtgttgactatagcgtgtttcgtccttgatatttccagaacgtacgcgcacgataatcctcgaagattgtgctagaggcacaattgtacaagaacccgccctcgaacattaattaatcatatgtaaattcagcatgcttatgaggcgacgagagcgttgtcaactacccattccttggtggccccgtgtatgtgctccttcagtacactacacctgtatctctacagatgtattcaccactctggtggttcatgttgttcctctacatacgtcgctagaaaaattcccctgtgtcactaggattttcaacatagttccgccggccgcacccgcccatgtacatgctctttggaaaggaagtagagggacaggccaagggtgtggggctcaattttgaaaagcgcaattcaggcaaagcggtcctagagaactgggaggggctcggagatccca

SEQ ID NO: 656357 - DNA, 126 bp, Homo sapiens
gcggccgcctactactactactgctcgaattcaagcttctaacgatgtacggggacatgactgctttactgtatttttaaggtcaatatactgtacatttgataataaaataatattctcccaaaa

SEQ ID NO: 656358 - DNA, 887 bp, Homo sapiens
gcccggaaggaaacgtgcgaggcagaaaggtgaccgggaccgagcatgcagatctgctcggtagaacctggtgcaccaccaccatgttggtgcaaggttggtgtgtctccggaacttaccttctagggtttccacccagcgttttcaccataggcctcccctgtgggtgaagaattcgcatcaggaatcaactcagtggcttgtttaacaaccctaagcagggaattatgcccaacctaaatacaagaatgggggattccggctgtggagaactgggccagagatatctcaagagaggcatgcattgggaaccatcgatggaataggcaattatttaaacaactggatccagacttgggcacaggatggttggttgctggaggggcgtgatggtaggtctgtggaggcatgggtgctagctagtggattgtggggaccttgtcttaatgagaatgggaggctattgaaataggcgtgtaaattgggcctcagtatggtcgaggatgaggaaattcattccagctaatattgtaactttagcagggagttatgggtgtaagcaggtttgtctgccattaggaattcacgaagaaggcctgttctcaatgaacttcatgatgaagaggcctctggggtgacaattggggtgaccgtggcaagcaggggggagctcgcaatggctgtacgatcaataccatattgacagagccaggcaaaggatctgtggttgcacatctggtgtgaggggcacgggcggtctctgcaaataagggccctcaaagaacggtgggaccagggctgggggcccccagggccggtgcgcaggcacgtccgactgggcccgagggcgcccggcccagattccccaccggggcccccggagagaa

SEQ ID NO: 656359 - DNA, 845 bp, Homo sapiens
  misc_feature (93)..(93): n is a, c, g, or t
  misc_feature (97)..(97): n is a, c, g, or t
  misc_feature (105)..(106): n is a, c, g, or t
  misc_feature (113)..(113): n is a, c, g, or t
  misc_feature (123)..(124): n is a, c, g, or t
  misc_feature (137)..(137): n is a, c, g, or t
  misc_feature (155)..(155): n is a, c, g, or t
  misc_feature (157)..(157): n is a, c, g, or t
  misc_feature (217)..(217): n is a, c, g, or t
  misc_feature (227)..(227): n is a, c, g, or t
  misc_feature (229)..(229): n is a, c, g, or t
  misc_feature (231)..(231): n is a, c, g, or t
  misc_feature (234)..(234): n is a, c, g, or t
  misc_feature (268)..(268): n is a, c, g, or t
  misc_feature (271)..(271): n is a, c, g, or t
  misc_feature (275)..(275): n is a, c, g, or t
  misc_feature (282)..(282): n is a, c, g, or t
  misc_feature (294)..(294): n is a, c, g, or t
  misc_feature (299)..(299): n is a, c, g, or t
  misc_feature (301)..(301): n is a, c, g, or t
  misc_feature (303)..(303): n is a, c, g, or t
  misc_feature (312)..(312): n is a, c, g, or t
  misc_feature (314)..(314): n is a, c, g, or t
  misc_feature (326)..(326): n is a, c, g, or t
  misc_feature (330)..(330): n is a, c, g, or t
  misc_feature (333)..(333): n is a, c, g, or t
  misc_feature (335)..(336): n is a, c, g, or t
  misc_feature (342)..(342): n is a, c, g, or t
  misc_feature (344)..(344): n is a, c, g, or t
  misc_feature (348)..(352): n is a, c, g, or t
  misc_feature (359)..(359): n is a, c, g, or t
  misc_feature (367)..(367): n is a, c, g, or t
  misc_feature (373)..(373): n is a, c, g, or t
  misc_feature (398)..(398): n is a, c, g, or t
  misc_feature (408)..(408): n is a, c, g, or t
  misc_feature (413)..(413): n is a, c, g, or t
  misc_feature (438)..(438): n is a, c, g, or t
  misc_feature (459)..(459): n is a, c, g, or t
  misc_feature (473)..(473): n is a, c, g, or t
  misc_feature (484)..(484): n is a, c, g, or t
  misc_feature (498)..(499): n is a, c, g, or t
  misc_feature (519)..(519): n is a, c, g, or t
  misc_feature (695)..(695): n is a, c, g, or t
  misc_feature (702)..(702): n is a, c, g, or t
  misc_feature (708)..(708): n is a, c, g, or t
  misc_feature (739)..(739): n is a, c, g, or t
  misc_feature (809)..(809): n is a, c, g, or t
atttattggtcaggttagccaccactcatgcttttcctgtaataaggatcctttataaaggcatgatggtgttcactattgcagatgctttcngaanaaccctgnngaaaaanaaagcattgnncctcacatcgaanctcctttgttgaaatgancnggtttggattttgtggattccaggtctggagccaagaccctagtccaaagatcccctctncccttctcangnanggngcttcaaagcatacacagtatcaggcatgtcatnccntctnggcagancctatacttggnctatntntnctccaacantncttgcccctgtntgcnctntnngttttntnccannnnngcccaangggcaggngggttnggccccagggaacattaccttttgngatgggaagngttangtgctccccagccaaactataaagnaaaagcgaccttcactaatgnggatatagctcagngatgtgaaagnggagggttgtgggnncagcacaggcaagatttggntgcctggcctgggcttcacggaccccagccagagctggtactttttaactatggccttaggacaaaccaggtgaaacagattaaccacatcctccttctttgggctagcaagtccagggctgcctggagtctgtctctaccatcaggatatagaatcttcctgcttggataaaagnagagganaaactntgtttctcatactttaaaaaccatgtggccnctacctttgtggataaaaacccaggtaggatgctgtttggaatgcagaaagtgctgggcaagaatggaantactggggctgctttctcaactcagccaatttgagg

SEQ ID NO: 656360 - DNA, 1017 bp, Homo sapiens
gcaagatggggctgatgtacccctacatcttccatgtcctgaggatgggtgaaatcaaaatgctgtttctattgaagatgaaatccaacaaggacctgcctccggactcgactcatgctctataggcccagctctcgtcagtgatgtgctacgtgagtgcctgtgttagtttgggagaaagcagaaacgaaaactgagagactggctgttagacaagaacagtacttctcatcagatatattctcatcagtgatcattcaaggacgtagatgggcagattcaactgtaggaacagtctgcctcaaaccccggagactggttgaatagctcttgtcttcagggacggtggacctggcccatagctggaagtaggctgtggtagggtacaggctggtcatgatggaccatagaaccgagaggatgtagggcctgcctgggactgaagtgaggttctggacacacccaaggaatgcataagaccctgtcaacgtgcccactcatacatcagtgagtgctctgctagacgttcttacaggtagttgtgtgcattatgcgacaggcgtagccattgacatccctttcgggtgtgcgggagactcatcagtgccctattcacttgggcatcactggcgatgacccaccataaccttctaccgatgccctgagtcaagaatccaggataactactaggacagagtgatcttagaaatccctcgaggcaatttcaggctattagctctacttgatgagtggcgtagaccatggccataggtcgctaactgactgcatggcggtacgacccttcccttgggaatcactgttgccatggggttgatcagaatggaaaggttcggcccaggttcaaaaagcaacagaagcacgccgggagaaggaaccaccgcaggaccccaggcagggggccagctggacaaatgcgccgcggagaaagggccaaagtacgccggtgcgtttatctaagaagagagacttacacgaataccgcgcccaagaggtggc

SEQ ID NO: 656361 - DNA, 352 bp, Homo sapiens
ggtcatccacaacttcccacagcagcccagtgttcaactgaccacagcactgtcccctggcagtaccacagaactaatcctttggtcaacgaatctacaaccttccagagcagcccaggctccactcacacaaaactcttccctgacagcaccacaagctcaggcatcgttgaggcatctacactgcgtccacagcatgcactggctcaccacgcacaacactgtcccctgccagctccacaagccctggacttcagggagaatctaccgacttccagacccacccagcctcaactcacacgatgccttcacccccaggcagcaatgtgctattgaaacttctaaaactagg

SEQ ID NO: 656362 - DNA, 1262 bp, Homo sapiens
gtcaactgtgcaatacttcctttcggtattagttgctgctctccttatcttgcttatgcgggggcttcctcatcttgtaatcgcgtgctatcaatgtctcgcgcgccctgccatgttgtctcttaattgggttaaggatgcaagttaagctactacttggattttgctcagtgtaagcggctaataggtattttttggacttctttcatggccataacccgcttaccaacttcgtttcttcacgcgtaccaggccattctaggctcttgggaaactgtggcgactttcgaatcttaacaactatcattccaacaatgcgtctcttcctgccatttctgctctaagcctcttcttggttagttcgatcacgacagtccagttacaagcactatcctcagaccggtttgtaacggcaagtgtagccatggaaatcttccttaaggaacccaatatatccctgtgaccaaggggggcactaaatcacttggtttccaccgactgttactactcgcagacgggggagtcaacaaagtcttggccatgcacgagagtcgatgcacaacacgttgggtggcaatgcaaccaccgaattcgcgtacttaagcaccggagaagcatagggactccacaccgtggtcccaaaggtcctcgttggttcctagcctagaattaaaggcatgtgttcctttagctctccgttcttgctctcatactgttttgcatctatatcagtctgcgataggaagagtattcagggatatatgaactagttttacatggatgcctccatttcaacgtgtctaaacgtccctcattgttcccatagtctactctgtggactcccgctctcgatgggatgtcaagaacttctcataagttcatgaggaacagcatgaagggcctatttagccctcaattgaccttttgtgatgggacgttgcaactcatgactatcctgactattggtgaagaataggactttgcttaatgcttgcgtccccgcgatagctcgtgtctgcgtagggtctacaatcatgtacgtctagaatcactacacaattcctcttagtcttcactccaagctccagagccagttggtacaaatgctttatagaaagctaaatacataatacacacaatgagatgaagacaatatagaaggtctggatagtcatcattatcccgttcattggccggttgaggcaggtcagtggctgagcccagttaaagccaacccgcagaaatcactcagcgacttaaga

SEQ ID NO: 656363 - DNA, 145 bp, Homo sapiens
tgcagtcagtttgaaacaccgatgagccagccctggagcctcaggcctctggagtcacggcggtccctcgagacccttggattgcgggactccttcagtgcttcacagagcccagggcatgagcttcgcaccctgcgtgctgtcc

SEQ ID NO: 656364 - DNA, 452 bp, Homo sapiens
  misc_feature (384)..(384): n is a, c, g, or t
  misc_feature (421)..(421): n is a, c, g, or t
cacgagggtgagaatggcgcggccgacggagttcatcctctattggtggagcggttcagcccggtgtcgttcgaccgggacgcgaccctgagtgacgcagaggtcgacgttctgctcgacgccgcccgtctcacaccatcggcgggcaactcccagccgtggatgttcatcgtggggcgccgtgacgaccccgtccactctcggatcgtgaatcacctggcacccagctcagcgcgctgggcgcccgatgccgcactgctgatcgtgaacctggctcacgtcctcgtcgaagacacggactgggagttctccgaattcgcgcgatacgacctcggacaggcggtggcccacatgacgattcaagggctggtcatgggactcggngcacatcagttccgcgcgttcgatcgtgacggtgtcncgcgcgagttcggggtcccgggcgcatggga

SEQ ID NO: 656365 - DNA, 724 bp, Homo sapiens
  misc_feature (115)..(115): n is a, c, g, or t
  misc_feature (136)..(136): n is a, c, g, or t
  misc_feature (142)..(142): n is a, c, g, or t
  misc_feature (188)..(188): n is a, c, g, or t
  misc_feature (203)..(203): n is a, c, g, or t
  misc_feature (205)..(205): n is a, c, g, or t
  misc_feature (212)..(213): n is a, c, g, or t
  misc_feature (218)..(218): n is a, c, g, or t
  misc_feature (228)..(228): n is a, c, g, or t
  misc_feature (257)..(257): n is a, c, g, or t
  misc_feature (276)..(276): n is a, c, g, or t
  misc_feature (303)..(303): n is a, c, g, or t
  misc_feature (314)..(314): n is a, c, g, or t
  misc_feature (323)..(323): n is a, c, g, or t
  misc_feature (342)..(342): n is a, c, g, or t
  misc_feature (344)..(344): n is a, c, g, or t
  misc_feature (349)..(349): n is a, c, g, or t
  misc_feature (353)..(353): n is a, c, g, or t
  misc_feature (357)..(357): n is a, c, g, or t
  misc_feature (363)..(363): n is a, c, g, or t
  misc_feature (365)..(367): n is a, c, g, or t
  misc_feature (399)..(399): n is a, c, g, or t
  misc_feature (404)..(406): n is a, c, g, or t
  misc_feature (410)..(410): n is a, c, g, or t
  misc_feature (412)..(412): n is a, c, g, or t
  misc_feature (416)..(416): n is a, c, g, or t
  misc_feature (418)..(418): n is a, c, g, or t
  misc_feature (424)..(424): n is a, c, g, or t
  misc_feature (435)..(435): n is a, c, g, or t
  misc_feature (440)..(440): n is a, c, g, or t
  misc_feature (442)..(444): n is a, c, g, or t
  misc_feature (447)..(447): n is a, c, g, or t
  misc_feature (462)..(462): n is a, c, g, or t
  misc_feature (475)..(475): n is a, c, g, or t
  misc_feature (477)..(477): n is a, c, g, or t
  misc_feature (483)..(484): n is a, c, g, or t
  misc_feature (487)..(487): n is a, c, g, or t
  misc_feature (490)..(491): n is a, c, g, or t
  misc_feature (503)..(503): n is a, c, g, or t
  misc_feature (506)..(506): n is a, c, g, or t
  misc_feature (515)..(515): n is a, c, g, or t
  misc_feature (551)..(551): n is a, c, g, or t
  misc_feature (581)..(581): n is a, c, g, or t
  misc_feature (601)..(601): n is a, c, g, or t
  misc_feature (626)..(626): n is a, c, g, or t
  misc_feature (653)..(653): n is a, c, g, or t
  misc_feature (713)..(713): n is a, c, g, or t
tgcaggaacccggcgatatggctgccgctgtgccccgcgccgcatttctctccccgctgcttccccttctcctgggcttcctgctcctctccgctccgcatggcggcagcggccntgcacaccaagggcgcccttncccctnggatacggtcactttctacaaggtcattcccaaaagcaagttcgtnttggtgaagttcgananccagtanncttanggtgagaagnaggatgagttcaagcgtcttgctgaaaantcggcttccagcgatgatntcttggtggcagaggtggggatctcanattatggtganaagctgaanatggagctgagtgagaaananaagcngganaaanagagcnannnagtcttctatctcttccgggatggggactttnagaannnagtncnaaanantggggnagttaaggttngagcnannnagngctggctgaaggggnaaggggtctaccnangtatgnntgnttnnctgcctgtatangangccctggcnggggagttaataagggaatatggtgtggaggaccgnaaggaaatattgaagaaggggcaagataanctctcaagtgtgaaggagantcagaagaagtgggccgagcaatanctgaagatcatggggaagatcttagancaaggggaggacttcccagcatcagagatgacacggatcgccaggctgattgagaagaanaagatgagtga

SEQ ID NO: 656366 - DNA, 288 bp, Homo sapiens
atgggaagtggtatagaatatacatcacaggtagaaaatgctaggaacccacaggttaggattcagattttttttggggatattagaaatacttaccgggttgcgcatcacaatcccaaaactcaaatccaaaatgctccaatgagcaagcatttcctttgagcaccatgtcggagctcaaaaaatttcagatcatgggacccatggcagcatttcagcatctcagttttcaggcacggttcactctcactcaggttgccagccgagggtaacgtagaatatataaaa

SEQ ID NO: 656367 - DNA, 862 bp, Homo sapiens
gccgggcggcaacaacacaggttgggtgcggccagggcttgtacggtgcggcgaccagtctgcacgagggagctgtgcctgggatcgtgggtggctgtgcagtggctggggcgatcggcttggcatgcatgctgttcagtgtgtgaccctgagttggctggtatctggtgcccagatgcccctgcagtctccactgtgtcccctgcggggacggtggacaggacgggcaagcgtgctgcagacgctgtctgtgggcaggcctggcacggcgtgcgatgggtccggtgggtgtgcccaggtgcgaacgcggcagtgctggcacggggatggggacgttggcacgtggggctgtggctggctgccgggcgcggtctatgtggctgccgctgtgacgtcacgtgcgcgaaggcataggtctcgtggccgaagcgtatcaggcatctcaatgctggcaccgcgtgtactgcagagtgccggcagcagggactccgcaggccaatcgacgctcggccgctgttcctccgacgacaacaggagggagttaccttgggaacaatccacgcggtaccttcgagccttccattagtagcatccaacgtggacgcaggcgtgacagtccggcttggacacgcgttggtgggagcccgacgagtagcaggagaatcgcgcctgcatatcatccaacgctggcccccgaaaaaccaatgacttggcccaacaaaagacatagataaccaaggcggccaagcaggaccacttagctagaaacaagcagggacaacaaacgggcatagatcgagtagtcaaaccaccttgacccagcgtgtacccccctggcacaacacagacccgacacagtagc

SEQ ID NO: 656368 - DNA, 305 bp, Homo sapiens
ggaaataatacgcactaccgaaaaaattccaaccaggtcccgaggcgttttggaattcctccccactgtaggctgagtgacctgaaggttgggccgactggcggagtcccaaagcttccgcatttccttagtgtcaggatctacttcaataatctcctggatccaaggctgagacctccggaacataattgtctctcctttctcttctctcctcctggaagttggatggagaatacttcttactgggcctctctgtattcgcttcatcagatgcgtgacataacctgctatcttgttgggagctt

SEQ ID NO: 656369 - DNA, 534 bp, Homo sapiens
  misc_feature (6)..(6): n is a, c, g, or t
  misc_feature (36)..(37): n is a, c, g, or t
  misc_feature (107)..(107): n is a, c, g, or t
gccggnggaggcatggccattcggctcatgcgctcnnctcccggagcgttctctgctcgcttcctgactactgggattacggcgcccaccacctgcccgctaatgtntcagtagagatgggtttcacctgttggcctgctggtctctaactcctaacctcaagtgatctgcccacatcggcctccaaaagttctgggattatagtgtgagccatgcgcccgcctggctcctaatcttgatccaattattgttacatccgatgtgatgaatcaaaatctcgagatgggggtccgcaatctgaatttcagtatgccagggcttttctgtatgccaaagtgggtttgaaatagttaatttttcttctagtctgaaatgtatcgggaaaatttggaaatcctgaaggctggaaattgaaataagtttttctaggatttgtgtctcttgctattggaaaactgatggtgaccaattcatgtttacaaataagatcctcatagatctcggtaaattataatttgctacagttttatggtc

SEQ ID NO: 656370 - DNA, 925 bp, Homo sapiens
  misc_feature (11)..(11): n is a, c, g, or t
  misc_feature (75)..(75): n is a, c, g, or t
  misc_feature (282)..(282): n is a, c, g, or t
  misc_feature (334)..(335): n is a, c, g, or t
  misc_feature (343)..(343): n is a, c, g, or t
  misc_feature (358)..(358): n is a, c, g, or t
  misc_feature (362)..(362): n is a, c, g, or t
  misc_feature (372)..(372): n is a, c, g, or t
  misc_feature (402)..(402): n is a, c, g, or t
  misc_feature (408)..(408): n is a, c, g, or t
  misc_feature (448)..(448): n is a, c, g, or t
  misc_feature (485)..(485): n is a, c, g, or t
  misc_feature (495)..(495): n is a, c, g, or t
  misc_feature (498)..(498): n is a, c, g, or t
ggttctagtanttagggtatgaagacatggggtcctctcctgacttccctcaaatatatggtaaacgtaagaccnacacagacgttggccagttaaacatttctgtttataaagtcagaataatacctgttgatcactgaaaggcctgcatgtattgtactctgaattttacagtgaatgagagaatgtaccctaattgttcaacagggctcaaaaggaaagattccattttgatgggtcacattctaaagaggggcagtgtgataggaatgagatggcccnttagcccctaagttccccgccccaggtttttccacgtggccccccccccccnntttttttnttaaacggagtctcncttnccaggctggngtgcagtggcccgccctccgcccactgccncctccnccccccgggttaggcgagtctcctgcctcggctgcctggngggctggggtggcgggcgcccgccgccatgcccggcngggttttgtnttntcagtagagatgggtttcacctgttggcctgctggtctctaactcctaacctcaagtgatctgcccacatcggcctccaaaagttctgggattatagtgtgagccatgcgcccgcctggctcctaatcttgatccaattattgttacatccgatgtgatgaatcaaaatctcgagatgggggtccgcaatctgaatttcagtatgccagggcttttctgtatgccaaagtgggtttgaaatagttaatttttcttctagtctgaaatgtatcgggaaaatttggaaatcctgaaggctggaaattgaaataagtttttctaggatttgtgtctcttgctattggaaaactgatggtgaccaattcatgtttacaaataagatcctcatagatctcggtaaattataatttgctacagttttatggtc

SEQ ID NO: 656371 - DNA, 445 bp, Homo sapiens
gggcgggggggggcgattcacaggctccgggtttgagacgtggggcgcggggggggaataccaattttctgcgaggaggacggctgtggccgtaggggcgattgggggggccctgaaggacgagggtgggtcaaaaaagggggggggggccggtgggggatttgcgggggatggtgggcccgggggtcgggggggactttctgggaagggagccagggtttcctggtcgaatggcacctctccgggggcggggactcggcatacaggggcgggccctatgcgcccttggcgtttttgccgcagcacaatgggggtcactcccgcccccccatttacaacataaaaccctcattcccccgggaaaaccccccccagggtcatacccctattcccccattttcctcctatccctcaaccccgacatcattaccggggtttcctttta

SEQ ID NO: 656372 - DNA, 1894 bp, Homo sapiens
  misc_feature (247)..(247): n is a, c, g, or t
  misc_feature (1396)..(1396): n is a, c, g, or t
  misc_feature (1894)..(1894): n is a, c, g, or t
ggaaaaagtaggacggcgatgtcgtgtgcagagaatgtgatagttggagctcgactatcatcgatggatggtgctcgttcgagttttgtgtctggcaggaagagatggaacgatgcatgtggatcaccagggtaaccttgcgtccctgggcgcaagtcagatgtgtatgcgagagtaagcattagctcttcgaagtaacgagcaaggcatgagtgcactagaaagttgcacgcttacctgtgaaagncctttgtggaaatgcgcacatctacgcagtcgtgcgcagatggacataagacgaaggcgaaggcgaacctgctcgtgagggggtagcgcttggttgagaacacatgagtactcaaccagttcagaaagcccagccggtggcattagaagggcttcattcataactccgtcggccccgtactgtaacgactgggcgaggaaagccaaacgcggcgtcttaccacaaattgcttcttcgttggacactaactcggaggtaggtgtttacccggtgtcaattgagattacccttcagaggtcaataatgtgctaggttcagagcagtttctccatcacactaacccggattctttgtgagctcagattgggaaccgtgccgattataaaacttttgtggactcgaaatgtcactagcatgctgcaagcctacattcgatttccatttattcaaccttgattgtaattctcgcagcgcgcattgtcttggcgtggaaacaagcgacaccaaccaatcttaaaaaattaacccacagggctattagaccatttcggagtttcaggacaagaaattggcgggttagcgcaacttagcttagaaattcggttattattggccctagacacatttgtttaggggcacttcaagtgcctcccaatgtcaacgacaaggggaacccccccggacacattttgttttgacgtgcccgcgatgagaacacgttgacccactaatcacaaatgctgtttataccccattggacgggttaagacgttggcgggcaatgtgtaagcagacgttactacgtgcgctgtgaacattcttttccacaagtgggtcacaatggggcgccacaagtgtatgtaccgagttttggaactcttcccaaaacaaggggcctatcgagtgcagcctgggatgtgtgccccatcctgctttgttgacaccttcccggtagaggcgttgagctatcatgacgtcacgtggccgagcccagtgggtaagcaacatcccattttgaaagcggtccggtgccaggggaatacaccatgggtgttgtgagccccgtatttgaaagtgccaagatgattgggcaaaattgataaagaaagccatttgtagcagagtggggaacagcaatgtgaggccgangttgtgtttcccacggtcgccgatacctccacgcgcgagtaggtgttgtgcaacgacaagcctttgtgctaacaatacacacgagcctgcgtacaggggaaatgtgttccgagcacacatgagtgttgtacgtcgacacacactcggttggagcgccacggcgtgttgttttcctcctataacacagaagcagagctctacatccccatgggcgcagaagcaagaagaagcacgaacacagcaacaaagaacataagacagaacgaaagaagcgaacaccacaagcacgacaacaccacaacaagtagcgcggcgcaaggacacaaagactgccagagagacgagcacagaacgcacacgacgtcttgagaacgctctaacgagtcacgaaaaaaaaagcacgcgagcgcggagacgatcagcaggaagcaagagagacgagaacatgaaagaccaacgcatagagcatagagcggcagagcacagcacacgcctagn

SEQ ID NO: 656373 - DNA, 1221 bp, Homo sapiens
  misc_feature (590)..(590): n is a, c, g, or t
ggtggtgcttctctccgcaggcgcccccattgggctccctctaggggggtccccttttttcttctgccgccagccccccctggcgtgggttggtgaggcaccgcccttgtgcttccatcgggaggaattgtgtcctcgtttgcgagaatagcggctgatggtgggtgccccacctggctggaccctcggcggatgtgttgctctcccccctcctccactttattgttgcaccagcgtcagccgcttccgctggcggtagaaacaaattgtggttgtggtgtcccctcagcggggagtaggagtcttcttcgctcgtttggggccaacttctgctgcggctgtggtgaaattgtatggggtgagacgacgacacccccccccttctcacaggcccctctccatctcaccaccatctttgttgagacctcatacctcctcataatgtgtgacgactcatgacctctctataccccccctctctggccctctattagagagtcacacctctcgtctccacagcagagagagagccctataatgtctctcaccagcgtgttcttccacacacacataagtcgcccccgcgtgtnccgcacacgcacacattttgtgtctttgtatataggcctcgcacccccacgcggctttatcacagcgagcacttgttcgtgtgcccacacatatgtgtgtgcaatagtagatatatatacctgctgcaccctacaccacacatatatgtcccgcccatcttcgtgcgtatagagtgtacacacatcatatgtagatgtgtttcgtctctgtgtgtccacacacatggtatatatctgtgccacgcgtgagatttgtgctccacgcggcgccgcgcgtgtggctcacacacgccctcgtgaaattcccacgccacactcgggagaggcccgagaggggggccgcgagttcgctggagaagtccacgcgaagagttcgagagacccacaccctcgggctaaacactggtggagaaacccctcgtttttatccttaaaaatatccacaaaaaaattatccccgcccatggtggcgggcccccgtataatcccacgctaacttgggagaggctgaaggccacaggagagaatatgcgcacatgaacacctcgggagaggcacgagacttgccgatgagactgagattgcgcccctgcactcccccctgggccaccgagcgagactccctttccta

SEQ ID NO: 656374 - DNA, 182 bp, Homo sapiens
gcgtcgactttttttggatttttcaaaatttattgtattcatatgatagatacaacacagcaaaattaatgttacacacaatagcataaaaacaaatcttacagtcataatgttaagagacaagccagaacataagagcataccttttaaatctatgaccatatttcttagacattcaagaa

SEQ ID NO: 656375 - DNA, 299 bp, Homo sapiens
ggcccagattggttcttgcattgtcaccccagctgcagtgcagatggcacaagtctcggctcactgcagccttgacctcctgagctcaggatcctcccatctcagcgtcgtgagtagctgggacaacaggtgtgtgccatcgacacccagctaatttttttattttttgtagagataggggtctcactacgtagcccaagctggtcttgaactcctggcttcaagcgatgctcccacctaggtgtcccaaagtgctgggattacaggtgtgagccacattcctagctgaataatctcaa

SEQ ID NO: 656376 - DNA, 782 bp, Homo sapiens
gctgggcctggagcagccaagaatgacgggctgtatgactttctgtgagcccccagcgaggggaggcccagctccgagagaccaggaaccctgcttcagccaggccctcagggcttcccaaggatgtccagccgccacaccacacgttaccataatgagtcactaggcttctggggagggccgaacttcacccatgcatgagagactctcctcctttccagagagaatcggatctggcaccacgtgtggcagccatgaggcgggcgggagcgggggcctcgtttagctctctttatcttggctctctcactcatgtatgcatacatgcacagagatgcatacacaggtgcctatgcaacgttcagtttaatgccctcagggcttggtccctgcccaaaggggctgggaccctcctaatcctctcctaggtatgtggggcttggtcccctgacaccgcttctccccttccttggtagaccttaaactcgcagcacatgtccccagcattttctccacctggatagaagcccataagctgggtctcaaggctggggctcaagaaacaggacttcgccttgctaatccgagaggccatttcccaacccccccagagaaaagctcccctgttttcactattcaccatgggattcccagagcaccggacacatggagccccacaggccaggttgacggtgggcacgggggacttccgggattcccgacagagactcaggtcatttaccttatctctattaaaaaatctaattctcttagctctgaaa

SEQ ID NO: 656377 - DNA, 149 bp, Homo sapiens
gtgacgtggcctggccttatcccaggcagctgtatgggtgtgaagcagcacaggcctgacactgacatggcattggctctcaaaaatgccacttgagtacgagtgagtggctggctgacacagtcagagttcccaccctgacttccatg

SEQ ID NO: 656378 - DNA, 114 bp, Homo sapiens
ccccccttttcacctcctcattttttttgggtctttctgttttccttttttcaccctcctccctccccttagccatcacttttgggaagtaaagaacttggcttagggccggga

SEQ ID NO: 656379 - DNA, 397 bp, Homo sapiens
gagctcggtacccataatacaaaggttaaaacaggctttaggacacacctggctgaatatgtgatcacagaggagttaaattctgagtgattttttaaaaaaaacgtatgaaataggatggacctagagggcattacgctaagtgaaataagtcagagaaagacaaataccatatgatttcacttacatgtggaatctaaaaagcaaaacaaatgaacaaacaaaaagcagaaacagacccataaatacagagaacaaactgatggctgccagaggagacaggtagggaggatggggaaaatgggtaaaagggaatgggagatgcagacttccagttctggaatgggtaagtcacagggatgaaaagtaaagcacagagaatgtagtcaatggtacg

SEQ ID NO: 656380 - DNA, 910 bp, Homo sapiens
  misc_feature (784)..(784): n is a, c, g, or t
cgccggatccaggtttattactagcaaaccctgcggagggggaaaacagcttattgtcagtgcccactgccgctcacaggcgggggtggtcatagcgctgggagggagggctctggacagtatagcttgctgctcagtagaagatgataaggatgttcctgaagtcaggctgttgggcctttgcccagcaggatgtgataaggatgtttctgcagtcaggtggttaggacatttctcacaggggggggttcccatggaatgttttactccaaccaggatctgggcgtccttcatgcttccttcctcaggggggcccaaacagaaacatggggcaattccacgcaggggccatggagggaacaaaaaacaaccccaatgaaaacccacggggggggataaatcttgccccaacatgaaactaaaaccgggtgcttcttaccacttaccaaaaaacagggttatgaagcttacccagccccctgaagggacgttcagggggccaaccaagtggggtgggggtgtcagcttgcttggtgggaatcccaaaagataaagataggcctggggggggtggtaatttaggggaattccttcaggcttaagtgtggaaactggtgggttaaaaaccgttggtgggggagccacattaagcgtgtaaaggcgcctctgggccaaataaaatttttgaatatgcgagcgggggagtattccgattggtgatggagaagaagattgggaggttgtgaatgtgtggggtgatggttgttttaagggggcgtgaacngtgttttggcggcttttgtaaagacccgaaagaatagggtccgctttttccgctgcttatgtagagttttggcccgcgtttaatttgagtgcggtatccgctggggaacgaaagccggggcggcgg

SEQ ID NO: 656381 - DNA, 307 bp, Homo sapiens
ggagttcgaaaccagcctgagcaacatagtgagacttcctccctatttaaaaaataataataaaaaccaggcgtggtggtgcgcacctgtaatctcagctacttgagaggctgaaggaggaacactgcttgaattcagggaggtcaaggctgcagtgagctgtgatgacgccactgaactccagcctggacaacagacccagtctccaaaaaaaaaaaggaaaggtaaaaaggtagggcctaatcagggaggtgccggcccatttctctggccaagattgaggagatagaagggggtgatgaagcat

SEQ ID NO: 656382 - DNA, 281 bp, Homo sapiens
  misc_feature (89)..(89): n is a, c, g, or t
actcttacggtttcggcggcaaatactgtttcaacaatgacttattggaggggagcgccgccccctttgattatcaaggcaaaacgganaatcacgagtcccacaaagactatgtgagagggttcggaggattatgtggtgtgcagacagacaaacactacaaatgtgaccttggcagcgatcacgacgacatgttgtaaccgcatcactcccaaaaatattatatgactggtgtgggacgccaattcggtgttcactcggagaggcaggactccgatgct

SEQ ID NO: 656383 - DNA, 205 bp, Homo sapiens
gaatgagcagtcacacgagttagcccaaatctgtagtagaaaaggccacctctggcatgtctaaaacatctgtagagtctgtaaaacttgcacatgttggaggagaatgcaacatattcctcagtatatatggaggcagaagcaacagctctgcactctgacacatctatgaaaggtcatgcctgaggtacctgcacaactcctg

SEQ ID NO: 656384 - DNA, 869 bp, Homo sapiens
  misc_feature (38)..(39): n is a, c, g, or t
  misc_feature (41)..(41): n is a, c, g, or t
  misc_feature (64)..(64): n is a, c, g, or t
  misc_feature (178)..(178): n is a, c, g, or t
  misc_feature (189)..(189): n is a, c, g, or t
  misc_feature (201)..(201): n is a, c, g, or t
  misc_feature (204)..(205): n is a, c, g, or t
  misc_feature (215)..(216): n is a, c, g, or t
  misc_feature (555)..(555): n is a, c, g, or t
  misc_feature (564)..(564): n is a, c, g, or t
  misc_feature (566)..(566): n is a, c, g, or t
  misc_feature (568)..(568): n is a, c, g, or t
  misc_feature (579)..(580): n is a, c, g, or t
  misc_feature (592)..(592): n is a, c, g, or t
  misc_feature (605)..(605): n is a, c, g, or t
  misc_feature (609)..(609): n is a, c, g, or t
  misc_feature (620)..(620): n is a, c, g, or t
  misc_feature (623)..(623): n is a, c, g, or t
  misc_feature (625)..(625): n is a, c, g, or t
  misc_feature (633)..(633): n is a, c, g, or t
  misc_feature (645)..(645): n is a, c, g, or t
  misc_feature (658)..(659): n is a, c, g, or t
  misc_feature (666)..(666): n is a, c, g, or t
  misc_feature (672)..(672): n is a, c, g, or t
  misc_feature (680)..(680): n is a, c, g, or t
  misc_feature (684)..(684): n is a, c, g, or t
  misc_feature (699)..(699): n is a, c, g, or t
  misc_feature (707)..(707): n is a, c, g, or t
  misc_feature (711)..(711): n is a, c, g, or t
  misc_feature (723)..(723): n is a, c, g, or t
  misc_feature (725)..(726): n is a, c, g, or t
  misc_feature (731)..(731): n is a, c, g, or t
  misc_feature (737)..(738): n is a, c, g, or t
gagcctgcgagtgttctgagggaagcaaggaggcgggnngnccgaggagtgcgagtagtgaaangtgcttctgaggggagcccaagatgaccggttctaacgagttcaagctgaaccagccacccgaggatggcatctcctccgtgaagttcagccccaaacacctcccagttcctgnttgtctcctcntgggacacgtcngtnncgtctctacnnatgtgccggccaactccatgcggctcaagtaccagcacaccggcgccgtcctggactgcgcttctacgatccaacgcatgccctggagtggaggactagatcatcaattgaacattgcttgattggaacactgatcacgaaaaatcttgtgggcgacccattgatgcccctatcagatgtgttgaatactgtcccaagaacgtgacatgtgatggtcacctgaaaagtgggggatcagaccagttacaactgtgggatccaagaactccttgtaagtgctggggaccttctctacagctcgaaaagggtatatacccctctcagtgtctggagaccggntgattgtgngnancagcaggcccnnaagtgtgggggnggacttacggacnatgngttacgtgagnagngnagggagtncagcctgaatancagattggtgatnnaggggtnccaacnagcaggtngtantaagccatgaggcgngggagtgnattnggcccagcctgngnngaganaaagtnnttcatgtgcgcaagaggagaatatgggcgattccgacagcgttttaatcaaatttgcgggtgtgggtgaaatggacacaagagggcctgacagcgagtaataggagagattatagggaacggattgggaaa

SEQ ID NO: 656385 - DNA, 255 bp, Homo sapiens
ggcacgaggggattacaggtgcacaccgccaagcctagctaatttgggggtatttgagtagaaaccccatctctactaaaaatacaaaaattagccaggcatggtagcatgggcctgtaatcccagctgcttgggagactgaggcatcagactcatcactgattctcatcaagcgatgagaacgtttgaacccctggaggcagaggttacaaagagctgagatcgtgccacctcatttcagcctgggcaacagag

SEQ ID NO: 656386 - DNA, 1209 bp, Homo sapiens
  misc_feature (515)..(515): n is a, c, g, or t
  misc_feature (1209)..(1209): n is a, c, g, or t
ggcgggcgcggtggctcacgcctgtaatcccagctctcagggaggctaagaggcgggaggatagcttgagcccaggagttcgagacctgcctgggcaatatagcgagaccccgttctccagaaaacggaacaaacaaaaacccaaaggacaagcacaaaaaaacaaagacaaacaaaaaaaaaaatgtgtgggggcggccgtggcccctaagaaaaaggtttcctaaacccattcggtgggggcgcggcggccccagtttggttaacgtgcacacgggcccacaaggcggtgttcccaagaggaacaaccgggccacacacacagggggcgggggtttccccccccaaataaaaaaacccggggagcggacccaccgagggggtgcttgggaaacaaccgccaaagagggagggtcgaggcggcgacgtcagcgggagtcctatcaacaagaggcgggtccaagagggagcggcagaatataaatattctacggccgccgacggagagtgagtantacaacactacgagaactctaacaacacgcacgacgaccacacgagcgcatagcgatactcagcacaagcacagacgcgatgacgaatcagaagagaacgatcactaaggacagcaatctcacgcagacgcagcgacgacaggtacagtacacgaaactacgccaccagcacactaccatccacagcgagaagagagagagaagaaagagagaaagacagaacagacaacaagcagaggacggagcaacacacacataagagcagcgagacagcgcgagcgagcgaaggcgacgcaagagaacacgaacagcagcgcagaacagaaagcaacagagaacaacgacgcaggaggacaaacaccacgagaacgaagaacagcaacaagcacacgcacagagacacaacgaccaacaaagaccaggacaatagcaagacaggagagagaggcacgaaacgcacacgagaaagaagagagagcactacacgcagagcagacagagagatagcagcagactacaagcagaagaacgaggagacgcacagaaccagacaagagagactaacggagaggcaaggagacagaggaagcagcgaaaccagagctaacgactcagacgcaagcacacaagaagaacggaacagagcaaaagcgcaaggcgcagccagacatctaggagctatcaaggtgtgcan

SEQ ID NO: 656387 - DNA, 867 bp, Homo sapiens
  misc_feature (867)..(867): n is a, c, g, or t
gctctttcccatcttgcaagatggcgggtgaaaaagttgagaatccagatgctacagagaagaaacccgcaagaccaagcaaggttgatgctgtgctgtgcatggtgacatacacgggtcaaccatcaaacagcttaaaaagcactccgaagaagggggaagcccctatttgcagcgcaaccctgtccttgtcagaggacatatgcgtcagggtattcctcgatctgcctatgtattccataaaggcctatgttcccagaggaagtacatcatgacctgcatatatccaatagtgttgcaatacagaaaacacagcaaggtagtaaggttctccgtgcaattgtttacaaaacccagtatggtaggctgagcacagaacggcccggtaaaccccgggggtggctattaaaatcttctgataacatatgacctcataattaattgattccttatctgcaccagtatgtgactctgcgaacataagctgtatgacgtccaccggcaacctaaggccttccatatcacgactcgtagagacatccttgcgtagccggcacattagacccttcgtggaaaccatttcttggagtcatcctcatctgggtactgcacctcagggtgggccaaacgagggggtgtgttttatcacgttgaaaaggcaatgcctgggcttatgatgggattttactttaccttttgtttgaacttggggatcccattcggttgggatcccgttcaaattacgggacgttcacttcgtatcggagatcgaaactacgatcccatgagaccacttcttgtcaatttgcccgacattcctaagcccaggggattcctgagttattcaaggtcaacggtggttacaan

SEQ ID NO: 656388 - DNA, 852 bp, Homo sapiens
  misc_feature (27)..(27): n is a, c, g, or t
  misc_feature (34)..(34): n is a, c, g, or t
  misc_feature (63)..(63): n is a, c, g, or t
  misc_feature (115)..(115): n is a, c, g, or t
  misc_feature (122)..(122): n is a, c, g, or t
  misc_feature (126)..(126): n is a, c, g, or t
  misc_feature (156)..(157): n is a, c, g, or t
  misc_feature (174)..(175): n is a, c, g, or t
  misc_feature (204)..(204): n is a, c, g, or t
  misc_feature (263)..(264): n is a, c, g, or t
  misc_feature (279)..(279): n is a, c, g, or t
  misc_feature (282)..(283): n is a, c, g, or t
  misc_feature (286)..(286): n is a, c, g, or t
  misc_feature (291)..(291): n is a, c, g, or t
  misc_feature (322)..(322): n is a, c, g, or t
  misc_feature (366)..(366): n is a, c, g, or t
  misc_feature (372)..(372): n is a, c, g, or t
  misc_feature (400)..(400): n is a, c, g, or t
  misc_feature (417)..(417): n is a, c, g, or t
  misc_feature (470)..(470): n is a, c, g, or t
  misc_feature (477)..(478): n is a, c, g, or t
  misc_feature (490)..(490): n is a, c, g, or t
  misc_feature (493)..(493): n is a, c, g, or t
  misc_feature (768)..(768): n is a, c, g, or t
  misc_feature (775)..(775): n is a, c, g, or t
  misc_feature (816)..(816): n is a, c, g, or t
taagtactgtttttaaaaactaataanttaaaantgccacacgcaaaaaagaaaattaaagtngtccacaaaacattctcctttccttctgaaggttttacgatggattgttatnattaacnagtnttttactactaaacttaaatggccatttgnnacaaacagttctgaganngttcttccaccattgattaagagtggggnggcaggtattagggataatattcatttagccttctgggctttctgggcggggttggtgnncttgccagctccagnggnnttnttgtncactgctttgatgagacccaccggaactgtntgtgtcatatcacgaacagcaaagcgacccaaaggtggatagtntgagangctctcaatacacatggggttgccaggnaccatatcaacaatggnagcatcaccagatttcaagaatttagggccatcttccagctttttaccagaangggggtnnatcttttccttnagntcaggaaacttgcatgcaatgtgagcggtgtggcgatccaatacaggggcatagccggcgcttatttggcctggatggttcaggataatcacctgaacagtgaagccagctgcttccattggtgggtcatttttgctgtcaccagcaacgttgccacgacgaacatccttgacagacacattcttgacattgaagcccacattgtccccaggaagagcttcactcaaagcttcatggtgcatttcgacagaatttacttccgttgtaacgttgantggagcnaaggtgaccaccataccgggtttgaaaacaccagtatccantcggccaacaggaacagtaccaataccaccaatttt

SEQ ID NO: 656389 - DNA, 115 bp, Homo sapiens
ggatcttgagtcctactcacccaagcggaggtgaagagactgtccttccccaggagccgactggccaatcacaggcaggaacgatgaaggttctagagaggctgcgtatgctggt

SEQ ID NO: 656390 - DNA, 363 bp, Homo sapiens
ctcttttagttgttttgaaacaacaatccattattaaccttggaatttagacctttgggtctcattgtataactttccctggcttacactgctagctgtaagccagtgattctctaatattttaaaactattcaagaaagccatgtttaatgcaatctaatttgaaaatacagatatgcaataaaaaatgcatctgtagtaccactgaccagagaccaatgtaacattttgctctatgttcttctaagcttttgtccacacatatatattcttagaaatgaaaatacatggaattgtgctctatataatttttgtaacttgatgtttcatatcataaaactatgatgattgtttttgtaaaaa

SEQ ID NO: 656391 - DNA, 185 bp, Homo sapiens
ggttactactcacgatgcacgcacgacacctaccgtcaccgttcactgaccacaaccttacggacgacaaaacctacaccacgactgacacgacacgtacgacatgacaactgacgtcacgacgacacgcacgactactaagactgagacgacacggaccaacggtcacacctactgacacgaca

SEQ ID NO: 656392 - DNA, 997 bp, Homo sapiens
gggcggcggtgggaagatgctgctctttggcgtacatcgcaatcgattagggatcgttgctcagaatcaagttagaagtgagagttcagatgagtgaggccgccattggtgctttgaacacctcagaaggggagaatggatttgatcaggagtgacaaatgaagagcattgctaggagctctaagagaaacataataccaaagtccagcactagggctccttcatcctaccaaacgcgaaagacgcgtgtcagatgagaagtccgaaggatcgctcaaaagataaaggggccaccaaggagtcggagatgagaaggatcgcggccgggacagaaagcccgaaacgaggcgccagcgctgccagctcggctagcagcagtaccaggtctcggtccaggctcggacgttccagctcaggctccagcacccagacgagggtggctcaaagcagtggctccatgctcttcctcagcatccaggcgattcagtgaagctccaggagctcccaggagctccagctctagcaagctcttctgggtctccaagtccttctcggggcagacacgacaagaggaggcgctcccggctccaaaatcgaaaatcacctaaaaacagactgagaacggagaggaaagaggacggaagcgccatctcactaagacccgacgcaaaagtgcacattcggggagaactgagcgcggaaatgtgacgaagaggatcaccatacgatggaagataatctgccaactatgggggaacacatccaaagagggacgtggagcaatgcgagctggaacaatgggaacgggaaaacccgagaatcaggtcacaaaagggataagccgatacgggagcagccagagaaataccagaatgaaagaccggagaaagggggacggaccacactagaaatgaacgaccaaaagagatgggccaggagaacacggagcacaacgaggatgacgccacagggccacgagacagcacggcaggggcga

SEQ ID NO: 656393 - DNA, 501 bp, Homo sapiens
  misc_feature (132)..(132): n is a, c, g, or t
  misc_feature (145)..(148): n is a, c, g, or t
  misc_feature (151)..(151): n is a, c, g, or t
  misc_feature (155)..(156): n is a, c, g, or t
  misc_feature (165)..(165): n is a, c, g, or t
  misc_feature (170)..(170): n is a, c, g, or t
  misc_feature (175)..(176): n is a, c, g, or t
  misc_feature (178)..(180): n is a, c, g, or t
  misc_feature (188)..(188): n is a, c, g, or t
  misc_feature (191)..(192): n is a, c, g, or t
  misc_feature (206)..(206): n is a, c, g, or t
  misc_feature (209)..(211): n is a, c, g, or t
  misc_feature (226)..(226): n is a, c, g, or t
  misc_feature (234)..(234): n is a, c, g, or t
  misc_feature (236)..(236): n is a, c, g, or t
  misc_feature (252)..(252): n is a, c, g, or t
  misc_feature (269)..(269): n is a, c, g, or t
  misc_feature (271)..(271): n is a, c, g, or t
  misc_feature (276)..(276): n is a, c, g, or t
  misc_feature (305)..(305): n is a, c, g, or t
  misc_feature (315)..(315): n is a, c, g, or t
  misc_feature (319)..(319): n is a, c, g, or t
  misc_feature (328)..(328): n is a, c, g, or t
  misc_feature (336)..(336): n is a, c, g, or t
  misc_feature (353)..(353): n is a, c, g, or t
  misc_feature (381)..(381): n is a, c, g, or t
  misc_feature (499)..(499): n is a, c, g, or t
tactctgattttcttgtcagcctgcttcaaggaaatccatgtgttcaaaatgcttgctcgcagtttgctccataccaaatggttgcttaacccaaatatctggagcagcaaattgagctgatccttctgggnaatgtacggttgnnnnggnaagnncactgggtngtcgnggggnngnnnacacatcntgnnctccccagtctggnggnnnggggggggggggggngggtgggngnggggtgttgcgggggntgagtggtccgaaaggntnggttntgggtgcgactgccacaaatacagtaggnatgcgatcgncttnatactcagntttaatcntcagggtttcatgtggncctttatgggggatgtgagtcggagttnacatgggatgcgagaatttccacaggccttcttgattttttcacagtgaccaagatcagaagtagagcccatcaacactacaaccctgcactgactttctgatttcaaaagcaactcnac

SEQ ID NO: 656394 - DNA, 427 bp, Homo sapiens
ggcttcacaatcactgggggaaggtgaaaggcaaggaggagcaagtcacgtcttacatggatggcagcaggcaaagagagaccttgtgcagggaaactcccatttttaaaaccatcagatcttgtgaaacttattaactgtcaccagaacagcaagggagagacctgctcccatgattcatttatttcccaccgggtccctcctacaacatgtgggaattatgggagctataagatgaaatttgggtggggacacaaaaccaaaccatatcattctgcccctggcccttcccaaatctcatgtcttcacatttcaaaatcaatcatcccttcccaacggtcccccaaagtcaacccatttcagcattaactcagaagtccacagttcacaaagtcttcatcttgaggacaaggcaagtttcctttcg

SEQ ID NO: 656395 - DNA, 896 bp, Homo sapiens
agcggattcggcggcggctcccgagcgcggcggtgcggcttccccgccctctccctccctcctccagcgacgcttccgaccggcttatcatcctccttatgacaaaccagagcggtcgtgttgtgacatcttctggagtgcgagtgatagccactccatgtgtcacacaagaagtagcctcgctaccaggtccgaatgcaggactcggcgaagtcctgtcctcgtatgagggttccgtgggactgtagacgtctgcaaccttctcggaagagcgtcgcgaggaccttctatgtgcatgcatgtgcgatgtgcgtgattcggcatgtccagccggagagacctcgaactgtgtctcaatgctggtgtgcaacaagtaggtttgcatcgatgcagttgttgtgcctccatataacagttctataagtaggacgatgcatatacaaatgcatggatgtataacaatgtaaaaatggtgcgaaatggaacatagattagcaaaggagaatagactataatgaaaatggtaggcctaagagttgaaagagtgtgtgatcggaagtgatgcatcaagctattgtggaatctttactgtgggatatctgatcggtcattattacatgactttatggctgcaatcagatcgtccaccagctgtctgtctagttgctggctctgcagatggtcacagtctaaagcggttctagactacttgtatggccacagagagaaggaaatgtccaggtcgtcttcactcgagaggagaagcctcatccattgcatggtgaatctcgattgaagagttaattttcttcccaaattccttagagtcactctctgttcttgcccatgcatattaacccagatttattgcccaagaggtacccccattttccata

SEQ ID NO: 656396 - DNA, 96 bp, Homo sapiens
aaaacttaaaaaaaaaatttcccttttttactttggccccccccctttaaaaaaaaaaaaaaaaaaaatcctttaaaaaaaactggggcgccgtta

SEQ ID NO: 656397 - DNA, 484 bp, Homo sapiens
gtgaggccactcttaaaggaccccccaaccatgtcggggttacatgtgtcatacgccttccgggttcacacaattgcttatgcgttcactctcttgagtagctaggactaatgggtgtgccaccgcaccaggctgatttttgtatttttagtatagatggggtttctctgtgttgaccaggctggtctcaaactcctggtctcaagcaatccacctgcttcagccttccaaagcgctgggattacaggcatgagccaccgagtctggtgtattctttatattattaatagacacgagggtcttgccatgttgcccagacctgtctcaaactcctggcctcaagtgatcctcctgcttcggcctcccagtgtgctgggatctcaggcgggagccacagtgcctgacccaaaaccaagctttattatcccaagcaccgacctttatcaagtctacctaatcctctgttgtctccttaagtgtccct

SEQ ID NO: 656398 - DNA, 742 bp, Homo sapiens
cgtgacgcgttggcggactgctgtgggctgccggctggcgccggcgagtgaggggacgcggcgcggtgtgggcggcgcggcccgatggaggcggctgtgaggaggggccgcccgtgtgtccccggctcactccgtgcacttccgtggccgctcggcccccatgcctgcccgacctgcgctgccggagccccagtgtgacctagcgccatgtccagccaggtggtgggcattgagcctctctacatcaaggcagagccgtgcagccctgacagtccaaagggttcctcggagacagagacctgagcctcctgtgtgccctggccccttggtccagcttcccactcgctgcctcccaggccacagagggaagcaggaggcatggggagggggctgggcctggcgagcagtggcggtgggaagctggtgctcagctcccttgcccaagcgcctctgcctggtctgtggggacgtggcctccggttaccactatggtgtggcaatcctgtgaggcctgaaaagccttcttcaagaggaccatccaggggacgcatcgaagtacagctgtccagcctccaacgagtgtgacgatcaccaagcggagcacgcaggcctgccaggccttgccgcttcagcaagtgcctgcgagtgggcattgctcaaggagggagtgcgcctggaccggtccggggttgggcggcagaagtacaagcggcggccgaaggtggacccactgcccttcccg

SEQ ID NO: 656399 - DNA, 111 bp, Homo sapiens
tctaccgcttatgtttaagagaatcctttcattaacttaaattgttaacattgttgttatggggagaaagaatattaacctaaacagtcactttacaacaatcatgtaaag

SEQ ID NO: 656400 - DNA, 402 bp, Homo sapiens
  misc_feature (402)..(402): n is a, c, g, or t
ttttctacacagaatcacattgttaatatttttaacacgaaataaaaattcaatctttttcctccccaatttaatcttgtatctccatctactttgctttgactaatagcctcttcctttcgaaaaggattctttaatttctattcaaacatctataaagtcccacaataaattattggacaggatgtattcatttctcatgaaccagacctgctctgaaccaatgctgtgcggcatgggtggttttccctgcagaggcccgtgttacctgataaggtgatgtgataagtacagtaagttactttgtctccatggggacaaattggcaagattgtatcatattcaagtccagtatcagtattaaacttacccttaggagctaaggatagacaccatgcttgn

SEQ ID NO: 656401 - DNA, 863 bp, Homo sapiens
gttcagggagcgtcctcgctgattccgaagaggtctttctccggcgttgactcccttaggaggcgcacttgccctgcacgccccttgtaatctggaagaggcccctttttctgtgacccgccggggggggtgttcccaaggagtattcccctgcctgactggctgcgtgggtggttccccccgcggcccccactagtctcctcatatttccggggcgggatgcgctttattggtagggcggcttctttccgcccacccacgcacgcggtttatattaggtagtgttacccgcggcccgctgggtcctatctctgtggacaaacgccccctgtcactccgtcggcacattgggtactccctctgcgagtagcatctgccccccgcgcccgcggtggcgcccatcttgggcgcagggtctctctcttcctggagagatgtaatttccccgctcgctcccaccggctctcctgtgggtagaatgaactattgtgcacctctcttcttgtctttgtggtggaatctaagacacgcgggcctttccacgcgccgtttcctcttctcgctatctgccaccaacaaatggttcacatagcaagaccattctccctgtgcacgaagacacaacacacacctgcgaggtggcaggcgagacatcccgggggcgagccccgcaggggcgcgatgacaagacgcacttctatttctgcaggggtggcaccaaccaggcgagacaactcttggtaaccggccggacgccaccagtcccgacgcccccctccccattggttccacccaccgccgtccctggcgcgccaagacggtccgaaccctgaggacaacccgaaaaaaagacccacaaaaca

SEQ ID NO: 656402 - DNA, 254 bp, Homo sapiens
acccggttaagcggtctcggtatagcggctcggtgttagcggctccttcattaccaaaagtggtgttcccctaactatgaacttattatgaagtctttctgattaagagatagtggtcaaaagtcagcactaaatatcaataacagcagtcaaaggttttcattaaccgaatactcgctatcctcccatctcgctaagtgactgttcggcatcgcacttactggtgtgtttctggcccagaccgcgcttaccgt

SEQ ID NO: 656403 - DNA, 190 bp, Homo sapiens
tgacagcatctcccactggccttcaaagtgctggaactacaggcgtgaaacatgcgccagcgtataaagtgtttttttttggtttgggggagagagaaaaacaaaatggacttaagacatctgggggtgagcttctgaatgccctgagatagctcaggtcccaagtaggtaatagtggctggttccgctg

SEQ ID NO: 656404 - DNA, 450 bp, Homo sapiens
accgggatacgacctatgaccccgtgcgtgggtcaaagactcaggagtctgtatttcccgtgaggtgttcattctctacccagagataacttgaatcctacagcaataaacgtctgtgagccgacaggtgcctgtcttctgtttgtctagcgcctgggagtttttgctcttgtagcccaggctggagtgcaatggcgggattcccctcattggaacctccacctctggggttcaagtgattctcctgcctcagcctccagagcagctgagactacaggcatgagccagcatgcccagctaataatagtatttttgccgggaagcctccggcaaaatggggtttcaccatgtaggccaggctggtcctgaactcctgacctcatgatacacccaccttggactcccaaagtgctgggattacaggtgtgagccaccacgcctggcctttag

SEQ ID NO: 656405 - DNA, 151 bp, Homo sapiens
ctagtgtaataaggatatcattttacatgcttcgatacttatttctctcggtaataatgagcttgaagatttcttccgtatgctggttagccgttgtgcgttgcactgttttgtgaagatgtgtggtcatatcatcttatttatctctctt

SEQ ID NO: 656406 - DNA, 228 bp, Homo sapiens
tttatatacttatttcacttagaagcaaacagcaatgttactgaaatatttattactatctccattttacagatgaataactttgccaggaggggtttgcacgaagtaggagaagggggatggaagtcgagctgctagaaccccaaagtcaagtgtccgcctcccgctgtgagagctgagccctagcctatgttccatgcttcatccttcctggtgggtgcttttgct

SEQ ID NO: 656407 - DNA, 726 bp, Homo sapiens
gccgacttcccagcggccccgtgcgggccgggtcatgcccagtgcgggcgcagcggcccggccctggaagcgccccggcggagctgggccgcggtgggctaggggcagggacgagtagccgcgttcggcggagctgtgggtttgagaggttattgtgtaccatgggctagctcgtgtttaattacaacagagaatcttcattgccaaagcttaaagtaacataacaacgtctcgaccgtagatccttcatgcatgagagcatttggggacgacttctctctcctgtgtgtagttcgatagtttggtggtgaagagatgggtgacagtgtcaaagccttactaccaggaccttggcggaggaattcgaatgaatctcatctggggtcattgggtcaccatctctaggaatgcttagattgctcggaatccaggcaagagcgatgatgtggcagacatggttcccatagatatgggcaagttagtgtcttgggcgacagcagaagaggcgccagtacgtctagagccggaattcgcaagatgagctgaagtctccatcgatatttggtaatgttatgtaatttcttcctagttgctctgcagtcgttgaggaactgggatggggagctggtttcttggggtttcaagttcatccgtcgtgggtgctcaatccgaagctatgtaattgccctgttgccttccagggtcggtaaccagtcccgaatcact

SEQ ID NO: 656408 - DNA, 155 bp, Homo sapiens
atagccttcgatatggctgtccgcgagtactgcgcatggcgaaaatggcgcgtagtggacaacgatgagcagttcatcgaagcggccgtgcagctggccgcggatgacgcgcagacgcccagacgctgggcagcatgcggccgcgcgatgaagcg

SEQ ID NO: 656409 - DNA, 425 bp, Homo sapiens
gtccctgtacgggagtggtggctcacacctggtagttccgagcagttgggaggctgaggtgggcggatcacttgaggtcaggagtttgagatcagcctggccaacatgatgaaaccccatccctactagaaatacagaaattaaagttagccaggggtggtggcgtgcgcctgtggtcccagctacttgggaggctgaggcaggagaatggcttgagcctgggaggtggaggttgcagtgagccaagatcacacaccactgcactccagcctgggtaaccaagaaagactctgtttcaaaaaaaaaaaaaaaaaaaagggattgtcaaaattcgcaattattttggcattaaaggtcagtttttgaccacagcttaggagcgcgggttatgaccgggcctttgtaaccttcccaaggttccattc

SEQ ID NO: 656410 - DNA, 351 bp, Homo sapiens
aggatcccagagtgtcttagactattttgtgttgctatcacagaatacctgaagctgggtattctatttactaaatttatttcttaaaaaagagatttattagacctaaaacaataaaaaccctagaagacaacctaggcattaccattcaggacatacgcatgggcaaggacttcatgtctaaaacaccaaaagcaggggcaacaaaagccaaaattgacaaatgggatctaattaaactaaggagcttctgcacagcaaaagaaactaccatcagagtgaaaaggcaacctacaacatgggagaaaattttctcaacctactcatcctccatggtggggtaccgagctc

SEQ ID NO: 656411 - DNA, 1885 bp, Homo sapiens
  misc_feature (669)..(669): n is a, c, g, or t
  misc_feature (909)..(909): n is a, c, g, or t
  misc_feature (1247)..(1247): n is a, c, g, or t
  misc_feature (1252)..(1252): n is a, c, g, or t
agggtggtagcgacatgctgtgtgattgggtgtggtttggtgttgaggttgtgcttggtttgtggagtgtttagtatattgtttatttgtatggtctccggcttggaagtcgcggaggtgtgtgtgaggatatgattgtgggtgtgtgaggtatttatgtggaggggtgtgtggtgatgcgctgtggtgtggtggtgcagtgtgtcgtactagagtgaagtgatggtgttggtggttcgtcgctctgtgtttgatattagtcgggacgatgaagtatgtgtttgggcgtgtggtctgggtaggtaagagtgtgtggtggtgtgtgggtagagtgcgtgtgaggtggtggagggtggggtgaagggtggaggtggataatgactcgccttgtgtatgggtgtaggggtggcgtgagtggggtgcgctgagaaggtgggttgtgatttggtttgtggttgttcgcttggttgttggttggtgtggtggttgtgttcgtgtggtgggggggcgtcgtggtggtgtgtgtggtctgctcgccggagtcactggtggatggttgtggtgcgactgctcaccacgtgtttgtatgtcgcgtcagtcccccccccgttgtgtgggttgtggtgcaagagaccacacgcacactgacggcggcggtttttttttggnggggcgacgacaccgcttgatgttatggagagagcgttgctcgtgggggaggtggtgccccccccccccgagagggtttggtgcccccgcagaagatctccccccgggcgcgtttggttttggtataaccgctgcccggccgcctctcccgttggttccattttatttcgcgcggggtgctctctttaaagaggtgttatcgcgggagcgccccctcgtgggggggggcgcgcgaaagtntctgtggcgccccggcgggagagaggatattgtgcgcgcggggcgctattcttctcggagagcagtgtgggacgcggggcgctctatcccccacgagaggcgcgagacgccggacgcactctagtgtttgtgttcgacacacacacagagagagagagaggggtcctccctctctgctgtgggggagagaacactactgtgcgcccacagagagagagtatagagtctcttctcccgcgcgggggtggtctactcacacacagaggaaacacagctactgggggttttggggggggtgttctcacagagacacacaccacacgcagaggagagaggcntgttnttgtgagagagcgcgacactctcacacagctttgtcgccacacagagagatagagtcgcgcccctctcgtctactagctgtgtgttaaagtagtgcgtctcacaactactgctgcgagaggcgcggatgatactactctctctctcgtcgcgcgcgtggggtggggatcaccacgagagagtagagagagagatcgcgcgagagagacgacaccatcatgtgtttcatatcactccccgcgagagacatcatatatgtgtgccacacctacacatatccgcgccgagaggtacacacacacgcgctcttcgcgagagagagagccccccccagcgagacaaacaatagatgtgtggacacacccggtcgtccaccctgggttctagagggacaggtctccacgaagactgggtgacacatctggtctcacacacgtggggggagatgcccggccctctctgtgagcaccaacaccacaggccggggttctacacacgaggcctccaaagtctaccccagaggtgcccgcccccagaaacaccacattccccaaattttggagaggtggaccatctggccccctccccccccatgtaaataaaattattttttctcatttccccaaaaaaaaaa

SEQ ID NO: 656412 - DNA, 366 bp, Homo sapiens
  misc_feature (36)..(36): n is a, c, g, or t
  misc_feature (113)..(113): n is a, c, g, or t
gctcgacggcgctcaagacctgggtcttgccgctgntacggtcgcggtacgtgatgcggctgccttgttcggacgtctggatatcactgacttcggcgttgaagcgcaccggntacttgaggtgttcgtaaaaggcataggggatgcggtccatgccgcccaccggctggaacatggtggatgaaaactccgggatttatcgaacaccaaggcgccccacagcttggggttaagcagggtttgcagctccagtggcgcgcgtgtcacgccagtcatggtcgccagcgccaggcacgcgcgtgtagccggagcgtaccgaacccttgtattgcaggtcgccgttgaggtcgcagtacactttgagga

SEQ ID NO: 656413 - DNA, 261 bp, Homo sapiens
ttaattttagaagattttattagagaaaatatctggtggttgtcttacacaaatatcagtttcccagggacagaacaaaagatatatatatctgtgttccaagtgccaggtcagaagcaagaggctctgtgctcaaaagtacttggagtatgaaaaggccattatgaatacaaaactgttatcttcggtttctactcacagttgacttaatcccgatggaaggccaacagtggtgtgtagtattcctaagtagactccaac

SEQ ID NO: 656414 - DNA, 188 bp, Homo sapiens
cttaatgtgaagtcatcatgtatcctggttgacagttttgagtagctgttgttatggtgtcgaacatgatggtgagtactgagtggctcacatgtcaggtacaaggtgtttgcccgatgaacatttacagtcgatgttgtccacactccatgcttatatgggcttctgtgaacagagtggggtcttgc

SEQ ID NO: 656415 - DNA, 529 bp, Homo sapiens
tggtggttgaattccagctctggtggattccaggaagttgccccggctgtgtggggctacgcgcagaaccagaaccacatgtaatttacgacagagcgtctagagcgggggccttgcgcggtactatctatgtacccagagacatctcattccggcaaggtgtagcgcggcagacaggttcgctctaccaggtttgtgtttctataccttgaggtctgcagcggttgcgtcccactgtaggacttgtgccggcccaagcaagagcgtgtcttgtgtaccttccaacatgccaaaatgttggccctgcgtggctattcaattggcggccccaggggacacctggtctctggaacagcccgggcacacccccaaggtttcccgcggattggccagggcccaggcgggtttggcgacgcaggcagccgggacgagtatccttggggctcgggcctctatttccacctttcaccatccaggtctctgcaggcgcagccaccccgtcatcctcggcctgctgtgggtgctcccc

SEQ ID NO: 656416 - DNA, 621 bp, Homo sapiens
gcgaagggcagaggttgctatgttgatccatgccctgatggtggagtagattaacgtagcttgtacaatcactgtctcacttttcacttagtcgtgcgtttagagcttaagttaaattgtgggggtacccttcttagagcagctcgtactgacgaaggtgcatgcgctgaatgatgtcacggcagtcgtatgaacacacggcggatattctcagtgtccacagagcaggtgaaatgagggtagcagtagtgacgcccatctccactggcagtgctgatcctcagaaactcatctcgaatgaagtacttggcccgggtcacgcgtgggtcctctccgggctcgggagtagcatcctcaggagtagtgtagcgagcaaattctggaaagtagtcctcaatcttcgatttcccagcaaggactttctcagcgagcagatcttgcttgttgaggaacaggatcacagagatggtgcgcagccatctgttgttccagatgctcttgaagaggttcagagcctcctgcaggcggttggtctggttgtcctcccggatgaccatgttgtagctgctggtgcaccacgaagatatggcgccactcgtgacgttagatctctggcgggga

SEQ ID NO: 656417 - DNA, 931 bp, Homo sapiens
atgggacatgcagcgcaagtaggtctacgaagacgctacttcccctatcatagaagagcttatcaacctttcatgatcacgccgctcatgaatcatttttccttatctgcttcctagtcctgtatgcccttttcctaacactcacaacaaagctaactaatactaagcatctcagacgctcaggaaatagaaagccgtctgaactatcctgcccgccatcatcctagtcctcatcgccctcccatccctacgcttccttgtacatagcagacgaggtcaacgatgcctcccttaccagtcaaaatcagttggccgccaagtggtactgagacctacgagtacagccgacgtacggcggactttaatgctacaaagctcctagcatacattaccgcccatatatgccgtagaaccaggcgaccctggacttccttgacgttgacaatcgagtagtactcccgatggaagcccccacattcgtattatagattaacatcacaggacgtcttggcgctcatgagcgtgtccccacatgaggcttaaaaagagatgcgatgtcccggaccgtctgataacaaaacacatatacagcggtagagacgggggtatactacgggtccaaggctccggcaatcagtggagcagaaccacaggtgacaatgcgcagtgcgtccctagcaatgaagcccacttaaggatctctgcaggtagggcccggattgaccctatagaagcgcatctaccactctaagaggcaagaaagaaaaataaggctgaagaatgaagcagaaaacgaaagaggcatagtcggagacagacgcaaaagagacaaaaaggaggagcgacaaagaagagcagagcaacggcacagaccgcgcataggggacacaaacacgggacgagcaaaacagagtcaagacgcaaacgacga

SEQ ID NO: 656418 - DNA, 647 bp, Homo sapiens
gctctgctcttgtctgcagctgatcgggttgcaagcactttggcacctgggtgagagaggtgaggaagctgcagaaagacaagtggaatctagcagagattcattcatgaggtataaggaaagaagctggctccagtaatataaaaactgcgagaagaagcaacaaagtccttatggagaagctgccacgaagttatccagaagatctagactacagatcactgacagaaggtgactacactaaacaatagatttgaaggcggacaaaagtggccttctgtggaagatgatgccatctaggactttcatagactggccaggagaagtcagtgccttggcttctgagaacatgcgtgacgttctctatgttagaagactagatgcagctggtgattttcaattgaagccaatgcttatttatcattcaaaaaatcctatggcccttaggacttatgctaaatctactcttcctgtgccttataaatgggacaacaaagtctagatgacagcacatctgtttacagcacagtttactgaatactttaaatcccactgttgagagctgctgctcaggaaaaaatattcctttcaaatagtttgtcctatgacatgcacctggtcgtccagggtctgatgggacatgtcag

SEQ ID NO: 656419 - DNA, 1021 bp, Homo sapiens
  misc_feature (337)..(337): n is a, c, g, or t
agcgggttgggtgactgaggcttcgggcggagcgtggagcccgtgccgctgccccaggtacacgcgcccgcgcctttgatcctgatcgtacagtccctagcccgctccgtcgacccgtcctgtctcactggagtcgtcgtcctgtgacactatctgcgctcgaggtaccctgcttccgtgtcgtctgtctgcttcgggcggtcgttgtgctgcttgtgcaggctcggcagtggactgcgtgatgtacttcctggaacggtccttgctgatgcgtgaccggacattcgagattggccatgtcatccatgaaggacttgacttcgtcttgtccgaatantgcttagcgtgatatccaacagtaactgcgaaggattggctgcagggagtgcactgcatggcctagctagtcacaatctggggaggagcttgctacttgttgccctcggcgcatcagtgctttgctcatagtagtagccaggactcaggtatgttggccaacaggccccctaactgcgattgtaccgtaaccggctcaatgaccctaggtacgtgactcaccattttttggtagaaaagacgtgtggcttgccaatttggaccttagtcttcgtcgcgtgcgctgaaagtgggcagagttctcagtgcccctatggggactcattagagcttagtctgtagttacaggaccagtcgatgtgagctttgcgactttactccaatgcctggttgggaacaatgcgttcatataccggtgtgaccaaattgctatgtggggatccataggaatgcccccatgggcacggaaccctgggggacgcattttatgcacagttgcttctgggagtagggacccctttccagaaaggtaaatgacgggaaattaacggaatccacttgcgaaagggtccttggcacggggacacgtgtaggcccagacggaagtgggacccccccacctatgtctatggaacagattgcatccctgtctgtggtccgggagtgggcaagaggccggcggggc

SEQ ID NO: 656420 - DNA, 820 bp, Homo sapiens
ggagagagagagaactagtctcgagttgggttttttttattttataaggcacctgtgggacttaattaggtaaaaagaccccagctccagccaaaggtttggaccggccattgaaagtgcggcctaaaacacccccgaaggttccctcctccctcctctctcagggtcaccagtgtttgaaaacatcggggcatgccggccaaaagggggaagcagggttcaaggcatgccccacatgtgggttctggcccttggaaaggcgggccccctaacattgggtctgatgttggagaagccgaagaacaaaagacttcacctgtgcttggatctccctgctgccccgaggggcttcaggcaaggaacccacccttcaaagtgcgccttgtgcaaaggcgctgtggtgtgcaaaagccttcaaccctcccctcttgttgacgccaggaaggggaaaatggcattctctcccaaaagatgttgttctcagaggggcgcaaggaacggagggcaattgcccactacccatgaggccaagtggccttaaaacccgtgggggtgtagcccctttgtgggagcgcaaaacgcggcgctgaccccggcagacccacaaagacaatcctgggggcggacacagacgcccccctgtgaggaacacagcggctacagtgtcccccagattcacagggaggcagattttcccctaagtctgtggcaaggggggcccgacaaaaaggccatagggacgtgtgagacgcgtcgtcccggaggaccagagagaccccgagaacgacctagtggaaatcctccccatggatgaacatca

SEQ ID NO: 656421 - DNA, 114 bp, Homo sapiens
tctggccccagtcagtattctcttggcgacggtatacaggatgtcaacaggcacgtctccccatcaatgacacctgcttccggtagtactcctctatagatggggtcgtattcg

SEQ ID NO: 656422 - DNA, 534 bp, Homo sapiens
  misc_feature (84)..(84): n is a, c, g, or t
  misc_feature (116)..(116): n is a, c, g, or t
  misc_feature (308)..(308): n is a, c, g, or t
  misc_feature (394)..(394): n is a, c, g, or t
  misc_feature (403)..(403): n is a, c, g, or t
  misc_feature (433)..(433): n is a, c, g, or t
  misc_feature (440)..(440): n is a, c, g, or t
  misc_feature (497)..(497): n is a, c, g, or t
gatcagggcaggctatgcgtcgcggtcggagtggggtctggcgtccggcgaccgtcgccatcgtcctcgttagtatagtgtggnacaacgtggagccactacagcccccccgcccnttttttttccctttaaaaggggggggtaaaaccaaaagcccccacccccggttggaacaccgggggaaacccaaaggggcccaaacgggttgggacacggagggaaactttccttttccccccaatgggtaaacggcacgaaactttttttggaaggcaagtggccaccccttgagaattgggtgccacatnttggcccatgcgcacagggcagcacacatggggcgccaggatcaatgctggcattcattattcacctggcattcccattggggccntgtgtgccnagatggggtttggggctggacatgggctcnaggggcnactttgggcaagccaagcccaatgaaacttggggcaaaacaatttctgggtcggacnaaaaaggtttggggcgcaacaagcacgcgttcatcgt

SEQ ID NO: 656423 - DNA, 137 bp, Homo sapiens
ctgttgctgccgtgtgctctgacggctccccgctttctcccttacaatggcgagtttgcttttctttgggctggaggaagagcatcctatggtgtgtcacagcggcaaagtgtgtttggggctgcaggccctcgctg

SEQ ID NO: 656424 - DNA, 720 bp, Homo sapiens
  misc_feature (606)..(606): n is a, c, g, or t
  misc_feature (636)..(636): n is a, c, g, or t
taaaaaaaccacatcatttttattggctttggtttttatacttttatatgtataaccattctaagtagctaaaaaaactgttcatggcttatcagttttgcaaaacaatatgatcaaaaacacaaaaacatccttttcatggttccaacagtttctctataaccacactccttacaaaaaacatgtaattgtacaaagataaaatccataaccacaagctttactaccatttttgtatcctctatgataacacattgagccggtacactctttaatctatgaggctactgaaaggaacaccattactcctgttattctgtcttttggactacacccactcactcacttatttattcatcatgactgtttccacctttcagcctcgtctaaccttgaccacctctcatagcgacaagtatactctctctcatgataatgaacgcttacctataagcaccttttcaccctggaactacacaattatctgataagatattccagagatacctactttagtaaaccctacaccctgaatgactgctgccctctctccactctttcacacccaaactctctcccccctccttcaaccccagtctttcctantatcatttacgaggcaaaaaaaataaaagnataaataactcaatcccaacccattatccgtcgatcctgtgtttcttactacaacataaaaattcttctcctttcttctacccc

SEQ ID NO: 656425 - DNA, 364 bp, Homo sapiens
  misc_feature (47)..(47): n is a, c, g, or t
  misc_feature (91)..(91): n is a, c, g, or t
  misc_feature (209)..(209): n is a, c, g, or t
  misc_feature (225)..(225): n is a, c, g, or t
  misc_feature (237)..(237): n is a, c, g, or t
  misc_feature (273)..(273): n is a, c, g, or t
  misc_feature (278)..(278): n is a, c, g, or t
  misc_feature (286)..(286): n is a, c, g, or t
  misc_feature (290)..(290): n is a, c, g, or t
  misc_feature (301)..(301): n is a, c, g, or t
gtttgtaagggaaaattggggaaaatggcccagtgagatgtattacnaaaatttggaccatagagggaatccccctaaagcctcaaattanacccccctgggctgggcacagtggctcacaccttataatcctcagcactttgggagtcctaaggcaggaggatcacttgagccccaggagttcgagaccagccctgggcaacatagcnaggcccaatctctgtnaaaaaaattgtnaccagctgggcatggtggtgtgcatctatagtcccnccctnctcaggancctnaagcaagaggntctcttgagcccaggagtttgattctgcagtgagttatgattgcaccactgcactctagcctg

SEQ ID NO: 656426 - DNA, 468 bp, Homo sapiens
gcgagcgatcagaacctgattcgctgccgtgtcctgactactggaatctttgagaacaagatccaagtggacaaagtcaacttccacatgtttgacgtgggtgggcaacgcgatgaactccgcaagtggatccagagctacaacgatgtgactgccatcatctacgaggtggccagcatcagctacaaaatggtcatccgggaggacaaccagaccaaacggctgcaggaggctctgaacctcttcaagagcatctggaacaacagatggctgcgcaccatctctgtgatcctgttcctcaacaagcaagatctgctcgctgagaaagtccttgctgggaaatcgaatgatagaggactactatccagaatttgctcgctacactactcctgaggatgctactcccgagcccggcgaggacccaagcgtgacccgggccaaatacttcgttacgcagagtagtacacg

SEQ ID NO: 656427 - DNA, 115 bp, Homo sapiens
  misc_feature (7)..(7): n is a, c, g, or t
gggggangtaatgatcagtactgcggcgggtaggctaagattgtgggggcatgaatgaagcgaacagattttcgttcatttggttctcagggttgtcataattttttattttatg

SEQ ID NO: 656428 - DNA, 729 bp, Homo sapiens
  misc_feature (104)..(104): n is a, c, g, or t
ttctgctgtgttatagaggatccctctactcgcgagtgcgtacagggacgtgggtacatcgtgggtgggagacattaacgagctgtcaggctcatgccctctcnctgcacgcaggggccagcacacctggcagtgccttatgctgcaaagaagagatgccttgggaatggggtcagtcaatgcaagggtccatgggttggccgagccggcatccccttgtgcaatctgcacaggcaaagctgatcaaaggcccaatgtcagtatataggcttgcctctctgcaggagcagctggggcccgggatcaggcctagagttggcggctcagctgtctgccatccagcctggagttgcgcaggagggcggcgttcccagccaaccactccagagagagggggcttccctcatgggggaggcgaaggcacgtggctggcctttggtcagaacccagtgcctggtctggccacagctgacagtgtggttttggtttccctccacatgtgtgcttccacagtgcacccaggcaccatggcagggtcttgcttaccccttcccaggggcagtgtagacagtgcactggacagaactggtttcacagcagaaggttgttacaacctggtctgctaatacaggaggacttcaagagttgtgcaggacaggagtgatgaccggagtaaggacgagtgatcgatatgctagttcgagtttttaaaaaaaaaaatgggagggg

SEQ ID NO: 656429 - DNA, 495 bp, Homo sapiens
  misc_feature (88)..(88): n is a, c, g, or t
ttcagggcaggtttcttttacatagggcgttgggtcaaactttgggaggcccgactgtcagttctttgggaagtgggcagggcatccncaaggggttttcctcctttgttttttggagaaccagggctcttctcaggggctttagggaccccaggctgtttcacccaggaaggcccaaatcaaaagggggatggaaaaagttgtaaaaaaaaaaaagtgggggtggggaaccgggggttctttcccccccattggaagaatgtcaaaagggttttaggagggtccccccttttttcccccccccccttttttttttattaacaaaaaggaaacttcaaagttaatggggggggggggtttcccagggggggaactcgttccccccccagcctttcatgaaaaagggggttttttttaatcaaacaaaccccccccctgggggggaggggttccccaacccttcaaaaaaaaaaggaaaggcttagaaaccgccca

SEQ ID NO: 656430 - DNA, 1024 bp, Homo sapiens
  misc_feature (7)..(7): n is a, c, g, or t
  misc_feature (110)..(110): n is a, c, g, or t
  misc_feature (142)..(142): n is a, c, g, or t
  misc_feature (145)..(145): n is a, c, g, or t
  misc_feature (207)..(207): n is a, c, g, or t
  misc_feature (234)..(234): n is a, c, g, or t
  misc_feature (249)..(249): n is a, c, g, or t
  misc_feature (336)..(336): n is a, c, g, or t
  misc_feature (348)..(348): n is a, c, g, or t
  misc_feature (353)..(353): n is a, c, g, or t
  misc_feature (372)..(372): n is a, c, g, or t
  misc_feature (387)..(387): n is a, c, g, or t
  misc_feature (395)..(395): n is a, c, g, or t
  misc_feature (397)..(398): n is a, c, g, or t
  misc_feature (406)..(406): n is a, c, g, or t
  misc_feature (408)..(408): n is a, c, g, or t
  misc_feature (433)..(433): n is a, c, g, or t
  misc_feature (451)..(451): n is a, c, g, or t
  misc_feature (454)..(454): n is a, c, g, or t
  misc_feature (502)..(502): n is a, c, g, or t
  misc_feature (509)..(509): n is a, c, g, or t
  misc_feature (514)..(514): n is a, c, g, or t
  misc_feature (531)..(531): n is a, c, g, or t
  misc_feature (534)..(534): n is a, c, g, or t
  misc_feature (538)..(538): n is a, c, g, or t
  misc_feature (547)..(547): n is a, c, g, or t
  misc_feature (560)..(560): n is a, c, g, or t
  misc_feature (576)..(576): n is a, c, g, or t
  misc_feature (608)..(608): n is a, c, g, or t
  misc_feature (648)..(648): n is a, c, g, or t
  misc_feature (657)..(657): n is a, c, g, or t
  misc_feature (664)..(664): n is a, c, g, or t
  misc_feature (684)..(684): n is a, c, g, or t
  misc_feature (686)..(686): n is a, c, g, or t
  misc_feature (692)..(692): n is a, c, g, or t
  misc_feature (703)..(703): n is a, c, g, or t
  misc_feature (709)..(709): n is a, c, g, or t
  misc_feature (716)..(716): n is a, c, g, or t
  misc_feature (732)..(732): n is a, c, g, or t
  misc_feature (735)..(735): n is a, c, g, or t
  misc_feature (762)..(762): n is a, c, g, or t
  misc_feature (787)..(787): n is a, c, g, or t
  misc_feature (793)..(793): n is a, c, g, or t
  misc_feature (796)..(796): n is a, c, g, or t
  misc_feature (800)..(800): n is a, c, g, or t
  misc_feature (835)..(835): n is a, c, g, or t
  misc_feature (851)..(851): n is a, c, g, or t
  misc_feature (870)..(870): n is a, c, g, or t
  misc_feature (876)..(876): n is a, c, g, or t
  misc_feature (900)..(900): n is a, c, g, or t
  misc_feature (927)..(927): n is a, c, g, or t
  misc_feature (934)..(934): n is a, c, g, or t
  misc_feature (958)..(958): n is a, c, g, or t
  misc_feature (974)..(974): n is a, c, g, or t
ttaccancaggacaggcaattttcagtgggcttttcagaagctggttgccatgacaaagagcacaatttattcctcagtcccttatcacagctacgatcacagaccatanaaattaacaccgctcttttccatccgatttcnganttcctcatccttacctgaggccttttgttcccccaattcaaatggaatgacatgtcagtcanttcacgacaattcaattaatgctgttncaaaattccggccanaaccagaatctataatcacaacttcctaatcacagcttcagttcatgagaatgaaaacgtaaagcacggaaattgcactaacttaantcaatttatganctaantagctggtattttctacangcacacggcgccttnccgacggntnnacaagccncntgacaaaaagagacgttctggatgntctttcttatcactcttntgntggtggtccaacaagatatgttccacaacacaaaaaggcatggggtanttttttnaaacntgtggccaaataaaatnttngtgntccaaatcntaaacaatgggantgggacctgaaaggcntgggggcaaatgggggcggtcaataaacgtgnaataataacctgaacccaacaaaggtgtaggggcccggcntattgtggntggggcnttcaaagggggggcacaagngnccggtntggtgtggtgngcccanggggtcntttccccaaatgaagnagngcccccctcccctccccccggggttgntgtaaagaacaaccccaaccaatgncaatanccntgtntcctgggcctcccaggggaaaaattattcctaggntaaaggggggaggagngcaatttcaggctggaggntggtancagacctaacctttttccctccanttcttttcaaatttttcaggttgtagnttaacancaggggcaactgagggcttttccnattaacttcaaaaaancagggggccctggcaaataatggctggggggcaggaggaggctccctttg

SEQ ID NO: 656431 - DNA, 2174 bp, Homo sapiens
agcggggtcttggctcgccccgcccttccttgtaagatggcggcgcccaggtggagcgcgtcgggcccctggatccggggaaacggccaaggttgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcctttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggttgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaaatc

SEQ ID NO: 656432 - DNA, 712 bp, Homo sapiens
  misc_feature (2)..(2): n is a, c, g, or t
  misc_feature (103)..(103): n is a, c, g, or t
  misc_feature (129)..(129): n is a, c, g, or t
  misc_feature (147)..(147): n is a, c, g, or t
  misc_feature (154)..(154): n is a, c, g, or t
  misc_feature (182)..(182): n is a, c, g, or t
  misc_feature (202)..(202): n is a, c, g, or t
  misc_feature (206)..(206): n is a, c, g, or t
  misc_feature (238)..(238): n is a, c, g, or t
  misc_feature (270)..(270): n is a, c, g, or t
  misc_feature (337)..(337): n is a, c, g, or t
  misc_feature (504)..(504): n is a, c, g, or t
  misc_feature (576)..(576): n is a, c, g, or t
  misc_feature (643)..(643): n is a, c, g, or t
gnggggggccttccgcgccgttgccgcatcacccaggaactgcatggtgcttggtgggcttcagctccttgttcagctcatacacaatggggatccccgtggncaggttcagctccatgatcgcctggnctgacatcccttccaggngcttganaatgccccgcgggctgttcccgtgggcngcaatgagcactcgcttgcnggcnttgatctggggaacaatctcctcgttccagangggcagggcccgggcaatggtgtgcttgaggntctggcaggtggggagttccccgggcttcaggcctgcgtaccgacgctccttgctaatggagtggtngtgggggtgcttttggtccatggggggcggcgggatgtggaaggagcgccttcagagcttcacctgctcctccccgtgcttgggggccgtttctgccttgttgaggcctgttaggccccgtaatgccgctcattgaggcgccaagtgcgcaccacaggcagccacanctggtccgtgccgtccaggatggcccagagggtgcggatggcccgcttcagcactgacgtgtagcagaagtnaaactccatcttggcatccttgaaggccttggctccccgcttggcctcctcggtccccttttcactnagctctgcatcgaaccagccacagaaacggttcttctggttccatgttctctcgccgtgccggaccatc

SEQ ID NO: 656433 - DNA, 345 bp, Homo sapiens
  misc_feature (30)..(30): n is a, c, g, or t
  misc_feature (36)..(36): n is a, c, g, or t
  misc_feature (68)..(68): n is a, c, g, or t
  misc_feature (70)..(70): n is a, c, g, or t
  misc_feature (305)..(305): n is a, c, g, or t
tgacctctgagagacatccattaagggctnttctcncaaggagagttcttggcgagatcttttcctgncngctcaaacctttggctttttccttcttaggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactggtangagcctgctgatgtctttcagagtatggatcctctagatc

SEQ ID NO: 656434 - DNA, 898 bp, Homo sapiens
gagcaggtgccgagctcggcctggaggtggcgagaacattgtgcgctgtgttcttgtgtgaccctccggattcggcgcgcgtgctgcccgccgtcgaggtgagggttgttcgtgtcttcacatcccgcggctcacgtgggattgtgagcagtagcttacgggtgcgcccaggcagcattgttgtggccttgatcgtcgttattgctaacttgaagtgaagccaagcagtttacggggccacgtacgctcgacttcctatagagaccagtgtcatagatgatagaggcaagtagccctgagtggacgtgagtgctgcttgtttgatccacgggctgcggaggcccaagctgtcgtcggaccccggccattgtcttacagacccgcagccgttagcaccgacctggcttggacccgcgcgcagtggcttcccttgtgatcacgctggcttggtagcttgccccgggggccttgggccagcgggacttggtaccgtgtcgcctggtagccttggtcgggccgtactagaccccgtggacacttggtctgaggggacgtcgtggggctcccttcggccgcaatagtcctgccacgggatgaccctgggccacgacgggcgttagcttggtgcggcctaccaaggtagcgactagcttaaactccactttgcaccacgcctagtgagtatggcctctgcgggaaaaatgggttctcgcttccattgaacgatttgccccggagtttggaaaggatgacacctgaaggaaccagggccttcttggagaaagagccttcagtgcgaaagacttttagaactctattcacagttccacccggaaagggctcccttgagagcgtccctatgcaagctgagcctcaggttcgagaatccacaagctcg

SEQ ID NO: 656435 - DNA, 472 bp, Homo sapiens
catttccttagcttcctcattctcactaggaatccttcatcttcatctctgtacagcgtgtagattcgtgtcctgaatgatctgaatccagctgattcgttcccccttgggggctggttggacttctaccatctctggatctgtcatccccatgctgatcaggaataaacctttctcctcatgtgccactgtctctcactatcagcttctttatagagatcactgtagacttctggtccattgatgcgtagatgtacttctggtctttgtcttgaaggagaactacaatgtctgtgagaagaactgcttgaacctctttcaaccttcctgctgcattcttcagaaacacactcccttcacgtacaagcttcttccgtttcatatcttccttggctagcatctgacctctcttcatcctcgtgatgtgacttgctatctcgtctttgtattaatctcattgagacgccctttc

SEQ ID NO: 656436 - DNA, 2143 bp, Homo sapiens
tgctgaggttactctagaggaatccccttggacctcgatacagggcgacacttggcagggtatgcgggagtctcttcactctcgtctcaaagccattttgtgccgctgccgctgcctctacggccataaatgcccagagattagcggagaagctccgagcccagaaacgggaacaagacacaaagaaggagccggtgtccacaaacgctgttcagcggagagtgcaagaaatagtgcggttcacacggcagctgcagcgagtccaccccaacgtgcttgctaaggcactgacccgaggaattctccaccaggacaagaaccttgtggtcatcaataagccctacggtctccctgtgcatggtggccctggggtccagctctgcatcactgatgtactacctatcctggcaaagatgcttcatggccacaaggcagagcccttgcatctgtgccaccggctggacaaggaaaccacaggtgtaatggtgttggcttgggacaaggacatggcacatcaagtccaagagttgtttagaacccgtcaggtggtgaagaagtactgggccatcactgtgcatgtccccatgccctcagcaggagtcgtggacatccccattgtggagaaggaggcgcaaggccagcagcaacaccacaagatgacattgtccccgagctaccgcatggacgatgggaaaatggtgaaagtgcggcgcagccggaatgcgcaagttgctgtaactcagtaccaggtgctcagcagcactctctcctccgccctcgtggagctccagcccatcactggaataaaacatcagcttcgagttcacttgtcctttggattggattgtccaatccttggtgatcacaagtactcagactggaataggttggccccccagaagctgtctgtgggcaccctgaagaagctggggctagaacagtcgaaggcccgctacatcccccttcacctgcacgcccggcagctgatcctgcctgccctggggtccgggaaggaggaactcaacttggtctgcaaacttcctcgcttctttgtgcattccctgcaccgcctgcgtttagagatgccaaatgaggatcaaaatgagaacaatgaagccaagtgtctgggagcacagtgaagaccatgggagcaccctggcacctgggagcacagtgaagaccctgagagcatcctggcacctgggagcgcaggttggcccctgaactgttctttgtttacaggactctgctaacttctcacttggaacagactgcgtaagagccaggtgggataaggtaaagcaactcagctgctacagggcttttaatggagaacaaagtctatttactgatagtttggctgcactgtggaaaagcctgctggaagtctccctgccgtgggctctcattgccaatatggaacagagcccagggccaggcagactggggcagtgactggaaaaggaaaactaaaggtcagaatccgggatcaggaactgtttttatccagcagtgaagctcttgagctcttaggaaggttcccgtggttggaaagaacataatggttaacaaatatcacagcatccagggattgcccagctatagtgtgggtgccctactgaactctgattagggaacctgtataagggtattgagtgtgaggttgaggtgggacatttgctgagcaaggagaaccgatgtgaatggcaggcagataacatgcacacatgaagctggttgggtgtaaggcagtagcggggagcagcatgctgtctaacagctgttagctccagctggttgttgccatgtgggaatggattttctcatttcttcagagaagctggaaacctagatatttatgtgaaacctcccagtgtattgccaactaaatcaaatttttaaagatgcttaggcacctaagcaaataatacttagaggttgaatttggtctacaggctagcagtttgcagtctatgtttaatgaatggtatagaagtttggggaaaggtgccatcttgaaaattctggatcagtggttggcattttcgctgcgtgtagtatgtatcctttctaggcttggagatggctttggttggtccgtgaatgtagttatgagagtgctgccattaaaaaatcaaaaatc

SEQ ID NO: 656437 - DNA, 791 bp, Homo sapiens
tacgggttgagcccaggttacttaatttgatggtacattgacaaggtgcggttccctaggcccctcccctcttcaaggggtctacttggcaactgatgtgtggcatgggactccccagacagtagaggtgtctctctcattcctcattgtgcatctatagctgggggcatgaggtggtccaaggggtctaacatccttgagcggccattgtggcgccatgaggtccaccaccctagtgcgctgtacgccaatattcgtttgtcatacaccgaggacaatatgagcttgcacaaagtggtcgattgcagggccaatgccagccccaagggctcaacaggtgcgcaggcatgtgggtgctcgctagtgtgcaagtacagaagagagaaccaccgtgggtgacctacagaggataaacccacaggaattgcccctatgagagagtgggccccttccgaagcgaccgtagactataacacccacacatttctgtggaatagatacatcacatcattagagggaacaggtctactacccataaaaccgcgagagtgtacaagtgtacccacacacttgagacacctgttctagcgaaatgatggcggggcgaacacacggtgacacacggaggcgcatagctcgcacaaaggagtagaaggctatcacccagagataccactcacacacatgtgggaattagcacccttttggcccaaaaaagcgctttttgcagcaaggagcgccccaagatacaacggcgcacgggggaatcgaatgcgtacctcggagaacac

SEQ ID NO: 656438 - DNA, 1305 bp, Homo sapiens
ggggttcagcggagggtttggctccgtctcttggtgaacttgaacagaggctgaggcaaaacgcaaaacatttctgcgccacggagatgacgcgggcggtatagccctggaatggcatgatgtccttgacgcctgggccatgacggctgcagctgtcgaggagcaactgtggaacagctgggagataagtaatggtgccacttgtgaacacctatctgtgaacatctggggcgatggaatcagtgagatgactccctagtgacttgacgcgacaaggcatggttgccatggagcctaggatgtcaaggagtgactgcctccgtgaggtccttggccctcactcgcccagcctggggaccgcttagaagaggacgaattcccaggggagcttcccaagcgcaatggatccattggattggccacaagtgggcgcttttgcgccaaagacttttgtctctaccaagatgtctcacaagaatgttcatcatcgcggcatgaagcaacgagtataccttgagatcgattcctataccatcagcggcatgaccgtaccgctgattgaaccggggcaagcccagtgcttagctgcatgcacaggtcggggggtcccggcgtggcttctccccagcaatgggtccccccgtggcgaccctcggtagaccaccgtgacagaccctttgccaggtgcgcctgtcgccggttgggctgccatgatgccggctggggcacttgacattgaggaccaaggcgaggaaagcccctttgacaacaggaacacactccggaagtccaagacccccaagaaagcttggcttaggcatttgggtgttgttcgagacaagtgccttggaaagaaggagcacccacgaaggaacacaggggacccgcagagacacacaagggagaccaccagatatggggattccagagacagcagatcaaacttaccgagacgctaggcagttcacagtatagcggttcaggacccggcagtaggattaccaacccaaagcttttcaatttgaaggtgaaacttcccccaaggggaaccctgggccctggaccaccgtggtgtgcaccccggaagggaattgcgcccatggagacgcaggagcaactcacccagcgaactggaccggatagcgaccagcagataacagccttggtagcatttgccgtattcaccgaaacagaaaccacaatgggaccacgcgacatggagaggacactccatgaaacaagagcgaaccctgctggtacatatacaattgaactctatataagataaagtaacattgatcactg

SEQ ID NO: 656439 - DNA, 106 bp, Homo sapiens
gattacacatgtggcccatgtctgcatggttaggcaacaaggtctctttcagaccttctggctcagaagctgactttagcatgctagctgagagttaatgtattta

SEQ ID NO: 656440 - DNA, 134 bp, Homo sapiens
agtcgtctcatacaggatccccggggtgcgttgaatggcttgtatcgtagcatgcgccaggtaaggtgggccacgagacttgcagcttgtagttgatgaagagctggggcgctcagtggtgatgaacgccgaag

SEQ ID NO: 656441 - DNA, 181 bp, Homo sapiens
tagaaagggaagcagacctatcattctgttagtagcagctagagttcattgctagatctccatgacagggctatctagctagcccttatggactcagccatcactaatctagcatcctctaaccagagccactcgaagactagagttagcagaaattctaacaacctagacggcattaata

SEQ ID NO: 656442 - DNA, 360 bp, Homo sapiens
tttgggccttttgcccccccccaggggggtggggcttccaaaaaaaaaaggaagtggcaaagggggccccaagtgggggaaacttaagggcttcaggccggggtggattcccttaagggggttcttttgccttgggccccatcccctcctagggcaaggggggccccccttgagtgacatgggggggccccggttccggcccttgtttcccgggcccccctgggccgggccccctggggtggggcccccccccccgggccctccctggggcccccccccccttggggcctttgggccccccttatgggggggggaattttttttttaaatggttccaaataaaacttgggccccctccta

SEQ ID NO: 656443 - DNA, 523 bp, Homo sapiens
tggcacagacagtgtcctggggaagaacgcttgacagagcacatacaagaggaagaagggtcagagcctcccaaaagcagagacccgaggcagggcagcagcccatgtgctaacaaagggccccgctcaaatcctcaggtgtacatggacatcacagattgggaacaacgccggctggccgcatccagattgctcctgcgtctgatgtcgtgcccatgacagcagagaacttccgctgccttgtgcactcatgaaacgggctttgggctataagggacgcagttgcaacggatcatccccagtacaatgtgcagggcggggattcacaaaacaaaatgggccctggtgggcaagtccatctatgggaagaaagtcgatggtggaaccctttaatcctcaagcatacgggaccggagataaaaatcatgggcaaatcggggccaaaacccatggtcccaagcttcctggacgtgacacgacaaccggtgatggacgcttggtagtgaaagccagaagcaataga

SEQ ID NO: 656444 - DNA, 321 bp, Homo sapiens
  misc_feature (62)..(63): n is a, c, g, or t
aaatacggggagcaccacagatgtaaaaatcagcatcagcagtggaacgccacccctggggnnttctgtgaatggggttcatctgcctcatgggagactctgaaagggggcagacgtgatctgtgagagttttttttaaaagaaactgcaaaagatctttccaaagatgatgtgccacagatcttttgtttttctctgtaacaaggactaagtgctgtcttagaaaaggtaattgacttgttcatcttcacaatctttcctttccacaagatcaaactgtagggaaaaaaaaggatatttaataaaaatttagagaaatga

SEQ ID NO: 656445 - DNA, 82 bp, Homo sapiens
  misc_feature (79)..(79): n is a, c, g, or t
ggcacgaggccgggagtcccgcctgccagaggatgatgagaggccccctgaggagtatgaccagccctgggagtggaangaa

SEQ ID NO: 656446 - DNA, 362 bp, Homo sapiens
  misc_feature (167)..(167): n is a, c, g, or t
gattccggcttttacatgggacagacggggacgcacaggccaccttccttttggcagggacttttatttattcccattgctttagggctttcggtttccccttcttccggtaggccgggtaaaggcatgcaccgggtaggtttccccggtgaccccccggcggcctnagggacgctccctgccccatcccggctgttggggtgggccgctttgcctttgcttcgccctgtgctgtgttttccagctttgtagcagcagccttgacaaacccaggggccctgtaccaaggcaatgtaacttttgattttcgggcaatttaagtttttttgtccccaaatattaataaacagttttggcttcca

SEQ ID NO: 656447 - DNA, 534 bp, Homo sapiens
gcgaattcactagtgattgtgagcggagatcgcaccactgcactacagcctcagaaagggagtgagacctgctgggaagcatgtctccagccaagaccagagacaggcacttcaaagaaggaggggttaggataggagcttcatgctcaatggattgaccaaacatacacattcaacaggttacatgaggagctatgaatattcatgaaagtggttctgacacatgcatattgaacaaacatgcatgcaacatacaacccatggtcactttggggtggagacttaacatttaaatgtattataattaggccctatatggcaaaaggtcttttcaggacacaaagacatgcaagtgcaggagctctgtaagccagccagaaccagtccatgatgggtagtcaccttgtcaggaaaaagttactgaaatcagtcacttgtccaatcaaagctgtagttatggctggtggaacagtggttggaggtcagttagtcagcatctgattgaagctgaaaatgtttttaatattgcttatc

SEQ ID NO: 656448 - DNA, 1193 bp, Homo sapiens
gattcctgagcaaattccctcaaagtgacctcttgttcttaacatttgcacattttcatggtgcagcattgtcaccagcatcagcaggccacattgcacaaccattgttaccttcattatcatgcaactagcttgcacagtgcaatcacttcacatttcacagtttgccactttcacatcacccaacacttcaaacacccaacaccactccatttcacacacagtcaggttcaagtgcatccatggcatccattgtatcattccagctatgtgcgctctagtgcaaattctcacacaggcaatccaacatcaattccatccatgcatttcacacattttactcagcagcaatttatgacttataaaatataactgttatcttatcctgtagactcgtgtactaagttatctctctactactactctctctactctctactctctctctcatctactactctctcaaaaaaaaagaagagatacagagacacgcagcaacaacaaacaaaaaacatgcagcactagcaaaaaacaacacagacagacgaaaaacatcaggagagcagagaaaaccaagagaaaaatcgccacgacacaaatacagaaaaagacgcacacaaagagatataagcgacccacaagcagaccgcatgagcgaaaaaaccgaaacaaacaaccacacaacgggacataaatgaacaagacaaatagaagaaactaaaaaaggagaaagacaaaaaaagaaaacagagcacaaaaaaaaaaggagttacaacttagtagagaggatagcaagagaaaaagaaaaaacatatagacgagatgaaatattctaagataaagggtaaaaatgtgtgcagatttactataaattggtagaagagtatttccaataaagtccatgctataattgacaccgatccagcgccagggtggaatttaacagactgccatgagaagacacaacaagaaagagagaggaaaacaaaaagacacgtgaggagcacagaaaaaacaagcacaacgaaaaggtaataaaaaaggggaaataacacaagtataacgaaactatatattataaaaaaaaacacaaaagtactataaataataactaaaactaactataactaacaaaaaccataaatgaataaagatataaataattaataaacaaaaaaaacaaaataatatta

SEQ ID NO: 656449 - DNA, 200 bp, Homo sapiens
aagagacagatacgaatcgagccggtaccgttacaaggcgcacatctggatgatatccttatgcttggaatcacgtcctgtcgtgcacgcgatggaaattctgtgcgaggatttcctgaccttcaggcgcgtagagatagtttagataagcttcggcaatcttgcgggagccgcgcttgtcgacaaccttatcaacgaca

SEQ ID NO: 656450 - DNA, 255 bp, Homo sapiens
ccaaagaagaagaaaaggcatttcaaactttacgaaatccttttattttcctttttatatagagacaggatctcactctgtcacccaggctggaatgcagggcaccatcatagctatctgcagcctcaaactcctggctcaaatgatcctcctgtctcagcgtcctgagtagttgggactacaggtatgctccaccatgcctggctaacctattttagttttacatatacaaatctacctggcaaatctaccgcg

SEQ ID NO: 656451 - DNA, 610 bp, Homo sapiens
gacgacctgtctcgccgagcgcacgccttgcccgccgccccgcagaaatgcttcggttacccacagtctttcgccagacgagaccgccgcccacgctaccggcctcctcactctcactcgcgcgctacgccaccccctgtcccacccggctgcccatgcccgaccctcacgctccaccgcgccaccccccacccgccgcctggcccgcaccacccccccccccccccccgcccccgccccacccgccccaccccccccccccccccccccccccccccccccccccccccccctcccccccccctcccccccccccccccccccccccccccccccccccccccccccccccccccccccccccccccccccccccccccccccctccctccccccccccccccccccccccccccccccccccccccctcctccccccctcccgccccccccccccccccccccccccccccccccccgcccgccccccctcccccctcccctctcccccccccccccccccccccccccccccctccgccccccccccccgccccccccccccgccccccccgccgcgcctcccccccccccgcccccgcgccccccc

SEQ ID NO: 656452 - DNA, 130 bp, Homo sapiens
ccctcgatgacgacgacgacgacgccaccaccccagcccccgtctgtgactgaaggcccggtgtgaaaagaccacgatcctccttgacgagttttggttttcaaaatggtgcaataatttaagtggcatc

SEQ ID NO: 656453 - DNA, 399 bp, Homo sapiens
taaaaaaaaaagagggggggggggggggggggggagagagagagagagggggggaaaaaaaccaaacaaaaaaaaaaaaaaaaaaaaggttttttttaaaaaaaaaaaaaaattttttttggggggggggggggttttatgtgtgtttaaaaaaaaaaaaaaaaaaaataaagagggttttttttaaaaaaacaagtaaaaaaaaaaaaaatctccacaaaagaggggagacataattaaaaaaaaaaaaagggggggggggccaaaaaaactccggcggggggggacaaaaaaggaacacccccaattggtgaaaaaagggggcccaaaaaggagagacaaaaaaaaaaacagaaggggggagaataaaaaaaggggaaaagaaaaaaaaaaacaaag

SEQ ID NO: 656454 - DNA, 312 bp, Homo sapiens
  misc_feature (7)..(7): n is a, c, g, or t
tataagntgagctcatagcaccctttttggtgcctagaatgtaaagaagtgctcaaagaatgatgggagacatgtaagaaggaaaaagaatcagcttgaaaagaatcccactggccaaatcagtgaacagtcaaacgtcaaaatagataatattatctaatagatagcaataaattataatccgttgaataaaatagaagatcatactaatataaataaatgaacaaatggaaagtttgatgaagatcagaaaatttgcatagttccaaagtacctcctcaaaaaatattcattaattacaaagggagaaag

SEQ ID NO: 656455 - DNA, 917 bp, Homo sapiens
  misc_feature (144)..(144): n is a, c, g, or t
  misc_feature (146)..(146): n is a, c, g, or t
  misc_feature (148)..(149): n is a, c, g, or t
  misc_feature (152)..(152): n is a, c, g, or t
  misc_feature (160)..(160): n is a, c, g, or t
  misc_feature (163)..(163): n is a, c, g, or t
  misc_feature (167)..(167): n is a, c, g, or t
  misc_feature (170)..(170): n is a, c, g, or t
  misc_feature (176)..(176): n is a, c, g, or t
  misc_feature (180)..(180): n is a, c, g, or t
  misc_feature (183)..(183): n is a, c, g, or t
  misc_feature (204)..(204): n is a, c, g, or t
  misc_feature (207)..(207): n is a, c, g, or t
  misc_feature (211)..(211): n is a, c, g, or t
  misc_feature (219)..(219): n is a, c, g, or t
  misc_feature (237)..(237): n is a, c, g, or t
  misc_feature (596)..(597): n is a, c, g, or t
  misc_feature (649)..(649): n is a, c, g, or t
ggcacgaggccgcgtccttggctggcgtgaggccaaagcaaaatgaggagcgggaaggcctcctgcaccctggagaccgtgtgggaagacaagcacaagtatgaagaggccgaacggcgcttttaccaacaccaaggcacacangngnncgncttcgccnagnagtngcnagcgangggncanccatgaatgggcccggccagnacnaccntgaggacnctgatgaggcggaacccntgacggcggcacaggcgtgatcccaggaagagccaggacagcaggaagcccctgcagaaaaagaggaagcgctcccccaagagcgggctcggccccgcggacctggccctcctgggcctctcggccgaacgtgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttctgaccagtgctgagcgtggccttctgtggatgtgtgtctcatgtgcnncctgttgctgtgcccccgatggtgcatgcctgcaggctagggtgactcccanacacatggccatgcaggtgtgcctgtcccctgacctgtgcccaccatgcccaagcccacctggtcaatggccatgccccctgctggtgcatgcctgcatggcacttggttcgggaggtgtggctgtgagaagccccgtgtatgatgcagccgagaggggcttctacgaggccctgtttgacggccatcccccagggaaggtgcgcctgcaagagcgagccggctggccgagggtgcccggcggggccgcagagaccgcggggcgcaac

SEQ ID NO: 656456 - DNA, 258 bp, Homo sapiens
ctgtgatgttatcccaacaccatcccaggttccaccaaatgtaagaagtaaagaaagagaaaagaaacatgaaaagtggctcaacagtcaaagacaagtttattttggagaataaacctgagaggggcttctggacaatttttttttttttttgggttaggagtgcttgctcctatggactaagagtttttatgggtttaagggtgagagagttactcacaggcttggaatgttctctgtgtggggcgataacggttc

SEQ ID NO: 656457 - DNA, 688 bp, Homo sapiens
ctactgtcgctgggatatagatgtgagccaccactcctcggctgccaagtaattaatagatttaatgctattcccatcaaactaccattggcattcttcacagaattagaaaaaactactttaaaattcatatggaaacgaaaaagagcctgtatagccaagacaatcctaagcaaaaagaacaaagctgtaggcatcacatacctaacttcaaactatactacaaggctacagtagccaaaacaacgtggtattggtaccaaaacaggcatatagaccaatggaacagaacagagacctcagaaataacaccacacatacacaaccatctcatcattgacaaacccgacaaaagcaatggggaaaggattccctatttaataaatgatgctgggaaaactggctagccatatgcagaaaactgaaactggaccccttccttacaccttatacaaaaattaactcaagatgaattaaagacttaattgtaaaacacaaaatcgtaaaaaccctagaagaaaacctaggcagtaccattcaggacataggcgtgggcaaagacttcatgacaaaaacaccaaaagcaattgcagcaaaagccaacatggattctaattaaactaaagagtttctgctcagcaaaagaaatatcatcagagtgaacaggcaacctatggaattggataaa

SEQ ID NO: 656458 - DNA, 343 bp, Homo sapiens
  misc_feature (81)..(81): n is a, c, g, or t
  misc_feature (175)..(175): n is a, c, g, or t
  misc_feature (191)..(191): n is a, c, g, or t
tttaaggagagacggggcttcaccgtgttatccaggaatgttgtcggtctcctgacctcgtgatcccgcccgcctcagccncccaaagtgctgggattacagcgtgagccactggtcccagcccagaacagggaaattttaaaccgtctaggaactatttggaattagcttgttnacttaggattttgtantttggcatgagataaaggtgggttaattgaaattttttcttttttaacattttttgagacagggtcttgctctgttgcccaagctggaatgcagtggtgtgatcacggctcactgcagcctcaacctcctggggtcaagccagcctgcccgc

SEQ ID NO: 656459 - DNA, 1088 bp, Homo sapiens
  misc_feature (859)..(859): n is a, c, g, or t
acaagctcgtccctctttttgtgttttcaataccaccacttttcgcagtgtttatagggggagccccctcagttgtgtaacttctcggaggggagtcccccccccagcagtgttgggtgcgcccacatgataggcccgcgggctttgtgtttaatgcgtcccgcgcgccccgtgctgatacgtatatagacgcgcgtgtctctctaaatggttatgtttcgagacgtgccccctcgtggtgtttgcgccgcagatattttgtcggcgcgcgctcgacgagagcgcgtcgtgtagtgctctctcttctgtgtgagagagcgccctctgtgtcgtggggagaccacgcgcgagagtgtttctgttataaaagagagatatacatatttgtctctgggagatagcgctctgtgtgggtggcacacaacaggcgccccatactgttttgttcctctgtgcgttcactatattatagcgcgcgcgtgtgtctctctcgcgcgatctccacacagaggagagagacacacacccaacgcgcttctctcttgtgtatacaatcattttgtagagagggtgtgtctttatcagcgcgctcccgcagagagatgtatactacacaccacagagtgctatatatattttgtgcgcacccaagagaaagatgcgcgcgctcgtatcatcgagagatatatataacagcacacacatgtagacacacacacgcctactgctctcacatctctctcgtcgaggcgcggcacacacacacacacacacacgcagaccctacagagtgattcatctctctcgcgcggagaaaagtgataacttcgcggcccccatcgggagaacacacagcggngcacttgatgttcttggcccacacactcttccgcagatacacacttctttctctcgctcaagggcccatctaggagacaccaccaatctccgcgcgtggagatgctgtgaccccctcccaaggagagtttccacgttcacggcaaactccgataaattaattgtgcgcatttgtcgcatctgtgtatttttaagaggggatttaaaaacctttcttccccttctaaaat

SEQ ID NO: 656460 - DNA, 230 bp, Homo sapiens
tgtttgctttctgctgagacatacgcgctggaggcatctccagggaatcccggaaggatgcgtactgcaccttcccacggctgtcgctggttgtgacgttagcctgcggttctccaaactgttatcattcagagagactgagcagagtgtatgaggaaacatctgtgtaatttcttacaactgcaagtaaatctacaattatctcaattgtaaatgatacaatactcaac

SEQ ID NO: 656461 - DNA, 268 bp, Homo sapiens
  misc_feature (20)..(20): n is a, c, g, or t
  misc_feature (35)..(35): n is a, c, g, or t
  misc_feature (53)..(53): n is a, c, g, or t
  misc_feature (63)..(63): n is a, c, g, or t
  misc_feature (131)..(131): n is a, c, g, or t
  misc_feature (229)..(229): n is a, c, g, or t
  misc_feature (243)..(243): n is a, c, g, or t
  misc_feature (260)..(260): n is a, c, g, or t
ctgagcagctgagtcaggtntgtgagccctcaccntgaatagtcatccccagntcacagaacntgtttagagcttgggcaacatagtgagaccctctctgtacaaaaaacaaattaaaaaaattacccagntgtggtggtgcgcaccgatagtcccagctgtttgatgacctgaagcgggaggatcacttgagcccaagagcagaggttgcatgtgaactgagattgtnccctgcactccatnctgggtgacggagcaanccctgtct

SEQ ID NO: 656462 - DNA, 108 bp, Homo sapiens
  misc_feature (37)..(37): n is a, c, g, or t
ggcacgagctgtggtggagaatgtagtgaagctcctnggggacagtactacaaagatgccatggagcagtgccacaattacaatgctcgcctctgtgctgagcgcact

SEQ ID NO: 656463 - DNA, 958 bp, Homo sapiens
  misc_feature (281)..(281): n is a, c, g, or t
  misc_feature (324)..(324): n is a, c, g, or t
tggagccaaagtctcgctttgtcaccggggctggagtgggggggcgcaatctcggctcaggaaaccttggcctcccggggttcaagcggattctcgcgtggcctcagcctcccgagttagcggggactacggggtgcccgctctcacgccgggccaatttgggtattttatactaaaagggggtgtgcaccagtgttgggccaggcgggctctgaaactcctgtgacctttgagggagaaagccagaaagtgaagtgccgggcctcagaactccgtggtgngctcactcgatctgcgggcgggcggcggaaccactcaatgagnggtctccttctccaagggggtcgcctatagacgtgcgtgttccctgtgtccgaggaacctgggggccctcccaagcggggctcactcaagagaaagagtctcttggaaagagaggcgccaacgtggtggctctccggacagagaagtgtgtgctccgtgagaaggtctccactcttgtgcggacacatgtgtctctgtgtggaacagcccgagggcgtgggtgcggacgagaaacactccccgtgcgttagaacaaaacgcccgaggtggtgaggcttgcgagggaaatataccgccgctatgactctgcgtgggtctcccaagcgcagagtgggagaagcacgtgccgcgagagagtgacactccgtggggagaggggacctcagggcgcgcttataaaaaaacggctggggtgcgtgccctcttaggagaaagatgacaaggttacagaaactaggggagacatcgggcgagagaactctcccgccgccaatcgttggcgggggtatcgaccgaggggggggggcacgtggcgaaacacacatttgtggaccgccagaaggggggcctcccccacagcgttgagcggccataacctgttgtgaccaaaccccgggggagcgctacacgagct

SEQ ID NO: 656464 - DNA, 111 bp, Homo sapiens
taagagggggactacctgcgcaacgtaatatccaggagagatggtggtcacggagcatgtcagtgacaggaggcctggggtcttcatctaccactctgcaaggaacccacg

SEQ ID NO: 656465 - DNA, 228 bp, Homo sapiens
  misc_feature (72)..(72): n is a, c, g, or t
  misc_feature (174)..(174): n is a, c, g, or t
tagatgtagaaaacagcttccatgtcgcgctgtgaggcgtagtgactgaatctagggtctctttctccttantattcttgtggctacatcatccctggctgtcgggctagtcggggctgtcgggctagtcggggctgtcgggctagtcggggctgtcgggctagttggggctgncgggctagtcggggctgtcgggctagtcggggctgtcgggctagtcgggggggt

SEQ ID NO: 656466 - DNA, 104 bp, Homo sapiens
tactccacaggtgattataggcatgagtcactacgatccggccagcattattactatagcagtaatataatatagtgctattataattagcactataataaaat

SEQ ID NO: 656467 - DNA, 152 bp, Homo sapiens
ggggggggggaaaaaaaaaaaaaatttgccccggttgttttttttttaaacgggggaaaaaaaaggttttggggggcccccgggcccattttcccctttggtgggttttttaattttttttaaaaaaaagggggacctaaaaaaaaggggga

SEQ ID NO: 656468 - DNA, 1471 bp, Homo sapiens
  misc_feature (117)..(117): n is a, c, g, or t
  misc_feature (433)..(433): n is a, c, g, or t
  misc_feature (749)..(749): n is a, c, g, or t
cggggtggttgttacgaccgccaactgcgggcaggatgtgggtgttcttaatgttggatttggagaccctgtttgtgaggagccaccgcgggtattgttttttggggggaggagaanatagatagcttgctggtttgtttgcccgccccccctctttgagggggtgtgtgcttgagaacctgacgatggttggtggaggcgcctctcttttctcccgggagagagggggtgtttttcctcccaccaccgacactggagttgttgggttgccagaggaagtagtggaggaagagatggaatattcttgggttgggggcgcgacaacggggggggtggtcggaggggaaggacgcccactcggtgtgttttagattaaccccctccccccctgaatgagaatgtctgcggccaacaaatgtgctcttgttgcacngaatatatcgtagagggtgtataatagggaaagagggggtggttgtatggcgccaccccgaagggtagggcactgcttttttctttgcaggagtagacttagtttctgttaaatttcattatatttggggggaccccctttgggggggtacttatataggatatggtggtggaatatttatgggggcccccttctgtttttgtgggaaaaaaatatcccacgaggtgtcaatacaccataaaaagggggggtctcctctgctagcgcgtttctacacacaagagcggtgcttctagtatgattattcttctagagnagattgtgtattgtctcccccacttgggagagagaaatatgatggtgtggaaactatttttgtagcgagagagaaatatagagatgttttttaaagagcgtgtctttgtggaaagacagagggcgttaatatttgtgtgtccccagaagagacattcacacaaaggtggcgcccacaaacatatattgagccccttggtttttccaataagaggagtgtagggaacacaccttggtctcacagtgggggcacaacaattttttcccacgacacaggtgtttttggtgtccacaacaaacaaaaaccgcgtgggtctctgtgttgcgctgaggtaaatacaccggaacttttttctttgtgtgggagatttcttgacacacatatatatttgcgccccaggttattactctctccgagtggggtttattctcgggcgaataacaaaatcttgtaaagcaatggggttctaactatacagagtgtgtggtttgcgtcctgttgaaagcatatgggttcttcccaatctcccaagtgtctctttgcagttaagctcccgtggaataaaattcttttacctcgccctatattaagaaggtgctaattagggggacaacccccggtcttgcgttttcatatcttggaactattatagttggccgttttttttggttttggggtggaaagaaagtaaaaagaaaaattaaagccaaattgtaatgtga

SEQ ID NO: 656469 - DNA, 335 bp, Homo sapiens
atcggaatgggaggtgattcatagggggttgtttgatcgcgtttcgtgcaaatataggaggtggagtgctgctaggtctccaataatgaagggtaatatagagtgaaaggtaaagattggtgtgagggtgggtctgtctattgagtagcctcctcagattcattgaactaggtctgtcccaatgtatggggtggcgaatagtaagtttgtaattactgtggcccctcagaatgatatttgccctcacgggagaacatagcatatgaagtctgttgatatagttgcaagcaggagtataatgccaatgtttcaggtttctgagtagagaaatgatc

SEQ ID NO: 656470 - DNA, 328 bp, Homo sapiens
actctaaatatgttttcctcccccatccaactgccacctgtagtgtgcctggtgaagatgtgcgttattgattctgctgcgtgcgtcattctctgcatgcctgaactcccaagtgtgctgtgtttgtcaagcagtggtgagggaccgtgttcaaaacctgctcatttatgaattcaattttgagctgaaacgcgctgtcactaggaatctccagacgttaacactaacacacaaactggtgtttttaaaaaaaaatctggtttctagcagtgtgtctgctgcaacgagtggctacttatcgaattcatcatagcaagaacgtcgacgc

SEQ ID NO: 656471 - DNA, 128 bp, Homo sapiens
cattggtccgagagaaattaggaccagactcggtgcctgatggatatcaggcgtcacagacatttcatggggctccactaactagttgcaactactggcccttcctcttgcttcttcttggtttgcta

SEQ ID NO: 656472 - DNA, 838 bp, Homo sapiens
  misc_feature (25)..(25): n is a, c, g, or t
  misc_feature (124)..(124): n is a, c, g, or t
  misc_feature (156)..(156): n is a, c, g, or t
  misc_feature (210)..(210): n is a, c, g, or t
  misc_feature (282)..(282): n is a, c, g, or t
  misc_feature (321)..(321): n is a, c, g, or t
  misc_feature (324)..(324): n is a, c, g, or t
  misc_feature (359)..(359): n is a, c, g, or t
  misc_feature (373)..(373): n is a, c, g, or t
  misc_feature (402)..(402): n is a, c, g, or t
  misc_feature (407)..(407): n is a, c, g, or t
  misc_feature (538)..(538): n is a, c, g, or t
  misc_feature (566)..(566): n is a, c, g, or t
  misc_feature (589)..(590): n is a, c, g, or t
cagaagattattttacacaagcaanggaagtgaaagcattcgcggagacccacatcaagggcttcacactgaacgatgctgccaacagccgcctcatcataacgcaagttaggcgggattattngaaagaggctgtgacaacactgaaaacagtantggatcagcagcagaccccttctaggttagcagtgacccgtgtcatccaggcantggccatgaagggtgatgtgtgaaaacatagaagtagttcagaagatgttaaatggactcgaagactccatnggactttcaaaaaatggttttcatcaataacattgcttnggntcaaataaagaataataacatagatgccgcaatangaaaacatgtgaanaatatgcttacttcagagaataaagtcanttganaccccaatacttcggctgtggcatacttattcagaaaagtaatagaggagcagttggaaccagcagttgagaaagataagcatcatggcggagagattggcaatcagttgcaatttataaacctgtcatgnttttttccttcaacttgtggatgcggcnaggtggtgatgcagagtctctanngagatgtgcgtcattgtgaccaaacccgattggtgtggtctcctagaatctaggacaggaggctcacgtgtactgggggaaatggacgaataagaaagggaagagtaaatctgagaagttttaaagagtgctgtggaaccgggaatttggcgcaaacatggggcttaagggcttggaaggggacctctaaccggagttttgcaaaggacttaacagtgtttgtttttaagacctttgtacgtgtgatt

SEQ ID NO: 656473 - DNA, 729 bp, Homo sapiens
  misc_feature (598)..(598): n is a, c, g, or t
  misc_feature (604)..(604): n is a, c, g, or t
  misc_feature (638)..(638): n is a, c, g, or t
  misc_feature (663)..(663): n is a, c, g, or t
  misc_feature (683)..(683): n is a, c, g, or t
  misc_feature (702)..(702): n is a, c, g, or t
  misc_feature (722)..(722): n is a, c, g, or t
  misc_feature (728)..(728): n is a, c, g, or t
aatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaaggaaagggcttcccgaagaccttcagaaaaagaaccagcacataatgagacacccttaaagaaagttgggtctggcctaacagtgtggctaccaagcttggtaaagaaggtggcccttgaagccagaaaatttcattttttaaaggccgtcttggtcacattccttactatccttggaatatgctggggaaaaaatagaaatattggnttctangcccctttttttttcattttatttaaatcgctgncctggatcccctatcagttcttttnatagatgaggaaaatagccnccagccaggtggttataanaaaaaaaaatttggattttntacttng

SEQ ID NO: 656474 - DNA, 214 bp, Homo sapiens
  misc_feature (139)..(139): n is a, c, g, or t
  misc_feature (158)..(158): n is a, c, g, or t
  misc_feature (174)..(174): n is a, c, g, or t
  misc_feature (196)..(196): n is a, c, g, or t
cagggctggtgagccctgtggtgtgggaaagattacgcaggaagtcagggtgccatctctcctcggtgttccaattccaagcctcagttccacacacagaataaccataaacagggaaatccagctctctgcatctgtngtgtatgctgtcatgtatncagagagctgaatttnagagggcagctgcagcacattncgaacaggaggagtttaa

SEQ ID NO: 656475 - DNA, 233 bp, Homo sapiens
ccgagttgattcggatgcgtttagaagtcccattcctaaacacatccgtgttactctcatcacgagtatcaatcacctgagctcaccatagtctggtagatactctattcgaaaccaattaattcaagcactgattataacatggttttctgggtctctgttttactctgctacaggcctcaaattacttcaagtcccccttaaccatttgctacggcatttacggtttaaca

SEQ ID NO: 656476 - DNA, 1403 bp, Homo sapiens
gctaccccgtaaaacgccagaagatgggcaagacggaaaacatgactacgagtaatccagagcgattgggtcgctcgatgtagcgtagcgacgtgagcattcgaggcatagtccaccacgtacctggtcgcatctgcatctatacaatgcgtggtggcatcgacagaagagcaaccatctgaagaaaactatgagaaggaggctgctgaggactgggaagaggtgctcgcttgcaagatatgtccctggggtcttggtatataacagctgagaagctgagacgttggaacgatggctagtcacccatttgtactaatcataccttggtggaaaatgtattgaagaccaagacagagtaacatgagtgatggagccttatcgagtatgagttggcccacgagggaacaaacaggatgacctttaaatccacaagagaccgatggatttacgaaggtggactatcatcaagggcctagactctgtgactgtcacttgaaattgggtcgcattggcgtaggctaggtggttggggatcgaacactctcttgagaggcctagcgctattgcttccgaaagaaaactggggcaggcacccacagaaagagagacaatcggcacgcaataatccgtagggctttgaacagcagctagggggttgttggaaaaacataatttaagaaattgctccgagagtgaaatatcacacgcataagagatgggaattgcccctaccgtgggaggcacaaaaccccgttactgagagacccaagccacgtagacagttactgcaaggggagcaattgtgcgtgctaaggggaagaaagccctaggcgcacctcgaatcaaattttaacgcgtaccaccatatttggggcttaaacataagcgcgccggagccaccaaggttaaagccaacatatgtggtggccccaatctttctcagtgaggttttgggacaacattgggttggaacccaaccactggagcgtcggggaacacccccacgggatggcttaaacccactggccctctggggtgtcccccaggcggacgtgggccacaagtgcaaccccgtctacaggggccgtgcgcacaagagcgcaggtcggcaaaccaacagcaaggcttcaaacgagcacacagcgaacatggagaatgtcctataccaacagaaaaaccgcggcccaaaactgtacaaaaaagccaccatgtatggccaagagcactctcacacggagcgtgtgttacaacacaaccatgggctcgtgcacctagggacaacaggacaccagaatagggctcaacaaggcgtgacacacgcgagagtgtagtcaaaaacacacgagggatggcggtgacaacaccaaggaaccagaataacaggtagtacacacgaccgtaaa

SEQ ID NO: 656477 - DNA, 119 bp, Homo sapiens
gctcggtacctataggcgctatgtgggaggattacctgagcctgggaagatcaaactgtggtgagctgtgatcacgccactgcgctctgagcctgggagacagagtgaaaccctaaatc

SEQ ID NO: 656478 - DNA, 754 bp, Homo sapiens
gccttcggcgtccctgcgtctcttcactgcacatttgctatgcattcgcgattcccatttctctgctaggagccagcctgggttggcgctgctcccagagccgtgggtcccagaccttgcgttccttttgttcctgtccgtttatcaggacactgggcccctacctgtcacgtgcctcgtaggcctacctcttagcccagcctgcggggcgttcccacgtgcctggatgccggcttgagttctgcgcacgcaggattcagtgtggggacggctccctgccaggatagggcctagccctggcccaggtggtgagctggtttgcagtgtccgttctcatcctacctgatgggcccagataaaggctccaccagctgtccagcctcctctggacggccaatcagcggtccctgcagcccaagatgggacatcagaccactgtgccaccagagctcacccatgccagcagaaatggggccccagccaggccccagaccagggtcaaaggagcaactgcatcagcacatgtacaatacatgttgccatagcaccaaccatggttgacacgtgggagcacacacacacacaggatgacagggggcacagcccacatccacactccggcaacgcccccacccatcccagcagtgtttctgcaatgtgacatcaaggactagcgtcctccccaaagaccattaggagggggtcaacaatcagacagcacttaagctgatgtttaaaaagacaccatttgccc

SEQ ID NO: 656479 - DNA, 150 bp, Homo sapiens
cccgtctggttcccctcctcttggtcctcatgcccccgggcgcctcgtctctgggaacccgcggtttctggtccggtcccaccctgctcccccctgggacccctggggagggtgtgtcttatggtcctgttggcggtctgtcggtgttct

SEQ ID NO: 656480 - DNA, 422 bp, Homo sapiens
agtagtcaagtatgtccatcaaataaaccagcgcaaacggcgtggtaaccgtgaccgcacaaaattttggtgacaccaatattgatgacaaatcgattacattaaccccatatgttgcaggaacaggtggaaatactgcacttgatgtgagcgccgccaataaagaccaaggaaaagctattgcggagtggcgctgcggcccagaagccaccaatggaattgcagccaagtacttacccggatcctgcaaaggctaatttaattattcaacacgaagtcagttaattatcgtgaataccagcaacgcatccccgaaaagggatgcgttttttattgccctcacgtcccctgactaatcttaatcgtcggaaacttgctcgaataatccttggccttcggagccacggcaatcgccacctgcc

SEQ ID NO: 656481 - DNA, 647 bp, Homo sapiens
ccggagtctacagacacacctgagagtgctcatgttgcatctcatgtgcctcatgtttcgttggacggtgctcaggagaccggctatatcactacgagaggtgctatcgactactaagatttatcactgcatagcccattcggacctgcaacagcgtgcgtcttacttatgcagagtgcgccgaatcctatactcgcttgtctaatgattgtgcatgacctcttacagtcagacatttgctagctccaacactgccgttatagatagccctaccatttctgcctcggcgggcaccttatcatgtgctcacagacactgttggtgtgctctgcgtcatattgcatctacgcagagatgtcatcatgcataactctaaggtgctcattcctgaatatctgaacttcattacacttcatgcagactcacacgatctccctctcatatctcgggtctttatgcgtcactgcattacttacacagttatgttgcagattgtcggccatccgtgctgcgatgactggtactgatctgcgcgttatatacagagatctactatcaacttctactggcggtgcttctagcaacatatagtgtagtcatacacgaagactcttcagatcttgctggcccttatagcgtgtagcact

SEQ ID NO: 656482 - DNA, 98 bp, Homo sapiens
aaaactctggggacgtttattaaggctctggcaacactggggagctggcctgcgtccccgaaaaaaaaagtcagtcacaggggggtctccatctgatc

SEQ ID NO: 656483 - DNA, 507 bp, Homo sapiens
  misc_feature (488)..(488): n is a, c, g, or t
ccccccactgggttcgagttcagtgaggcacagagttggactattgtatatttagttggagccggggggagggcaggagtattatcagataatggattttataccttagagcaaaatctattagtctctctcagtttatcaatttaaatggctttaggcttatagggggtgtaaactttaagaatataattctcccattcaagtttacagcaaacatctagccaccttcaaaacaaagaagatacagaccatcatttagcaatactaatacatgattttccttggggatggcaggtttgagaatcctttagcaacaggacatacttcccctaaattacagtgaattatttataacgagataaagctttcaggtacaagctgaaggtggggtgtctaacaactaaaaactatcactaaatctcaaagagaaagttcttgcaaaatatgtaaagttcacaaggtgcagacattttccttctttaggcttntatctaaggaagggctatg

SEQ ID NO: 656484 - DNA, 169 bp, Homo sapiens
aaaaaaaaaaaatttgtttttttaaaacttaattttttttttactccccattcagcatttccctgtgttttttgcattttcacaaacactgtttttccatcctccttttcctgttattcccaaaactcaccttcccccgtaaatgatatcttttcccccttggttttta

SEQ ID NO: 656485 - DNA, 1072 bp, Homo sapiens
  misc_feature (526)..(526): n is a, c, g, or t
  misc_feature (782)..(782): n is a, c, g, or t
  misc_feature (785)..(785): n is a, c, g, or t
  misc_feature (794)..(794): n is a, c, g, or t
ccacggggcgaccgagatggcggcctccgggggcctagagggaccctgggcgtgcactcgcccttccggctcggcctttagttagtgaccagctcctcggcgttctgcagagcgtgggtttcagcgagttctacgtgccaggtccgcccggtgccggcttcctcgctgcccctggcggctcgtcagcccccactacccctgaacttggtcccaatggcggcccgcccctccttcacccggaccgtgggcatctgggcctcgccgaagccgtcaaggtggctgctcgggcttctagagcccgtgtccagccctttgccaccgaggcctgatcctcttttctgccctaaagaacttgccctgacagcctctggctcccgctcttgaggatcttgcttgtccaaacccagaagacagtgcatgaagccaggggacatccgccatgctccaaacaacttggcctcaggagtcagtgacctttgaggatgtggctgtttacttcacccagaatcaatgggccagcctcgancctgcgcagagggccctgtacggggaggtgatgctggagaattatgcaaatgtggcttctctggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgcagtagnggncttctcagnacgttctcagcacttgattttaaagggagggactgaagcagactttcaatctaaatccaaatctgatacttcggggtggaatgaagttctatgaatgtaagaatgtgggaaatctccggtatacaaaggtattcggccgatgatcataaggggagacccttgtgaggagggaaatccgctccctgatgtgtgttaaacacaggagggccaataaaagggggggttcaccgcaccaaaccgcaacaacaaggggggtgccacaaccataaaggggccca

SEQ ID NO: 656486 - DNA, 225 bp, Homo sapiens
  misc_feature (118)..(118): n is a, c, g, or t
tgaatcgagctcggtaccgttgctaggctggagtacaggtgtcataatctcgctcattgcaacctctgcctcctgggctcaagctgggtcaagctatcttcccacctcggcccccgcnccgagtagctgggactacaggtgcacgatgccatgctcagccaatttttaatttttttttttttttttttttttttgtgtgtttttttttggttttttatttttttt

SEQ ID NO: 656487 - DNA, 790 bp, Homo sapiens
  misc_feature (500)..(500): n is a, c, g, or t
  misc_feature (503)..(503): n is a, c, g, or t
  misc_feature (512)..(512): n is a, c, g, or t
ccacggggcgaccgagatggcggcctccgggggcctagagggaccctgggcgtgcactcgcccttccggctcggcctttagttagtgaccagctcctcggcgttctgcagagcgtgggtttcagcgagttctacgtgccagctcttgaggatcttgcttgtccaaacccagaagacagtgcatgaagccaggggacatccgccatgctccaaacaacttggcctcagatgttttggggattctagtagcccttgggtttgatgacttcagaggagagttttgcaatcagcagcctccagaaatactggtagcgtttccattccccaaacctgctctgatctcccacctggagagaggggaagcaccatggggcccagatccctgggacaccgagattctgagaggcatcagtcaaggtggtgagtcctggatcaaaaatgaagggctagttataaagcaggaagcctctgaagaaacagagttgcacagaatgcagtagnggncttctcagnacgttctcagcacttgattttaaagggagggactgaagcagactttcaatctaaatccaaatctgatacttcggggtggaatgaagttctatgaatgtaagaatgtgggaaatctccggtatacaaaggtattcggccgatgatcataaggggagacccttgtgaggagggaaatccgctccctgatgtgtgttaaacacaggagggccaataaaagggggggttcaccgcaccaaaccgcaacaacaaggggggtgccacaaccataaaggggccca

SEQ ID NO: 656488 - DNA, 324 bp, Homo sapiens
gaccagatcttctgtaaccttactgattcttttgtctaacccatcacctattaagaaaggtgagtaaagtccccaagtatgattgtggatttgattcctcttttacttccattatcttttgctttatacactttgaaactatattattgggtggctatagatttagaattataatattttcctggtgtacctactcctttatcattacaaaatatctttccatcgattttaacacttcttaccttcaggtaagtgtctgaaacgtgtaccttttctctggttagtatttacatggtataccttttatcattcttttaaactttc

SEQ ID NO: 656489 - DNA, 241 bp, Homo sapiens
caaacagccgcccgcaggaagaagcacagctctgagaggaggagctcagacagctcaagcaagtggccaaaagagaaagggtgaagcagaaagagactgtgataacaagaaactcagactggagaaggaaatcaaatcacagccatcttcatcttcaacctcccacaaagaatcttctaaaacaaagccctccaggccctcctcacagccctcaaagaaggaaatgctccccgggatacag

SEQ ID NO: 656490 - DNA, 362 bp, Homo sapiens
  misc_feature (32)..(33): n is a, c, g, or t
  misc_feature (83)..(83): n is a, c, g, or t
ttacaaatttgataaaaggaaggtccactgtnntagaaaagcaaaaaaaaaaaccctcgtaagtaaaatgtagatatacaggncgggtgcagtggctcgcgcctgtaatcccagcactttgggaggccgaggcgggcagatcaccgaggcagcagattgagaccatcctggctaacacggtgaaaccccgtctctactaaaaatacaaaaattagccgggcgtggtggcgggtgcctgtagtcccagctattcaggaggctgaggcaggagagtggcgtgaacctgggaggcggagcttgcagtgagcggagatcgtgccactgcactccagcctgggcaagagagcgagactgtctcaaaa

SEQ ID NO: 656491 - DNA, 260 bp, Homo sapiens
gggttttttgttttttgggggggtttttttttttaggggttagggccccagggtttgaaggagccccctgtagtctctttgatatgttcagattttccagaaagagatttaagtctaaaaatttattaagggaattttaaactatttcccccaaggggcccttagcctctttaattttatttaggattcatgaattaatttatgggcctcttatttgggggtaataggccccccctctttaccaaataagttccgaaata

SEQ ID NO: 656492 - DNA, 108 bp, Homo sapiens
atccacccgcctcagtctctcagagctggtgcgattacaggcgatgagcaacgattgcctggtcccgacctttgcttaacacttccggacacaccttattcgtacacg

SEQ ID NO: 656493 - DNA, 135 bp, Homo sapiens
tttcaagagaaaggttgtgtttattttctgaaatgagcacaaagacacctttcacaataacactgaaagcaggtgcaaagactggatagggaccttgactaaggagcttcgaaaaagcagccgcatttagattga

SEQ ID NO: 656494 - DNA, 148 bp, Homo sapiens
tgatgacttagtttttaagcccgtgaaaaaaaaaaaaaactctcggtggcaaggttgaagtaaaaatgccgaaaatgaatggaaaaaattggagcaaaaaaaggttgattacaccggccccagggttcaggcaatgcaaataaatgta

SEQ ID NO: 656495 - DNA, 624 bp, Homo sapiens
gggcgagacttgtgcgaaagatgcatcaatcagatagaatatgcatgtctatccacggcatctattcgtgtagtgtcagagccctcctgaacatcgtggtccagcctggatacattagtgttctattgtcgtagaaaaagagagtttgctgtgttccagtttgggtagtcgtgtggggatagttgacttgctagtggtcctaggtctcactctgctcatcaggatgattcgggctagtccttctatagacagagaaagaagtctatgacgggcattacactgggccgccgtttataaacagagttagtcaccagatgagcaggctcctcggaagtcccccctccgacactgagggtcttgtaaagagtctgccttctggatcccaccagggcccagtcatatatgcacagttagaccactccggcggacatcacagtgacaagattaacaagtcagagtctgtggtgtatgcggatatccgaaagaattaagagaatacctagaacatatcctcagcaggaaacaaaagcaaactggactctcgtgcagaaagtgtagcccattaacacatgtagcctggggacccaggcaaggacaagtcacgtgtatcacagaggagagaag

SEQ ID NO: 656496 - DNA, 356 bp, Homo sapiens
gctgtaatggggggataggaggagaacgggggatcggtgtatgaagatgagggtgtttactcgggatgaatgagaggtcataggtagtggaatgtggtgggtgagtgagccccatggtgtcgtggtaaatatgtagagggagtatagggcggtgactagtatgtagagtcctgtaagtaggagagtgatagtatatgtgtgtcttataattcaagcacgtcatattacctctgatgacttacaatttgcttcggctttaaaggctcacagagaagctgccgtccatgtgcttttcaaaggcagccaagagcacgtgggcgtggccagtcacttccaccacatctccttcgacgacc

SEQ ID NO: 656497 - DNA, 183 bp, Homo sapiens
gggcggcggctggatgataatgtgaacatctggggggacaaattctttcaggttacagcacaactttgacacctatgatgatagcttaatcacagactcaataaaacctatgattatgagtctttgatgcactaacaggctttctcatttaacaagaatggcagtgttcccaggcccgggcgg

SEQ ID NO: 656498 - DNA, 104 bp, Homo sapiens
catggtgggcaggctgttcagctgttgatggcatgtccgggcacaggtaaggtggcatcatcgggggtccctggggccggaggggctggcctcctctgtgctgt

SEQ ID NO: 656499 - DNA, 208 bp, Homo sapiens
gacgcggtctccgtcttctccacaagaatcaaggtactgtccagtgaaagccacaactccttctgtttgggggcagagctctcctcacttcagcacatggcacatttatagcccaaatgccctggaggagaactgctcatcagtaagccctggacatacgtgaaactcccagtcaggattctatccagacatccaaataaaataggcc

SEQ ID NO: 656500 - DNA, 242 bp, Homo sapiens
ctgcagagcggctcatggtggagcaggccaggacaagatgggtgggtccaggcctcagagaaggggacatataacagaggcatgctggagcgatagacggtgactctgagttcttgaggggcgccggccctgactgtggatgtgagcaggaaggagcagaggtctctgggcaggacataggccccatagtgctgatgtgcacttgtcctgtgacctgggcagagactgggtcccagcatctg

SEQ ID NO: 656501 - DNA, 894 bp, Homo sapiens
  misc_feature (552)..(552): n is a, c, g, or t
  misc_feature (611)..(611): n is a, c, g, or t
  misc_feature (690)..(690): n is a, c, g, or t
  misc_feature (735)..(735): n is a, c, g, or t
  misc_feature (858)..(858): n is a, c, g, or t
gatgcgagcactgcggctgggcgctgaggatcagccgcttcctgcctggattccacagcttcgcgccgtgtactgtcgccccatccctgcgcgcccagcctgccaagcagcgtgccccggttgcaggcgtcatgcagcgggcgcgacccacgctctgggccgctgcgctgactctgctggtgctgctccgcgggccgccggtggcgcgggctggcgcgagctcggggggcttgggtcccgtggtgcgctgcgagccgtgcgacgcgcgtgcacttggcccagtgcgcgcctccgcccgccgtgttgcgcggagttggtgcgcgagccgggctgcggctgcttgccttgacgtgcgcactgagcgagggccagccgtgcggcatctacaccgagcgctgtggctccggccttcgctgccagccgtcgcccgacgaggcgcgaccgctgcaggcgctgctggacggccgcgggctctgcgtcaacgctatgtgcccgtcagccgcctgcgcgcctacctgcttgccagcgccgccagctccagggaaatgctangtgagtcggagggaagaccgcagcgccggcagttgtggagagtcccgtcctgtctccangcacgcaccgggggtgtctgtatcccaagtttccatccccctccatttcaaagatatttatcatcaagaaaggggtatntttaagacagccagcgctacaaagttgactacgagtctcagagcncagatacccagaacttctcctccgagtccaagcggggagacagaatatggtccctgccgtagagaaatggaagacacactgaatcacctgaagttctcaatgtgctgagtccaggggtgtaanattccaactgtgacaagaaggatttataaaaaaaca

SEQ ID NO: 656502 - DNA, 185 bp, Homo sapiens
  misc_feature (11)..(11): n is a, c, g, or t
  misc_feature (86)..(86): n is a, c, g, or t
  misc_feature (92)..(92): n is a, c, g, or t
  misc_feature (163)..(163): n is a, c, g, or t
ggagatagggnactgaggctcccgtgaggttggaatcgacttcaccatggggggccctcagccagcatccagctccccacccccangctggnagtaggactggttagatgctgtatttccacccaaatctgggtatatcagtgtgtcttggagaatcttggancattaaagataaacatattttt

SEQ ID NO: 656503 - DNA, 146 bp, Homo sapiens
atcggttacagatgaggaagtggatgagctgtacagagaagcacctatgacaaaaaggggaatttcaattacatcgatgttcacactgcatcctgaaacagtggagccaacagacaaacgatgacgtgaaaggaacttatagctaa

SEQ ID NO: 656504 - DNA, 143 bp, Homo sapiens
cgcataattataccatggactaacccctataccttctgcatatgaattaactagaaattactttgcaaggagagctcgcagcaaaagactcccgataccagacgagctacctatgaacagctataatagcacacccgtctatg

SEQ ID NO: 656505 - DNA, 247 bp, Homo sapiens
aaaaaagaattcctatcagtgttgcagaagtttttgcaagtataatgacattttaaggtttgttaagtattccaaccaaaagaaaataatggaatgggggcttaggtggaacaagattggcaaaatattgattattttttaaattgagtgatgggtacttgtggcttaactatactgttctgtgtacttttatgtatgtttgagaatattcaaactaaatttttaaaaataaattcactgatggtaa

SEQ ID NO: 656506 - DNA, 141 bp, Homo sapiens
tagatgtggctataaatgattaaggatacgtagatataagagatcaggttcgtcctgtactgttgctgtatggctatcattcgattttgaggttagtttgattagtcatagctgaggctggtgtaagattactcgtacaca

SEQ ID NO: 656507 - DNA, 104 bp, Homo sapiens
tatcagctggtcatggcactcagaaacggcgttgacgtaatttaggacgtgtcataagcgaaacagcacactgtttgaataagagcgagtcgaattggcagagg

SEQ ID NO: 656508 - DNA, 547 bp, Homo sapiens
  misc_feature (142)..(142): n is a, c, g, or t
tcctgtgccaagtcccctccccggaataaattgccccaggagtgggagaacacaaaaaacgccctcctcacctacctggagcaggtgcgcatgggcattgcaggagtggtgagggacaaggacacggagcttgggatttctnaccctgtcattcccgtggatgggattaaccataacgtgaccccggcgtggggcggggattattggggttttttgaccccaggggattacatggtgactgccagtgccgagggctcccattcagtgacacggaactgtggggtccccttttaaaagggccccttcccctgcaattttgtgttccccaagactcccaaacaaagggtgggcgagcttttggcaattggggccaaggtgcccccggaccttttcaggggcctggagcggtttaaggggacaaaaggttttatacctgcggttttaaagccctagggcagggtgggcctggcaagacgggaaggggaaaagtaaagagggaggggcaaagtgaggaaaaggggttcttttaagctcccgggccccttta

SEQ ID NO: 656509 - DNA, 733 bp, Homo sapiens
  misc_feature (201)..(201): n is a, c, g, or t
  misc_feature (529)..(529): n is a, c, g, or t
cgtgtaagagcaagggatctcgtcccggggagcccggtcctcttggagggagggcttttggcttttaccatgtgaagctaggttgcccgcctcggggtgggcctgtttcttatacttctcatgaattcttattcctccaccctgacctttcacaaagggtgaattttaatcagcgtggtttttgccagagagattcagganaattccgccccattttttgccaatgttatttcttttgcgcttttccatgctccttccttctttttcccgcttccttaatgggatttagaccctggccaaccttttttaggacccagagggaaggaagccccatttccaaaaagcccaggggttttatattgaccccatttcccccctaaaaggggtttgaggaaatgcccctttttcccaaaaatggcccctgatttccccgggttcctttttaaattagggaacccgaggattttatgtttttttttccggggggcgggaaattgggtttttttaccgggtggttcccggtttcccngcccccccgggttcttttttgggggccgggtttccaaacccctttggtttttagggtttttaaatccccccccgggcctggggcccgggggtcgttttttgtttgggggttttttttttcccatggaatctttaaagggggggccatttgttttttggcccctataccctgttttccaataaactgggggtttggtccagttta

SEQ ID NO: 656510 - DNA, 344 bp, Homo sapiens
gttagtgcataccgtgggactacaaacgtcactgtaactgccttgaggacttggatattttttttttttacagtagggaggaggaggaaagttgtctaagagcgaaaaggttacattaaaaatcctgaagacctggagtacaagactagccgggtgaccatggtgaaaccccgtctctactaaaaatacaacatattagctgggcatggcggtgggcgcctgttatcccagctactcggaaggctacggcaggagaactgtttgaacccaggaggtggaggatgcagtgtgctgagatcgcaccattgcactccaacctgggcaacagagcgagacttcgactc

SEQ ID NO: 656511 - DNA, 648 bp, Homo sapiens
  misc_feature (11)..(12): n is a, c, g, or t
  misc_feature (39)..(39): n is a, c, g, or t
  misc_feature (43)..(43): n is a, c, g, or t
  misc_feature (302)..(302): n is a, c, g, or t
  misc_feature (307)..(307): n is a, c, g, or t
  misc_feature (464)..(464): n is a, c, g, or t
  misc_feature (474)..(474): n is a, c, g, or t
  misc_feature (501)..(501): n is a, c, g, or t
  misc_feature (517)..(517): n is a, c, g, or t
ttcttggaaannctgatgatgagtagggacaggcactgngttnggctccctgagagtgttgtacgagctgttgataggcatctccctccacacctccggggtccaccagcggaccgtggactgcactggcacggcctggggcttgttgcagacggtttactaggtgttggggctgcaggaacctcaggtgtctgagaaggtctagcaccgggtagcctaggaggtctttgacttatcaacctttggcaaccagtaagtaggcatcccgcgggtggagctgcttggtgttgtgaaagtgcgtnggtanggtctgccctctcagcagcagatagaggtcgctggcccagtgtcctagtccctgcggcacaagtttcgaggtgtgtcctgcgggcgagaggtcgtcttagtggtgtcctactttttgcggcaggtgtccatattttggcctctgttcccgactacgncaacatagtntttcgaggctaagagcgcttggacttngcagtgggaccgggtntgagacaacaccctggacagctccctccaggtcgcccattgatgcttgcaggtgccgcaacccctgctgtgttggttatgagtacatgtactccctacttttataggggatcgtcacttacgatactagac

SEQ ID NO: 656512 - DNA, 795 bp, Homo sapiens
agctccagtcccgatgcagaaagaggtggccggggagaaaggagccgtcccagctgcgtcaggcccaagcctcccatccccgccaaacctcagctgcccgcacgaagtctacacaatccctgtgtccacgacaccgcccggccccacgcctccaagccctccaatcctatctacaatgagcctgatgaacccatagctttctaataccatgggcaagcggcagccctggggaagcccccagcaacatctaatgtggaagtggaagatgagggcctacccgccactctttcgggcaccctgtcctgacggaagagcatggtccaaggcatgtcccaggaggccagaataacaggtggctcccagctgcattctgagaactctgtgattgggcaaggccctcccctgccccaccagcccccacccgacctggagacacaccgctcccgccacaatctttctagacaggtgcttcaggacagaggacaggcatggcttccccttgggcctcctcagtaggctggtctaggccatcgacccgcctaacaaagtaagcctggaggtgcagacgaagcaaatgcggagcctgctccctcgctaagaagagtcccaagaatccaatggcatcagtcactcggtgatctaacacagcaaagaagtctgcaaggagggcccagactagctcccacatgtcctaggtttcatcctccctggagtctaatattccttggccctctgagccttttgagtcatgggacctggtccaatgctgactgttgtctgaggaatggatttggt

SEQ ID NO: 656513 - DNA, 1289 bp, Homo sapiens
tgggggaaaatttttccatctttttttttctctctccaaaaataaaaggtggtgggtgtgtggaaaaaaaaaaaaaaaaaaaaaaaaaaaaaaaaaaaaaaaggggggggcaccacaaaaaatcccccggggggccccactacgagcgcgcgccccccgcatcttatattgtgatgagaacgaagagagggggcctccaaagagagagagaggagctgtttacttagaagagagagagagagacgagggggcgcgcgggaataaaacaagacggggagggaggggagaaaaaagagcggaacgaagggggagagctgtggaggagaaaagaaacccttcataagtggggagggggagaacaatatgggggagagaacaacacacaccaccaacaacaaaatacaaacgcacccagaagagagaaaaataataaaacttaagagaggcagagagaaagaggtgcgggaaaacacaacagcgcggaaaataaagcagagggagaggcgggagagaagaaagaggggagcggcacagacgcgagcaagatacggaacaagagagaaaaaatattataaaagcgcaggggcggccccccccccccacctaaaaacaccagcaaagagaagagagaagaaggagaggaggagaacaagaagaagagagaagaaagagaaagaagaaaaagaaaggggaaagaggagagaagaggtgaaaaaaaagaagaagagaaaaggacaagagaaaaaaggagaaaaggaagaagaaaggaaaaggagaagaaaaaaaaggaagcaaaagaagaaaagaacaaaaacaaagaacgaaaaagaaaagaaagaaaaaaagaaacaagaaaaaaaaaaaaaaaaaagagaaggaggaaaacaacagagaacaaacagaaaagagaagaaaaaaagacgaaaaaacagagaaacgaggaagaagacaaaaagaacaaaaaaaacaaaacgaaaaaaaaaaaacaagcaagaagaccggaaaaaaggaagacagcagaaaaaaggcaagaagacagaaaaagagaaacaagaacgagagaaatagaagagaaaaagaaacacgaaggaacggagaagagaagaggagcagagaacagaaagaagcgagaaggaaaagaaagaacggaagagacacgaaagagacagagagcaagaaaaaggaaaaagagacaaaggagaagaagagaaacacaaaaaaaagaaaagacacagaccagaaacaaacaaaaaaaaaaggagaaagaaaaacaaaaaaagcagggaaag

SEQ ID NO: 656514 - DNA, 356 bp, Homo sapiens
tgttcagagtgctatatctacatcttatgttagtcccgcattaattagccattgactccccaggttagtatacccgttctcatctggcattatttacagaaccacattttaaaccattggtaatcagatatccacttatgccttccagaatataaacactactgcctgacacaaatcgtgtgataagcaacaggctgggcctaaatattttgagtaattgttctgattcgcctagataagaaccctctacatttagtaatgctctacttactctcgctgtatctttgatgctggttaagagctcttgctcttgcatgacattctcagatttagaccttgttttaatttttatgtat

SEQ ID NO: 656515 - DNA, 111 bp, Homo sapiens
caaaaagaacctttattactttttatgatgggcgtgtgataggtggcgcgaagaaccttgggatcagaggcatggggggcagtatcatagtcccccttctgtcgtcttctc

SEQ ID NO: 656516 - DNA, 338 bp, Homo sapiens
tttaggggtttttcccccccccaaaggtttctttttgaaaaacccctcctttgaagccccccttttttttaaatttcccttattttttatttttcggggcccccccattttaagttttttttttcccccctttttttttttttttttttttttccaaatgggggtttttttcccgtttttgggggcttttttgggggggctttcttttggtttccccctggtttttttttttttttttaaaaaacccctttttttccccaaagggtttttttccccccccccccccccccccttcttagggggggaaaaaccccccccccccccccccccccttttta

SEQ ID NO: 656517 - DNA, 692 bp, Homo sapiens
agacctaatttggaaccctccaccgttctcccccatcctctgctccttccgctatgaaaaatacatgcagttccaccctctccccccctattgaataatctccgcgttcttttttctccccccctctccgcttcacaatatattctttccccccccctagttacctctctcccccacagatattgagaaagatagtccctcccacccatgtgtccctctcctctcgatgagcttcataatagataatatcccccctcgcttctaatatcttctatagcacaaacagtgaccaccacgcgtgagtatatatgcaatatataaatatcacgtgcgtaccattcatcatctcttagtgtaacaaaaaaccgcgcacactctttaagagacgcttaatctcatcctctactatagagattcgttatttatgtaaatttctgtgtagaacacaccccctctcctctatgtgtacagaacaaagtgtggtcattatataaccgcttccccttttgatattcttgggggtgaaacaggggtcttcttgacaatcttgccccggcattccagcatgttcgccccgccgtaacatgtggacagaccatggcattagagacgcaccgaccgccgcggtcgccccttgtcgccccaacacccagcgggacgctctctgcaaatctccccacaaatagtcgaga

SEQ ID NO: 656518 - DNA, 129 bp, Homo sapiens
ttattaatggttaactgctaacctaaaagcatctatctttgtaggcctatcatctatcttttccgatatggtccttgcccgtaaatacctacacgtacgcaactggtacgttggggggtacctgagctc

SEQ ID NO: 656519 - DNA, 177 bp, Homo sapiens
cgtccttcatcatactaccagaggggatgcatgctggagaggatgctatggtttgaatgtgtcccccagagttcatgtgttagaagcgtaatccccaatgcaacagtttttgaggtggaacctttgagaggtgactaggccggctgggcggcgtaattcacgcctattatcccagca

SEQ ID NO: 656520 - DNA, 1033 bp, Homo sapiens
gggcagttgtgagaagcgccgggacgccgagtatgggcgccagcccggagcaggtggcagagcaagtggcgatgacgcgactcagaaggaggcctgggtggagaaccacggtgggacagcaccatggaacagtggtgggcggcgggaggcagtgctggccggaagccccgtcaagtcgggctatgaaggagctgggcgtgttcctgggacgaacggtcactgagcaggcaccggcagatgagggcatacgggtggccaaggcagtcacctctgagtcctgtgagtgagctcgcaagatagctgggatcacacccctgtccaggaatccctggcaacaggcaactggaccgaggtccgtgtgagcagggatctccgaccatgcgccattccaggatgagcggggcccatctggcagcaagcttctagtccctggacatctcaccaagtgtgacaagcatggcctgtacaatcgcgtcagatacagtgcaagatgtctctggaacgggcagcagtgcgggagtgctggtgtgtgaaccccaatcaccgggaagctgatccaggaaagcgccccagcatccaggggggaaccccgagtgtcatctctgtctacaagtgaggaggaggaggctcgcggggtgacacccaggcggatgcagtagaccgcagacaggcggtgcctggggacccgtggacccgccggcacatctacaaagaacagtgcaggaaaacgggagtagatgatcggggagggagcgacagaaggagggagatgaccagtacagacagagacgaattagcaatggggaactagagcaagaaagaatagacacaaacgcggcaccgaccacctaccatgaggggaagtcgaccaggcatgaaccacgttgccctcaccaggcaagaagaaagggagactgagaaagacacacaggagcaacacgggaaagagcgaaggccacaagaaggtaccaccccggggaccataggaagagaccgcgacacgagaacatcgaccacaaagagaggcaacagg

SEQ ID NO: 656521 - DNA, 209 bp, Homo sapiens
ctggagatgactcactcactcattccacctagacagaagcaagcaaaatgagatgaaggcaggcctgggcggagagtgagacatgtactttcccttgccaattaggagacaggaaaactaatatgagagcctcagaggctccctgggccagtaatattacagggaaagggtaagggttgaggtggggctagcaaaccctctgcgtgtca

SEQ ID NO: 656522 - DNA, 292 bp, Homo sapiens
tcctgcaaggcctctggagatttctttaggaccaatgtcttcgcctggttgcgacacgtccctggacagggattcgagtggatgggagagatccgccctgtttttgatgtcataagggtcgcagagagattccagggccgagtcacattgatcgcggacgtttccgcgagcacagcctacatggagttacatcgtctgagcctcgaagacacgtccgtctacttctgcgcgacaaggactccgggcgacggctggcccttcgagttctggggccaaggaaccctggtcaccg

SEQ ID NO: 656523 - DNA, 986 bp, Homo sapiens
tcgaggacttcgtcaccatgacagcttctcggatgctatgacccaaccgatcatgtggagcagtgtgatgtgcaccatgggaaccatttcactggacttcttagagtgacgagaagtatgtggacatctcttctttatcctgtccctctagaagaacattctcccttgcttgatgcaacactgttccaaaagagggtggagagtcctgcatcatagccaccacatagtgaggaccggggctgaggccacacatatagggtgacctgatggacgcgagcaggatcgacgttgactgtcctgatggccatgagcagtctgagtggcacagcctggaccccaaggagcagcgtcacttgtaactgcgagtacgtgtccagatccagctgagctccacacactgactgccagtgagttgcagtgaaacactcgcgacatgttacctgtagatacactgtgctatccacatcacccacgcgccactaccatgatcaaaaccagacgcccaattcatacatccaacaagcatggacattctcgaacccaacgccatgagtagcacgactcaatgtcctacatgggacccactgctgtgacctgcgcaataccatggctcaaccgacgcccaattaaagaaacccccaatggactggctggatcaaaccatacctaagaccatgaccctgcgacgcacctgggaccaccattgtcatccaacaccaacacaacataatgtacatcccacaatgtgggcaaatcatatatgtaggacatagcgggacctttcacttgctcccacaatctgtgcaagaacaaggggggaaccacaccattacaatacggtgcacactgtgccaacgacgaattactcttgaaatctagcggaataataacagcgacagtacccaaaggaagaaacacagctagttatccaagcaatttaattaccattgaccacaaaatcaacttcatacactcacacaactgtg

SEQ ID NO: 656524 - DNA, 196 bp, Homo sapiens
gctcctctaaaaaataaacagcaaggtgagctgctcacacctgttaatcccagcacttgggaggctgaggcaggtggatcacttgaacccaggagtatcacttgaacccaggagttccagaccaacctgggcaaagtggtgaaacctcatctctacaaaactccatctctacgaaaaaaataaaaaaaattagcca

SEQ ID NO: 656525 - DNA, 180 bp, Homo sapiens
agcactatcccactacactctatacaacatattttgtcaacaagacccaacactgactaatcaactaaccaccataattacccccatactccttacactattccatcatcacccaacataaacatttcaacacaaactaccacctaactccctcaccaaagcccatcacaataaaaaaaa

SEQ ID NO: 656526 - DNA, 178 bp, Homo sapiens
actgatcctatcgggtatagaagataagggtcatgaaggtaaagaaaaacgttaaaattagccaggcatagttgtgtgtgcctacagtgctacagtgaggctgaggcaggagaatcgcttgaatccgggaggcggaggttgcggtgagccgagatcgctccattgtattccagcctgg

SEQ ID NO: 656527 - DNA, 302 bp, Homo sapiens
ggcattatccctttattgtttttttaacaaaaactttttttcaattattttattgcaatgttattttgagcaagtcctatgccaaaaattttgtataatgtttgtatggaaaattaaattttactcttgtggggtaaaactatttcagttactgattttaaagttggaatttgatattccagcccaaagtccccagggtattcaaaaatccaagttggggtcaaacatttcattttgatgtgaacttttttttgctttcctttgttttaaaactcccttttgcaataaacgttttgccagta

SEQ ID NO: 656528 - DNA, 630 bp, Homo sapiens
  misc_feature (66)..(66): n is a, c, g, or t
  misc_feature (196)..(197): n is a, c, g, or t
  misc_feature (501)..(501): n is a, c, g, or t
  misc_feature (518)..(518): n is a, c, g, or t
gagtgaggagggagtgttatttccttgggaacctagggaggagaggttccttcgttgggaaacttncgttgatagctgctgcctttgtcctgatcgttttctttcccttttctctggtggcctgttgtggtgcaacgagctgatggcatttgatcttgccccattcaggttggggagtgaagtgtgaggacccttnncccccgcttgctgtgaaagcacagattcattgactacagcacactgttgctcagaaaagaaggctgcaaatgacttctgagactttatgtcttttcttccagaccaaggaccgtaggaaggagtcacatctagccggcttagccaaagtacaggtgtatttgttcagggcacttgatttagatttggagggggtggggtggacagagcagcaagaggcgagtaaagagaatggtgggttcaaagatctctcttcccaaatgtgttaaatttttcttctcccagattagtttaattagaaattanctggctgctttaatcgngggtatgtacttatctttttagaaggttcggcgccagaagttttctttcgactaatttgttttcttaggagcaacaggagaaaatttaactttggacttctgtctttcacat

SEQ ID NO: 656529 - DNA, 131 bp, Homo sapiens
tacaggatcttaaattgaggtcgggtggggagcgagtgacacattgagaatgtcaaggcaaagatccaagacaaggaaggcatccctcctgacctgaaggttcgagccacacctccacccggactcaattt

SEQ ID NO: 656530 - DNA, 211 bp, Homo sapiens
taacccacttgtagttagtctgtttcacactgcttataaagacctactcaagactgggtatttatacagaaaagaggtttaattgacttacagtttcacaagactgggaggcctcatgaaactttagtcatggcagaaggggaagcaacatgaccttcttcacatgtgcggcgaggagaagagaaatgagagcctaacaaaggggggcaaa

SEQ ID NO: 656531 - DNA, 925 bp, Homo sapiens
ctcttaagtatagaggtttgtatctagaggatctcagttcaactcctgtctctccatataccagcaggtaactgtgaataacatacttaaatggctgtgcttatttccttttcttttcttttttcttttttttttttttttggaaatgaagtttggctctggtcccccaggcgggagtgcaatgggcacgatctcggttcactgcaacctccgcctctcgagattcaagcgattctccgtgcctcagcctcccaagtagctgggattacgggtgcccaccaccaccccgtggctaaattggtatttctcagtagagacggggtttccccatgtgggttaggctcgtcgggaacctctgacctcaggtgatccacccgcctcggcctcccaaagtggcggggattacgggcgtgagccagggcgcccagccgggtgcttattttcttaaaataatttttggttttaaaaacttcacattaaataagtgctaaggtctatggcatagtagggtgactagaagttaacaataccctatggcatatattctggaaatagctagaagagaggatttcgaaagttctcaaccccaagagtaatgactcctattgcgcggtgcgggttctgctaattaccccggctgcgggtatacggccagtgtcctggttttcctaacctttccgctggctgcccctcttaattgttgtgtttttttctcatgtggggccatgaaaaggcagaatgaaagcaaaaatcatcttcttctaaaaaaacagtagaagagatgcagaacaaaacacagaagagagagaaagaaacgggtctagaaacagcaggtagaagaaagagggagcgggataacggttccaagaaacaccgccgtgcataagcagaccaagatataaataaggagacataaatgaaaaga

SEQ ID NO: 656532 - DNA, 264 bp, Homo sapiens
atgattgcgtagcttccgaaatacttgctctaggtggacgaccacgacactactttctggaccgctgtgactgacgttgtgtgatgcagatagagcccatgtgctgtctctccaggacacgtgtgtggcgttgcagagcagaaagcaatgaagtccttctccacgtgggtcttgtcaacagcatcttcctccaggttctcagatgactgtgcagaggccacttccaacggactgctggacgacactcaccttggttgtgcatct

SEQ ID NO: 656533 - DNA, 169 bp, Homo sapiens
atgatgaagtagttgttgcgaatcagggcaactggtcggtggcgcttcatctcggtcctcaggccctgcctcggggttgggcatcagacgtggaggtcccagctggtccagctgtaccacgtacccctccatccacgtggtgagaggatcttgcttgaagtatgtagta

SEQ ID NO: 656534 - DNA, 89 bp, Homo sapiens
tggagacgacgtgcagaaatggcacctcgaaaggggaaggaaaagaaagaaagatagatgcagagagacctgggaagtgactcaggtgt

SEQ ID NO: 656535 - DNA, 248 bp, Homo sapiens
gagaatatgagacccagaaagatcacgttgtctagagaataccagtcgtagaagtccatgagcattgtcggatggaatctcccatcaccgataggctgccatgaagcaaaaccgccaggccgtagtcgatctctggcaggctgctcaggtcggccaggtcatactcctcagggtccgctgacatgcctcgcatcccgaagcgatgggcgtccttgaacagcgaggtcaacaaacatcctctgaaagtc

SEQ ID NO: 656536 - DNA, 1032 bp, Homo sapiens
  misc_feature (463)..(463): n is a, c, g, or t
  misc_feature (477)..(477): n is a, c, g, or t
gtgctgcgcaaacgggtgggacttgtccactcagcacgcgtgagtcaagctgctgaatggcaggagctgctacccacaaccgccgtgcgggccagcaaagccagtctgccacgcacattaccagaggataccgaatgaagcgagtcctaacgaggtcgactgtagctccctttgcgagattacatgcttgctgttgctagcttaacacactacgtccgaggtaagactccagccggttgctcaggataactcaagctatgaggaacccttgtcacccaatctcagcacagcttcatcttacttcctcgctcggctgactaaggccgagatgggtaccctgggatgctcccctgaacatgcgagtctgctaggaccttaggtaggggcattggagagcaaccgacgtatcctgtcgcaacgttgagctccagcctaatctggacactcgtagaaggaacgctcntagcgacatttcantcccggcgtcgtcctgtccaagggcctggccatggaaggactagtcatcgagtgaaagttcgcgctgtcccatggtcaaatcgaagcggtgacggggtctccttgcttggcgtgcctcatacggcatgcgaaccatcgcatgcattgcagtgcgccgagtgcagacctactcataggcttggaggacctctgcccgtgataagattcctagcgcccgtcaattcatgtcattggcatcaaggaacttcgctagagggtcgtggctgagcacgtgccagtggagttcttggtcgcgcaggggcgtcactcactcaccgacctgaatgcctagcagcccagaaccagaacgaatttccttgtacgtggcgcccaggacaacgtgggggcccgtgtttgtgtaggtggccaagggtggcctcgtgccccgtagggtgggcgacttagcctggcttgcacgcgcagggtcctcgtgcggtcactcgttcctttccaattgggctcctccaattggcgccctttttccatttcctggtgcgcgacgtggcgcacgcaggg

SEQ ID NO: 656537 - DNA, 1014 bp, Homo sapiens
tgggcttctagaagggggttaaagggggtgtgctaatagggttaaattacgggcccatatttcaaagattttaaggggaattaatttctaggacgagtgggcattgaaacgtggtggtttgtgcctccacagaattacaaagcatgtgaccggtagttattaccccgcggacacggtgttacacgaggtgcaaagtgtggctatgaggatatatagacacgttcgcgggacaattgtgactatcgtggatctctaaacgccatacagtggtgcgggaccgacgcctcacgtgaagtgtgccacaacagcagtactactctagggtacaagtgtctaaatatattatatctaccaacactgtggaggggcccattcccaactcaggagaagattaacccatcacctcgaacttggtggtcacacgctgtccccaacgcgcacgatctccccccgagtcactccccccgtggtctcctcactagagaaaacatccacgtggggcgcgaggcaacaagcatcacgatcgcacccacggcgacaccaccaccgcgccaccacacacgaccacgcaacctaccgcaaccacacgcaaaaaaatcaagagcaccgcctccagcaccacccacaaccacaacccgcaacaccccaccaaccaccacccaacagacggccggagacgaccccacaaccacaagccacacaccaaccccaagcgcacacaccaccacgcacacacgcagaacccgccccaagccatccagaacaactcaactagaaacaaccccacgcgcactacaacagggtaccaccagcgcagcaattacgcgacgaccaaaccgcatccccactgagaccgccaacacgcagcctgccacacacttccaaacgcactactaaaatcgccgccacgtggcaaaccagcaccactagcggagaccaacccacctatatgcaccacctaacccacaagcccatccgcaacagccacaacgaatcacagcacccgccgctagt

SEQ ID NO: 656538 - DNA, 502 bp, Homo sapiens
ggttcgggtagccacctgacctgctaggtagggccgtgttcggatgattcgaccactcctacagtcctcctctcgcatccaaactgcgtcgcgttgttctaggaagatgatacgggggcctcgtccctagccagcaaaaggtttgcacttcacctctcccgcctaattgtagttcctaacgtagtattctaacgtttgaccgcacccgtttctgagcctgcagccttcaccgtgtggccttgagggcctgtcgagtgagctgccccagcccctcccagcccttgcccagcctgggggagtggggaaggcttgggcatggcccccgttggaggattgatttgctgattttgtttcttgtcctttgtgttctgtggtacttgctgagagaataaagagtaagtgagccaagcagaaggaggtggagttagcggacccaaactcgagtgtgcagtgccccatgcctttcctggtagtggtgggaacccttatctgcaaagatacg

SEQ ID NO: 656539 - DNA, 120 bp, Homo sapiens
ctgcttatatacacctcgtgtgtgaagtggaggtgcaggtggcattagtgaatgaggatgtgacactgtaaagttaggagatgatttcttccccgccccccccctttttttttaggaaac

SEQ ID NO: 656540 - DNA, 225 bp, Homo sapiens
cgtgtgatggacgagacgactcaaaaaaaaaaaaattgggacaaatggaagagtgttttttctcatcactgggtattttctaaaaagaaaataacagcagagataagaaatctaatacaaaaggtcgtattcatcttatgtcctcttcttggaggtagactaaaagagcatcattatatgggaagaacccaagatggaattgtccattgggcttgggagatttta

SEQ ID NO: 656541 - DNA, 92 bp, Homo sapiens
aaaaaagcggcgcgaatcgatatcagctatcgatcgtcgactcgaggggcgtacatgctatagtgagtgatacatcatgcgtcgtacacgtg

SEQ ID NO: 656542 - DNA, 478 bp, Homo sapiens
gcgattctgcggacgcatccctgaggagagtgccgatgacggacgaactacgaccctgacaagacgcatctcgatctgctcctctgacaaacgacttgcctgtgaggcagagtctccgattctagaagaggagggagaggggggccgcaagaactcttccaacttcaaaaaagccaagagagtcaaaacagaggatgaaaaagagaaagacccagaggagaagaaagaagtcaccgaagaggagaaaaccaaggaggagaagccagaagccaaaggggtcaaggaggaggtcaagttggcctgaatggacctctccagctctggcttcctgctgagtccctcacgttacttccacaagccctcagattatatattttctatttctctgtgtattaatataacaatttattaaatatagatatccccagggacagaaaccaaggcccgagcttcaggcagctgtgctggtgagctcttc

SEQ ID NO: 656543 - DNA, 840 bp, Homo sapiens
taatgggtctcggcatcccagcccattgtgccgggccgacgttttggcacttgcgggattccgtgtgtgcaagaccactcaggccggctggacgggctccggggaccttccatgattggcagcccgggttttcaagaaggagaattgtccttgtgtctgaccggtggccctgctccggttcaccacaaccaagccggttgttccttgccccgatggaccccagagcccctcctcagccctgtgccacccccttccccaagcccatgcattagccagcgacgcttgtaggacgtcactctggctgtaacgtggcaactggtaggttgggacaccagggcgagaagatcgcacgcctcatctggacaatggctgtgtttgcagcctgctttagtgggaccgccccgagcctggctgcccctcatgtggccccaccccatcaagggaagaaggaggaatgctggactggaggcccctggagcccgatggcacagagggtgacagcttcctttcctgtgtgtgactctgtcccagttcctttagagaaaatggatgccccgaggactccccaccctggcttggggtccagaaaccagcccgccagagttaggggccttagggcaactgggctgttgttcccttgagccgactctggccctggcccttacttgcttttttagctctctaggcctttcccgtttgtgcaccgtccccaccctccaatcagctgtcctgcagccaacatctccaccctccaccttccattttccccccctactgcagcacctccaggcctgttgctatagggcctacctgtatgtcaactacccacagctggagcca

SEQ ID NO: 656544 - DNA, 478 bp, Homo sapiens
gcttccgccatctatcgtgcacgcaatgtggccgctccgctcaacagcaaaaagaacaaaaagagctctctcaatccatgtgccacattagaagagaaatgctatgactgtggttctcccgaccgcatatgtatgcattaaccatttactataaaaagatgcgcaatatgcaaactatggaagtcatcatcattaatgaatctttaggcttctaattgtttgcggcccattcaaaaaatcttgtatattcatttctccaagtccatacactactctataaattgtggaccaccgaggatctacggcaccactttcaagatcactaatataagattgggctaaaccagatttatctgccaattgatattgagtcattcccaattgtctgcgccaaagtaaaatcaatacaccaagcttgtgaacttcttgtcgaacttgtagatcttgacaacatacgataggattcatgctaacctct

SEQ ID NO: 656545 - DNA, 1156 bp, Homo sapiens
  misc_feature (1118)..(1118): n is a, c, g, or t
catgaacgaagtggtgtatgctgtgaccattgtagatgacaccaccccagtggtctgggtctgtgaggcatatgtaggagtctacgatgagaaaccctcgtcgaaggcctccgcgatcttcaacgactgtcttagctgagcacgtcagtgatgcaagtgctacgaggcgtgtatctatatgaaatccggacttaaatctaagacagaaggcctgtataccaagatactgccaaggataatagcgcaggatgcatgcgatgcgcaagaacgacacgcctggaagcaaggacttcagcatgtcactgcacagatagttcctagcacaagattcagtaccgttgtttcacttggcaccgacaactcgcagtatggcgtccgctggcttgcctgcgtggcgtcgcgaggactgataggtccctacctggtatgtgagatccaggctgaacgagagcgcactgttgcgccgagataggctgagactgggtcccgcgtaagagtggcttgtactcagacctagtgattatcctgttcgtaaatccaataggtgtttttggggtcccgtgattcgcacgagtcgaattccgagctggtcaggtcagggtggatataacccaagcgcggcaacatgaggctactcataagcgaggatctagccatgttcggtatgacgagcctgcccataggacaggcctttgtctcgccctgccacacgagccccatccgagcgggccctgccgccagagagggttgggcatgtctatttgagcgaggtcatttgtgcaaatccatgcttctgatggtaggcccgtatcgtcctgttggggctatcgccggctttggccgcacaatgaggggacttaccccaattcgaactccggccagcattgattggaccttcgagaccaaaacgcaataggaattttcaacttgaaaggatttaggggcgccaggtcgggaccgtgagccccgtgtatacatccttagtgcacccgcggcaggagagctcaggagttctaaagcgcatatctagaagataggcgcttgcgccaccaatatgagggcttaatttgacccccgtaacttctttcggagttcgacaaggaaaggccattcaaagnccccgtcatgaggggatggcgacgtttgaggtccccaa

SEQ ID NO: 656546 - DNA, 178 bp, Homo sapiens
agctcaaagaaatccactgatcacctctgtagcatcttcaggtcccatcttgacaacttcctctaattccccaggggaagagttgtttagagactccgtggatgccctagagggagcggctccagaagcttgccttcccgtcctctggtttacacacacggtccagccgactaggcac

SEQ ID NO: 656547 - DNA, 984 bp, Homo sapiens
  misc_feature (383)..(383): n is a, c, g, or t
  misc_feature (386)..(386): n is a, c, g, or t
  misc_feature (390)..(392): n is a, c, g, or t
  misc_feature (394)..(395): n is a, c, g, or t
  misc_feature (397)..(397): n is a, c, g, or t
  misc_feature (399)..(399): n is a, c, g, or t
  misc_feature (402)..(402): n is a, c, g, or t
gggggcaccccgcgggagacgccacgccaggttttcctccaaataaggcccgggccccaaagggcgccccctcccgtgggggccccacgaaaccacgtgctcgcgtctggtgagcgccccggatgtataggacagagaacctctagggacccatgtgtagggaacgcaaaagccccaacccccacccttgggcccaggccaaccctgcctcgcgtggcaccagggaaaaataaggtgggccaagaagaacccatcggggaaacacacccgagcttctggcaaccttcatgcctcatggtaaaaaaaagattaaccagggtgaacattctgatctgtaattccagggactgttttctttccaatggactgtttgttggtagaanaancccnnnanntnanagntaaaatgcatcatcagtcctagtcggcagttccttaagaatggactggcggcgtggttgagctgatatggaaaagctgcaccttcctgcagaagatcaactgaccattgctatcccaccgccaaatctcagcctgaggtataagtcactgaaggcaggtagctgtccatatcagatcagagaaacaggttttccagagcaaaaaggttaggaggacaatctagtgaaagaaaccgctcccttgatacagatttaatcccattgccccgatgaatgggagggcacaagaacccacatggcaccttctgctctatccagcaatattgcacgtcatcatgtgcgatcgaccaacttctgcccgttccatagggtcttgaactggtcaggaactgggaattcattcaagtcaccgaccttctgtaggaatgagcacattcatctcggaagatgtggccctgactatttcactatccagggaattcgttgactcaggctaagcatggcagccatctgtatttagatgtgtatggagtagtggcttggcactttacccaatactctgaaccttggacatccgtatctg

SEQ ID NO: 656548 - DNA, 1493 bp, Homo sapiens
  misc_feature (1367)..(1367): n is a, c, g, or t
ggaaggacctgggctctgggtaagatcataaagacccatggaaggtctctgtcgatgaggactaacacgccacctaatgaaactccccctaacttctggacgtctatctgtattggacgcagggatgactggaacggagacccctttgcagggacgtctgcgagggacacagtgagtgagctggtggctctgggtagtgtgacgcattgcccgtcccacatgacatagtagtcgagggactggtccgcacgtcttagttctcaccgtagccgacgactactgcgctagtgtactatacataacgcttttaccggtgctccctcgcagagaacgtatgcgaacaaccagttgagagacatgttggtcggggctatcccgtgggggatgtctcaaggactcttgaccgacattagcttcccttgggcctgcaggacaagtcgtctgccaacgcaacggactacagtagagctcataagcctgttgcgggtatgtaaccctataggcccggcgaaggggtggcattacctaagagggtcgcatcacctccatggaggtgtggtctcaacttcgcctacaacatggttttcagacttattctaaaactgttagttccgaaaattcccacgatggttgcgttggtcccaagcttggccgacgttccaactcccgacgggcgttccaatcggctcctcgcgtccttttggagaacgctgcctacggcaatcccaccaggtggccctccggtccgtttccgcctctgcccctggacctggcttttctccaccggtgcgggcgagtttgggaccgcgcctcgacccggccctcggcgccaccgctttgtgccgttccgtccgtgtgccgttgccctgcaattcccaagaaccccccttgaggttaccgccggccggtgtttgcggctcctaaccttgacgttttgggccccattgggtggttataccccccggcaagcgttgctgggcgtgtgaccacttggggtcctgaatcgcgaaggcccctgaccctttgtgcccttttctattgcaccctgaaccccttctccccttcttgtccgattcccctgggtttccctcgttaatcttggcacagccttgggcttcccccaaggcacctcgaggagctaagctattccagcgataacttgcgccaccgttcatcccccttgttgggcaaaggcatagagaccttcccctccctacacactcctggcgctctggcccgaactcccacctagcagccattacaaaaacccctacccctatgtccaaacctcaactacaccttggacgcgcttcgtcctacccacgccaccaccaccacccactcacctagcacacaacacaccatangcaaccacatacaacacacccactccccactcgagcaagacccctcacgcgcactgacgccataccagtaccactcctcgtatcacaacccgcccgccccatcatctcacaccacgaccgcccgac

SEQ ID NO: 656549 - DNA, 162 bp, Homo sapiens
cttgcgggtataagagaataaactgtttccatgtcactactcccatccgggtttggcctcaggatgggaggggcatccgtttccaaccatcggagccagctcgcatgcagaggtgcatggcgtgtgcatctttcatctacagaaaacttaggtcagctctag

SEQ ID NO: 656550 - DNA, 228 bp, Homo sapiens
  misc_feature (65)..(65): n is a, c, g, or t
gccagccaacacggtgaagtctccggggacggggtcggcgcccgcgctgccgctgcctacggtantccgccatgcaaggctggcgcgtctccattgaggatgctcacaactgttatttctcgagctgggacaagttagacagaccatgttttttgtctacgcatggacataggagggggagggaggttgaccttgttactgtggccatatatcttcctgatatcatca

SEQ ID NO: 656551 - DNA, 111 bp, Homo sapiens
cagaagcgctcagagtcactctagacaactggggataagtatatggagaaagaaacaaatgaaagaaacaaaacaagccaggagaagtggttcactcctgtaatcccagca

SEQ ID NO: 656552 - DNA, 224 bp, Homo sapiens
  misc_feature (133)..(133): n is a, c, g, or t
  misc_feature (198)..(198): n is a, c, g, or t
  misc_feature (200)..(200): n is a, c, g, or t
  misc_feature (203)..(203): n is a, c, g, or t
  misc_feature (213)..(213): n is a, c, g, or t
acccggggggccgcatccagtccagggccttttataacatggtgacgtcgattattaaacaggtgtgctgagttaactgtgctgcccaccctcgcaaaggagcccgcgcccgactgtggtggggccgtcggtntgttttggttgcctcttcctgaatgggacgcctggggctttcagggcaggcaactgggcatgttntntcnactaaaggtnttgtgagagga

SEQ ID NO: 656553 - DNA, 791 bp, Homo sapiens
ttagggctaggtactgaggccctgggtttccgaatctgtgcgcgtagagcgtccgtccagcaggcttgactggtgatgacggcgtcgcagcattcgtctccagatctgctcgatacctcatgtgggagacttcacacgtaatgcagcgggtcagcagagctaccccagaggcctggacaaaaccacagtacaagagctaacctatccctgagcctgaaggtccagatgccagctcaatcatgtctacgtgaaagtattacagtgttccctggtgccccctgctggatggtacatgccaccttaaggctggtgaacgacgacaagtccccctggatttgtgttctgtatcgatatggttccttttccgtcaccactggacattgtccagggtattgaaagtgcctgagatcctgcaggctgtgcctgtccggtgatgtggggatagcatttgagctgactgtgtcctgccaaggcagtggctgcccaaggaagcctgcataggagatctcatcgccagggtgacagccccctgcccagcggctagtgccagcctgtgcatacccagtccagcctgtccagctggttctgcacagatactgaatgggtgtgtcggggacatactggcctcaattgtgtctctggcttgataccaacagcctggcagtggtcagaagccagcttatcattgcctggtcaaggaagcaggcctttgggcagggtccgctgatcgtgggcatcttgctggtgttgatggctgtggtctatgcatctctgaatataaaaggcgcaac

SEQ ID NO: 656554 - DNA, 934 bp, Homo sapiens
gggctgcgtcgaggctgcaaggcacacagatggcggactccacaggagataaaagtccctcgataaacttattcggtggtgtggaagaacttgatagtaaggactaagaacaggagtaggcgacggtactgtgagctggtgcctcttgatgatgatcgaacgatatgacacttacaaggtggacaggcatgattattggggcaccatggacaaattatgaagacgagaatatatagcctgacaaggtagaatgtggcacctaaatagcccagaagctcctccggcagttagatttgtaacaaacaattaatatgaccggattaaatatatttccagcgggactggtggatgcccggagtcataccagtgttagcaaaactggcaaatattcttactatagcattaaagtggtacttcaatgagctaagacgtctaagtgactgtccagagacagtatgaggcttccacagtcaccagtagggatcaacatacaagaattaatcctgaggggatctcaaacttgtctttaaatcaagaagcttctactcatgtttagtgtcttggattaaattatcgcaatgcgaattcacacttaaggtccaacgacctcccagccggcaaacatgcaccggacacttcgccagacattttttatatgtgttgacccccatagtgttcagggtaacggccgaaaaatggtcgccaagtgttaccctgaaaggagcggcggttaacatagtcgcagtctcgcaaaactcgttacgacgaaggtgcgaacgtcatgcaggagggtttccaacaatacaaagggtctcgcaagagtgaggttgctcttcttgtcttctcgtccttcgtcatcagctctctgctcctcttatctcttcgtccccggacatcggtacagagacacacaatcataacccgacaaccaagt

SEQ ID NO: 656555 - DNA, 500 bp, Homo sapiens
gagcataaaaaaattcatataacattgaaacttccttgtttaatgaggctgaatataacaacacgtaccttgattaaatcattctctatatgtaaatagaggccaacattttataggggagctcagggggtcaccacggcacaccattgatgaagccaatttccttccttccttcctttactaatgcagtcaaaaaatgtagaaagcaatgttccctaaaacagctatagagaaaacatttgctcagcttggatagttcttaatataggccatataatttctagcctatttaattacataacatattttatgcttcatgaccaattacattaatagcttaatacagaagaatattatcctctcttgatttgattatgcagccacacaatatggtatatttggtacttaattatcatcatccattgagcaagctgctgtggtagaataaacagagagctgggactatgcaggctgtgttattggctttagatggttttgcc

SEQ ID NO: 656556 - DNA, 573 bp, Homo sapiens
gggtcccgcgcccaggtgggaagaggccggcgactggggtgaccgcggggaaactgaggcagaggttgagccagaccctgaagccttggccaccgtgtttttggggcggagggaggagatgggctccaaggcaaagaagcgcgtgctgctgcccaacccgccagggcccccacgggggcagatctggaggatgtgcgggggcgccggagaggatcaggtcacatcctggcccggaagacccccagtccttcaggatatggaggatgcggaggccggagagcagtctacacaaagcggctagtggtgcaaccagggtgagcaggcgggcaacgtgctgaggcgaggtgtgagctcctgcgggcggcgaggacctgagcggggtggccagatgagcaggcagcattacggagcgaggtgctcctcaggctgacctcggcctgcggttggcggccaggggctgccggttcctgggtcgcgccgatgatcaggtccgccctggtgtgcgggcctctgtgtggtgggtacgcgtctctgcggtgtggaccccatgtcctgtgctggcctggttacgtg

SEQ ID NO: 656557 - DNA, 413 bp, Homo sapiens
  misc_feature (42)..(42): n is a, c, g, or t
  misc_feature (44)..(44): n is a, c, g, or t
  misc_feature (391)..(391): n is a, c, g, or t
gagacagtctcactctgttgcctaggctggagtgcagtggcngntactcagctcactgcaacctccacctcttgggttcatgagattcttgtgctccagcctcccgagtagctgggaccacaggcacacaccaccatgcccagctaatttgtttttatttttactagagatgaggcatcgtatgccgcccagactagtctcaaactcctgcccccatgcaatcctcccgtctcagcctcccaaagcactgagaccacaggcatgagcaactgtgcctgggctctccttctgtccataaaaatttaaaaattaatattgggtgatagagctttttttttaaataaaagtgagctaatttaaagtaaacatttttgggtaaaggagtacatcntttggggccaaattttcacagg

SEQ ID NO: 656558 - DNA, 339 bp, Homo sapiens
ccagttacacagctcaggaacaagaatattttctggctaggcgaggtagctcacgcctgtaatcccagcactttgggaagccgaggcaagtggatcacttgaagtcaggagttcaagaccagtctgaccaacatggtgaaaccctgtctctactaacaaatataaaaatttgccaggcgtggtggcacaggcctgtagtcccagctactcaggaggccgaggcaggagaatcgcttgaactcgggaggtagaggttgtggtgagctgagatcacaccactgcactccagcctgtgtgacagagtgagactccgtctccagaacaaaaaaaaagggtacc

SEQ ID NO: 656559 - DNA, 122 bp, Homo sapiens
  misc_feature (114)..(114): n is a, c, g, or t
  misc_feature (121)..(121): n is a, c, g, or t
cccttgtgccctgttgataggaatgtaaaatagtacagccagtgtgaaaaatagtatggcaattcctcaaaaaatgaaaaatggaattaacatatgatctaccacttctgggtntttaccna

SEQ ID NO: 656560 - DNA, 920 bp, Homo sapiens
agggacggttccaggctccggggcccaagctggcgccatgccgggaatccgtcggcaccggccagagctacgtgacgaagggtgaagccaaggacattccgagggccaggtgcaggcacgctaaccagggctgtacgaggactgggccggggccagtcccgcacaggagcctcgggcagccgtgctgtcgggccttggcggccgcactggagcgccggaactctaccgtggcgtagaggctggagaggcagggacacggtagctcaagcctgcggtaggcggaggctggagactgagcgcaagacgacttcgggcctggggtgccccgggagcaggcccaaggccacacccagccaggtagccgggctgagaggccctgtgctgcgcctagcgggagccgctggagtgtgacgggctgtgatgtgtccggacgagcggccccggcttgccttagtgtccctgctggctcccgccctggcctacggcaacactgtggtcataggtgcaccagtgcggcctgtcctcatgctggccctggaggtctgccaggacatggccaccgtgttcccagcaggcactggccaacgtggtgacaggagaccgggaccatactgacccgctgcctggccttgcaccaagacgtccaggccaatgtcggtactttcggactcagccaagggttacaccagtttgttcgagtgggcctcggcaggaaacctcaaaccggagtgggagagcaggggctgccgagcgggcactgggactaggaggccgagggggcaggcccagagctggggctgcgagtggcgcggaccaaggccctgtggctgcctatgggggactagatgcctgagcgccacagactgcagtttggacaccttcacacgaaggggagataaccccagggacacctggagtct

SEQ ID NO: 656561 - DNA, 652 bp, Homo sapiens
ttctcgaggatcctcgatatggatgcggcatatagcttcactgtagttatctgtaatggagacagacttctttacttatattgtatgcaaccaacctctggtagcttcactatttcttctgcagcttcctcacttctctcggctttacatgaattgcagagcgtgggagccttatctgaaataggctttggcctaagtgtgcctggttggatcttttatacagaccactaaaatctttcttcacatcaacagtactaaatgccgtttacttcttatcagtcatttgctcactggagtaatcatttacttttagttccctttaagaactttgcatttgccttcacaagctctggctacaatgattggtacaaggacgcccagctttcggtctgtatcagcttttgatatatcatcttcactaagacttaatcatttctagctttagatttaaagtgagagacatgcaacttttcctttctcttgaacccttagaggccactgtagggctgtacttggtctcatttcaatattgttgtgatccaggaacatagatagacacgttacaggcccctcccaaaggcaatgggcagcaacaggactggcagttgtagcacagccgactttataagttcctgcttaatggggtgttgtg

SEQ ID NO: 656562 - DNA, 495 bp, Homo sapiens
ctaggagtggagcctctagcagattgtcagctcacatgataggtaagataagagctggtttgacagtacaacttcttactagtacgcgtgtcaagtctactagggtaatgtgaaaaaattaggtatgagtcccatacaccgtgctgagatatagtctacttacagcagtacaaatggctcttcacacacagggcagcttatactaatgttctcaaaaccaattaatctccagctctagcctcatttaataggtttttacttactttatttattatttatagatggggtctcgttctgtcgccaggctgagtgtaatgacatgatcctccagctcgtacaacatctgcttcctgggtcagggcgattctctggctcagctcccaagtagctggactacagggcgccaccaccacgccagctaattttgtatgttagtagagacgggttcacatgtggccaggctgtcttgactctgactcaggttcactacttggc

SEQ ID NO: 656563 - DNA, 138 bp, Homo sapiens
accggaaaggtaagctgtactgcgatggctatgtggctgattgaagagtatgcaatgacgcgattttagtgtctgttttgtcgtagtgcagactgtgagcttgtatataacttattgcctccatagtgtgcatagtac

SEQ ID NO: 656564 - DNA, 265 bp, Homo sapiens
cgtgccacacacctgactaattttggtatctttagtagagacagggtttcaccatgttggtcaggctgatctcgaactcctgactcgtgattggccactcagccccccaagtgctgggattacaggcatgagccaacacgcccgggccactctgccattgtctaagccacctctgaaagcaggttttaaccaaaaggatgagcgcagaactcttccagaaccatcacctttgggaacctgctgtgagagacctgagcaagccagg

SEQ ID NO: 656565 - DNA, 962 bp, Homo sapiens
ctacaaaccacaaagacattggaacgactatacctaattgattcggcgcatgagcttggagtcctaggcacagctctaagcctccttagttcgagccgagctgggccgaagccaggacaagcttctagggtaacgaccacatctacaacgttatcgtcacagcccatgcattggtaataatcttcttcatagataatacccatcataatcggagtgctttgtgcaaacttgactaggttcccctaataatcggtgcccgccggatatggctgtttccccgacataaatgaacaataagcttcatgactcttaccgtccgcttcgtcatccgtacattcctgctcgcagtctgctataggtggtaaggccgtgagacaggataccagtgttgaactagatctagcctcccttagctagagggaactgaatctactccacacgctggtaggctccgggtaggacgcgtaagccagtgctttcttcctgtagcgacctaggacgaggtggtgctcctgctatgctttagggggcgcatgcaattctcagtcatcaaacaattatgcaatataaataaaccctcggtggccgataacgccagagtacgcaaagcgcccctcttcgtctgatccgtcctaatcacagcaggtcgtagttctcctatctctcccagtcctagctgctggcatcaagtatactagtaatcagactgcaaagcttaacatcaccttcttcgaccccgccggaggaggagaccccaattctataacatcagctgatcctgattatttcgggtcaccctgaaagttaatatccctatctaaacagggtttggaataatttcccctgttgtggacttactcactcccggggcaaaagacgccttgggtacacagggtgggcctcgggaacaaacacacaggggtccgcagaggattcggtggagcgccaaaataagggggata

SEQ ID NO: 656566 - DNA, 314 bp, Homo sapiens
  misc_feature (230)..(230): n is a, c, g, or t
tggggggggggggagaaaatctcccgttgcaggtacccgggatcacatcctctgctcagtctatgcctggtaatttgtatttgtggagaggggatatctcgccacgttgccgagtgttgaagccagatcatgcaattgggttccttggatttccgaaatagaacccaatattctggctttacccctggagggatgcagatgtaccttctctcagtgcgatgaactcaggnctccacggtccctggagctctaggaaaggtgggcgcgatctcgcgcccacacccagtgctctgggtcataagcctggatctgga

SEQ ID NO: 656567 - DNA, 657 bp, Homo sapiens
atcaaatcagtcggcatatatgcattcatagtatgtacgtatagatgcttcataaatatgtgtactgagtgaaattgcgcctgagtactctgcactcattgcatttgccagtgctcaccaagtaatacatagtgctggatctctttgtctgatgttctcgaagatcatactctgaaagtgtttggtccatagttgtgcatgtatcgtgtattctaatgcaaccgagtaggtcctgcagtctgtagactggaattatcataatttacgccgctgtttcgtgttcatactgtctatttagtttattacccgtgtatttattttcttattcgtacttgttgagggtttgttgttgctttccgttttctagatctgtaagttgaagtcttaagattattaagatcgttcttcttttctattatagccatttaaagctacaaatttgccccatgtcttgctttatttgcatcctacatatgtgctcctttctgattaaaagctctctccttaaagatatatagtaccctgactcttgtagtattttgtctcattttctgaaacaatacactttagtttttctgtgttaagggaacttgcctttaagctggaggtcacgttgcctctgtgtgtgtgtgtaatgactttaatccaatatttctg

SEQ ID NO: 656568 - DNA, 142 bp, Homo sapiens
gtccttgcttgctgaagtgaaccagttcccagaaagacaatggtgagccatcttggtttcactcgcggttagctgaggtctggggccacacagggggtttcacaaacctcgggatatatcagagtttatgagaagggaaaca

SEQ ID NO: 656569 - DNA, 193 bp, Homo sapiens
tacggatctatctacgagcgcactgcacccagctgggcggcagagcaggactgtcttaaaaaaaaaaaaaaagacttaccaaagactgggcgatttacaaaagaagaggtttcttggctttagttcccctggctggggaagcctcacaatcatgggggaaggcaaggaggagcaatttggtttttacccgcga

SEQ ID NO: 656570 - DNA, 330 bp, Homo sapiens
cgtgcagctgacctggcatatctctggctaccagctagccaccggcactctacaaacacctggacatccgtacgccctgcaactcgacctcacggctagcgcaactagctatacatgcattcccactcctcggccaaaagcaaaatgcgttcaacaaaaaaagtagatcaaatcctgcaccatggaatcctgctaatagacaaagtggaagcgcatattctctctgttacctagcactttcaccccttctactgctggcgcaacacgctcacaccgctctcctcctgcccagctacacctcaaccccctcgcactgaccttaagctactc

SEQ ID NO: 656571 - DNA, 122 bp, Homo sapiens
gctgtatgtatgtctcagagtattggctagctgtacatatatcattctaactaatattatctttgtcaaacaaaatgtcgctttattataaatgatactattaatagaagttgaaatgccag

SEQ ID NO: 656572 - DNA, 182 bp, Homo sapiens
gatacatcatcaagactattaccagtgaagacgtggccgaaatgcacaacatcctgaagaaataccaccagtacatagtggaatgtcatgggatcacccttcttcccagttcttggcatgtacggcttaatgttgatggagttggaatatatgtgatagttacaagaaatgtattcagccac

SEQ ID NO: 656573 - DNA, 127 bp, Homo sapiens
tgccaaagcggtagtacaatgcccaatctcagtgctggtgagacaagaggggggactcatatgtccggagggaggctctggagggagacatgccctgtggtcaaccctgacttgtgtacccacaccc

SEQ ID NO: 656574 - DNA, 122 bp, Homo sapiens
atccggggtaagatgaagggaagagggttgtgttggttaaggacgacccttgctctgaccggaagagaagtccctatacccacacctgcctgtcactgttccctccacctttcccactgcgc

SEQ ID NO: 656575 - DNA, 943 bp, Homo sapiens
tgcagctcaagctcgatggagatcaaccccgagatgctgaaacaaagtgctgttcccggctgggagggtcgcccggcagtggagcttcgtggacgtgctgggggtggaagaggagtctctgggctcggtgacagcgcctgtctgcgcgctgctgctgctgtttcccctcacggtccatgatgagaacttcaggagaaagcagattgaagagctgaagggacaagaagttagtccgtaaagtgtatccgtatcatgaagctgagcattgggaagttctgtgtggtgagaatcggacttattcacgcatgttgtcagagtaatcaagaaaaacctgggatttgaggatggttcacgttgtgaaacagttatctttctgaaagcagataaaatgtctcctgaagacagagcaaaatgctttgaaaggaatgagggcatacggggagccatgatgccgtgggtcaggaaggacaatgtcgggtagatgacaaggtgaatttccatctaattactgtgtaacaagcgtggagtgtgccagctctatgaacttgatggacgaggtgccttttccggtgaaccatggtgccagttcagaggacatcctgctgaatgacgctgcaggtctgcgagaagttcacgagtcgtgagctatgtgaagtcgcttactctgccggggtcgtctgagagctaatgtttgtggaggactgtggtgattcccttccgttagttgaatattttgccgcatgagctaaatgtttagctgggaagagggtttatgttggaaagctacgttagcatccggattagaggagggagtgcctggcatggggtaggaacaggagagttcacggtgtgtgtgaaagaaggatgtgtggaaacacagggctggtacaggagtgggaaaaagggcacggactgagtgaaatatgaggaatatatataatac

SEQ ID NO: 656576 - DNA, 220 bp, Homo sapiens
  misc_feature (56)..(56): n is a, c, g, or t
taatatgaagctatcaggactggatactagtacctttgttacaattaaagagaagnaattattccattctttgtttttgaatcaacatgctttacaaactaaggagtcaaataaacccaattctacttagtactctcttgggacaaagaaagtaagtgagataagtgaggcagccaatcactaaatataggggaatgaataaaaaccgggaaccgggttg

SEQ ID NO: 656577 - DNA, 558 bp, Homo sapiens
ccccacgatggccttcattacttacgtgctcctggctgggatggcactgggcattcagaataaggttctccccggagggtgctggtgcctgtgtgcaagcacagagctggtgtgggtggtgatggatggtgctggccctgctcctgggcctctacctggccaccgtgcggcagatgacctgagcacctttcacctgctggcctacagtggctacaaatacgtgggaatgatcctctagtgtgctcacggggctgctggttcggtagcgatggctactacgtggcgctggcctgtacctcatcggcgctcatgtacttgcattgtgcgctctttgcggacagcagtccctggagaccccgaccagcatggggggccccgtcccccggcagcgtctccagtctacctgacctctgggagctgtagccttccagcaccctcatcatatactgctgacgtaatgcacctggtccggatgaccctcgatgggccccagatggcactgagtctatccatttcattgaagaatttgatttccttgaaaaaaacaaaaaaaacggg

SEQ ID NO: 656578 - DNA, 257 bp, Homo sapiens
gatatacatagatcacagctatttaacctgttcctcaagacagtgaggctgtgttggaaataacccgcctctagtgctgttggtatgcaaggcagcggtgcttaatcaatatttcctgtgttcaacattcgccaaaatataacccatatcctgagcaccaatctactctccatttacaactaggtggaaaccctagactcatagactcttagaaatgacccagaaataggagcataaactttataaaacagatccgc

SEQ ID NO: 656579 - DNA, 353 bp, Homo sapiens
tatgccaccttgaagatgttataaattggtgagtctgggcattgatctttactagagaagaagcccacttggctgggagagtaaagaaaccacatctgaattctcttgtccagcactcagctttgccacgcctgtgtgccactaatgcaagctccagcaggcagtcagtcatgactatcattctctctttataaataaacggaagcccttaaaggtgacgtgacttgcccaaggttacagaaacatggcagtgagtcagatggaactgtgtgtgtttggaggaggaggagaagatgacattataaacaaaaggcagagagtgagggacagatccacacctcttctgaagttaa

SEQ ID NO: 656580 - DNA, 916 bp, Homo sapiens
tcagaaaaaaaataggtctaggtacgaggctcggtggttaatcggccgaggccagctcgcagctggagatctgagaacgggtagactgcctcctcaagtgggtccctgacccctgacccccaagcagcctaagctgggagtgcaccccccagcactgacacctcacacggctgggtactccaccagacctgcagctgagggtcctgtctgttaaaaggaaaactaacaaacagaaaggacatccacaccaaaaacccatctgtacatcaccatcatcaaagaccaaaagtagacaaaaccacaaagatagggacaaaaacagagcagaaaaactggaaactctaaaaagcagagcgcctctcctcctccaaaggaacgcagttcctcaccagcaacggaacaaagctggacggagaatgactttgacgagctgagagaagaaggcttcagacgatcaaattactccgagctaggggaggacattcaaaccacaggcaacagaagttgaaaactttgaaaaaacatttagaagaatgtataactagtataaccaatacagagaagtgcttaaaggagctgatggagctgacaaccaaggctccagaactacgtgacagaatgcggaagcctcaggagcagatgcaatcaactggaagaaagggcacctcctaggaaccaggatctgtacttggtgtcccagtgatcaagtacaacagactgtccttcctgcactcaaggagacagctccataagtgcacgagcttacactgacactgcccaatccggggaactatacacagatattgctataacgtcacattggaacaaggccgggacaagctatgatcccccggtcggtgaatcgccacgtgcatcgctcaaagcataatctgccactatatcgcccaaccaaggc

SEQ ID NO: 656581 - DNA, 120 bp, Homo sapiens
ttagagaatacatggatgtgcatgaactccacgtcgtgagctgaaagtacagactgcggggtgaatatcctttgcttctgagtgttattaacaggtccttatggtcgtcagaagatcgag

SEQ ID NO: 656582 - DNA, 1135 bp, Homo sapiens
  misc_feature (760)..(760): n is a, c, g, or t
gagatgcaggtgagcaagaggatgctggtggggggcgtgaggagcgtgcacaaaccgcatgtgtcttgagggcggagccgatcctgctgctggttgctgggcacagatgctggtaggctcggccacggtgctgccgcgtcctcgctgcgatgtgctcacgcgccaggaccgcggctgtgctgtgccagcgcaagcgcttggtggcagtccccgagggcttccccaccgagacgcgcctgctggacctaggcaagaaccgaatcaaaacgcacaaccaggacgagttcgccagcatacccgaacctggaggagctggagctcaacgagaacatcgtgagcgccgtggagcccggcgccttcaacaagcatcttacaacctccggacgctgggtctccgaagaaacacgactgaagctcatcccgctaggcgtcttcactggcctcagcaacctgaccaagctggacatcagcgagaacaagatggtatcctgctggactacatgtgcaggacctgtacaacctcaagtcactggaggtaggcgacaatagacctcgtactaaaaactactacaccgtgccttcagacggcctcaacagcctggagcagctgactcttggagaaatgcaacctgacctccatcccacaccgagcgctgtacaacctgcatggcctccatcgtcctgaatgctcagaaacctcagaaatacaatgacaatacagagaaataatccttacaaaaggctctacggaactcacganctttaggaacatccccttggctcatttggaaccacagaagaccaaaatatgatataagagccacaaattgacatacccggccaaaccaaaactaggaaatgagacgagaggacacaaccgggcgggtgcaccaccaaaggaaaacatcgcggaacagaaagacatgcagcaaaccccacaaacacaaaagaccacagagacagaggacgcacacgaacaaccagagggcgacaaatgaggtggatcaccacgacgccaaaacaagcaagcagaatcatagcagagacgcaccagagaacacaacataaagcgctcaaagtcgaagacacacaccacaaacaacaaaatcagaacagagaaaaataagtgaaatca

SEQ ID NO: 656583 - DNA, 209 bp, Homo sapiens
tcagcaggtgtcgtggctaggcactgtgtaccaacaacttgagagactgaggtggcaggaggattgcttgagacctaggagttaggggctagcagtgagctgtgcatcgtgacaccgcactccagtactgggcaacacagacaagaccttgatgtcacaacaattttctattacttacaatctaaaagagtttcatgacacctcagaga

SEQ ID NO: 656584 - DNA, 274 bp, Homo sapiens
  misc_feature (48)..(48): n is a, c, g, or t
agaaagggaaaaggtaaggaaaacatatttaataaaataatgtcagangacttcccaagtcttgggagagatggacattcaggtccaggaagctcaaagaaccccagattgattcagcccaaacagatcctctctgaggcacattatagttaacttgtcaaaagtcaaagacaaagaaagaattttaaaagcagcaagagaaaagcattaagtcacatataggggaattaccattagctatgaatctccattagactatcatatttctcagcat

SEQ ID NO: 656585 - DNA, 89 bp, Homo sapiens
ggcacgagctggagaataaattgcctttcctaaattcctctgcttcgctcctttcctggcgttgctctggaaccttgttggtgtctgtg

SEQ ID NO: 656586 - DNA, 595 bp, Homo sapiens
gctgcggttagtgatcatagaggatcccctcgcaggttctctacctcagtgatctggcaaaccagcagtgtcccacacggccgggtcagcagctggcggcccctccacctcactccagctccatccgggcggcaaggaaaggtggggaggtcagcgggtctacccacagtagaggcccggcactgaccatgaggccacggcccacggccaccatatcatccccatctgacagagggggactctgaagggacatgagggggtgcccgggcataaacaggcccctgactccccacacctgccagtgacgggttatgtgataacagatctcagactctcgggggttcacttccctcacgtgtcaggggggggtcaaagtatgtctcagggtcaccgggagaatccagggagatgcaaggacaagggcccttcgcattcactcattcattcgacaaccattcagcaagcatgctgatgtgatagtgatccctaccctggcggagactcagacaaggagcaaagaatcacttgatacaacaagtaacaagcagggcttgccagaaaccaacaatgagtccaggagccacaaagaagagac

SEQ ID NO: 656587 - DNA, 242 bp, Homo sapiens
atggcgaagcagtatgagctgggcctggggcagcctcccagtcgggcttttggtctacccgccaaggacccccagtccccagcagactggtccagcgggctctctagcaccattgaccggcacccctgaggcgcttagctgccgtgagtccccatggtacactggccctgagtccatctgacctggaacaggtccatcaactgggctgagctctgagcctgtcttgacagccgctccttgac

SEQ ID NO: 656588 - DNA, 759 bp, Homo sapiens
tcctcattaaaccttttaaagtggggtctcaaactcctgtgacaatttttgggccaatttgttcccattaaaaagtcctggtatttcaaaactaataatcttaaaatgccacacgcaaaaaaaaaaaccaaggtggtccaaaaattttctccttcccttctgaaggttacgatgcttggttatcattacccagtctttatactactaaacttaattggccaattgtgaaacaaaccagttctgaaaccgttctcccaccactgataaaaaggtgggggtggcaggtataagggataatatccattagccttctgagctttcggggcagacttggtgacctggcccagctccagacagccttctggctccactgcctttgatgacccccaccgacaatgtgtcgttgtctcatatcacgaacagcaaagcgacccaaggggggatagtctgaaaagctcctcaacaacacatgtgggcttgccaggaaccatatcaacaatgggcagcatccccagacttcaaaaaatttggggccatctcccagtttttaaccagaagggggatcaatcttctcccttcagctcagcaaattgggcttgcaatgtgacccgtgtggcactcccaatacgggggcatagcccggacgctaaattgggcctggatggtcaggataatcccccttgagcatgtgaaacccaggctgttccccatggcggggtcattttgctgtcccccagcaaggttgccacgaagagattc

SEQ ID NO: 656589 - DNA, 176 bp, Homo sapiens
ggctgatctagagtatccccgctccatccggcaatcgaaccactgcgccggtgcaaatactaatacttataacgcattattttaaactgatgacagcttaacacaattgcagaaacaaacttgcaaaaagaaagttaattaaaactctacactttaactttgtccccggctgccat

SEQ ID NO: 656590 - DNA, 250 bp, Homo sapiens
  misc_feature (76)..(76): n is a, c, g, or t
  misc_feature (182)..(182): n is a, c, g, or t
  misc_feature (189)..(189): n is a, c, g, or t
  misc_feature (208)..(208): n is a, c, g, or t
ccgatgaagatgccgttcggtagatgatgatgccctgcacggagacactgaagccctggcacagagcgcgagttcngaggcctgggagactgcctggtgaggatcaccaagtccgacggcatccggggcctgtaccagggcttcagtgtctccgtgcagggcatcatcatctaccgggcggnctacttnggcgtgtacgaaaacggcntcttcatcgggggtaccgagctcggatctcgcctcatggtca

SEQ ID NO: 656591 - DNA, 790 bp, Homo sapiens
ggcattcctgtagctgggaggcgtgggctccgagatggcccactccctggcctaatatgagctcgctctactgtctctttagggcctggtggctatccagagcactccaaagattcaggtttactcacgtcatccagcatagaatggacagtcaaatttactgaattgatatgtgtctgggctgcatccatccgacattgaagctcgcttactgtagaatggacagagaatctgaaaaacagagccattctgacttggctttcagcaaggactggtctgtctatctgttgctctacactgaatccacccccactgaaaaatatgactatgcctgccttgtgaaccatatgactgtgacacaggccaagatagttaagcgggatcgagacatgtaagcagcatcatggcgggtcgaacatgccgcatttggattgcatgaagttcaaaatctgattgcttgctctttaatattgatatgcaaatgcactgacactttatacactgtacggttataataatgttaacatggacatgatcttatgtataattgtactccgagtgctgactccatgtgtgaaatatccgagaaagttgcttcacacggagctatagggaggctggcgactaagacgtggagagacccaattcttttattcacaccaactcttggcacgattgaaccttaagctgttgactccaactttgtaagatcgggaacccccttaataacttcaacctcatcttggttgagacggggaaatccaatataaccgtgttgggaagtgcttag

SEQ ID NO: 656592 - DNA, 201 bp, Homo sapiens
ccagctggagatcaacttcaacacgctgcagaccaagctgcggatcagcaaccgatcctgaccttacatgaacctccgaaggcatagcgatcgtgtacggcataattgcctgtgtgccctgggtcagaaggctggcagcagagtctgtagaaaggggtttacgagggagtgcgtatgtctcaattgagatttcggaagact

SEQ ID NO: 656593 - DNA, 108 bp, Homo sapiens
atatacaattctatacaatgataaatactctgcatataattagtagaaataacttctgtttacctagttacaataaacctatgtgtggaccaaatgttatgcagacaa

SEQ ID NO: 656594 - DNA, 145 bp, Homo sapiens
tcacgatccctcagctcccccacccacccaggaggcaggctaagtaaggccccatcactgagtccgggcccagagagaaggctcgggcactaagtatgtggttgcctgtgcagcagtgcaggtgagcacacttggcacactgcag

SEQ ID NO: 656595 - DNA, 599 bp, Homo sapiens
cgtttttctgagcaccttcgcagatggctggccacactcccaccacagactctttctagagagtccgctgggcgctggcgtttataactgagagttttctgaaacgcacaaggcgccccgtatattctctcccacatggcgtatttgtaaagagaacacaaggtggcgctgttaatcttaattgccgggtggtataaggggagataatctcttgaatataaacttggaggcccacgcacaaagattatccacaaggtttgagagaatgcctttctttgttcttcacatgtctgtcacagccacgcacccacaaggcccttgtttgggcaccataatcacgggcgtgtaatggagaaagagtctctccggacccaatcacgaatgccaaagctgagaaagaggagttgtaaccacaaattttcttggctggagatttgagaagcgttaaaactcctcgtggagattcaccacatccaataccacgcttcacgcttttgtcacttgcttttatgtataattagttccatttgtaaaagggttactttcatactccttatgtaccagaaatcacatgaaaaataaaggttccataaagccca

SEQ ID NO: 656596 - DNA, 121 bp, Homo sapiens
ctcttcgttccagatccaaataaatgggacagagtaataaaattttagttataactatgttctcatctcctaagtatctcttcagagtctgaccgtcagtaaaacacacagaattgtgttg

SEQ ID NO: 656597 - DNA, 132 bp, Homo sapiens
attacctggcatatgcacaacacggcacactaggtggcatcccagtctaggcacacgtgtgaagcactactataaacttgagtcatcccgacgttgatctcttacaactgtgtattgttaactatataggca

SEQ ID NO: 656598 - DNA, 181 bp, Homo sapiens
accagcatagtgatagtacaggcatacctattgccatgattataggggcggagcaaccacacaatataggatcctcacactagactcatcgcgtcacccttatctccctggcacagcagaatacacattagactacatgctcttatctggaatattaccacacagaaccctgacccttact

SEQ ID NO: 656599 - DNA, 131 bp, Homo sapiens
agcgcctcacgagcgcctgatccagcggcacattcggctcggtccggcagtcaccatgtaggtgccttcgaacaccgcacctttatcctcgtctgccgaatcagatgcacttccggcgtgcactgcgcgcg

SEQ ID NO: 656600 - DNA, 123 bp, Homo sapiens
agagggtaagggtggggtattttgtattagtaagggtggggaagcgagttgactgtagtgagaagaatatcagtgctatagggcttgtagaggtagcgatgagagtaatagatagggctcagg

SEQ ID NO: 656601 - DNA, 1138 bp, Homo sapiens
  misc_feature (17)..(17): n is a, c, g, or t
  misc_feature (275)..(275): n is a, c, g, or t
  misc_feature (284)..(284): n is a, c, g, or t
  misc_feature (318)..(318): n is a, c, g, or t
  misc_feature (921)..(921): n is a, c, g, or t
  misc_feature (950)..(950): n is a, c, g, or t
gaggtctggagttcaanaccagcctgaccaagatggtgagaccctgtctctactaggaatacaaaaattagccagttatggtggcaggcgtctgtgattccaactacttgggaggctgaggcagagaattgcttgaacctgagatctcggctcactgcaatctcctgcttcctgggtttaagcgattcccctgccttggcttcccgagtagctgggactacgggcgcccaccaccacgcccggctagttttttgtattttagtagagacggttcnccatgttgnccaggatggtctcgatctcctgactttgtgatcngctgcctcagactccctaagtgctgggattacaggcatgagccaccccacccggtccatatagtacaatcttaacccaaaaagtgtgtgtgtttgtgtgtgtgtgtgtgtgtgtgttttgtttttgacagagacatgtaggagacaggtggaaaatttgaggctgatgaaccaaagagaatttcgagtttttagtactatatgtggttgatacttgaagccatggaaattgccaaatttatcaaagaaaagggattgtgtggccaacagaatgttagagaaatttcaagagttgagggcaaagagaaaaatctagagaagaaattacctgtaatgtagaagaaaaagtacagttcactgaagccatgtttcatgcaggatgaagtctaatcctatgcagggatcactgaaaggtgactattgagaaaaagttattattggctgtgaggaagtttcaatagcatagtggaatagtaaagcaggtcacagggaacgaggagagaatctcctctgaggaagtgaagatgagcggtagctggataggataccctggttgaggttgttttttaagttatagacaactgagtagttttgtagaggagcntcctgtgaaagagaacagagttgaaggtnaaaaaacccaggaggaaggaggaggagattgaaatgagaacatgagtaaaatgggaactagagaaaaaggaatagttaatgagtgaggatagatggagagatgttgagggaattcactttgacttgtgagtaaatcatattagaggggaaaaaggttcagatccaaactgggaacgacaggaaagtaa

SEQ ID NO: 656602 - DNA, 231 bp, Homo sapiens
cctcccctagggggggggtttgccccccaagggggggttttttccctgtttttcccttttttgggggggcccccggggccccccccccgccggaacccttttttttttttttttttgggggggggttttattttttttcccccccccctttttgggccccccgggggggcccccgggtttttgggggcccccccggggcccccccccccgtccccccttttttttttgtta

SEQ ID NO: 656603 - DNA, 311 bp, Homo sapiens
aaataagtgatgagaactggaagggcatcaggtgcccaaagctaacactaccagcactttggaggcagaggtgagagaattggttgagcccaggagtttgagaccagcctgggcaagatgacaaaaaccccatctctaaaaataaaaacaaaattagcaaggcacagtggcacgtgtgcctgtagtcccagctacctgggaggctaaagtaggagtaacccctgggcccaggagtttgaggctgcagtgagctgtgatcacaccactgcactccagcacctgggtgaaaaagcaagaccttgactctattt

SEQ ID NO: 656604 - DNA, 717 bp, Homo sapiens
ccacaatctgctgagctcgcatgttgcgggtgggtggggtcccgtgcgcttccccctgacgcctccaggccagccgtaggtccgtatctgccctgtggaattcaagcctcgcatagcttcgtgtgcggcgtatgataagcctaagagtggatgtggtccggcggttcactggaggcggccgagtaacgttgcggtcgtgatcctagggtgccagaaagggccgggttggagggatatcgaggagaatcgaggagtttctgaggaccatgcagccacctgcttgctggaaggtggaagtgatagaggtgcaccctgcagtgcccaggaatctaggacgtgatgttgccccatcaaggcgcagggcatccccaacactatgctgctgagtgacagaggaaactagagaagttgattagttgccaggcggccagtttttcttgttcatgagtgtgtatttatcgttgatctatagcccggttctccgaacttctgcctgtgtgtatccgccgaaccgcttgacccaagtgacatctagaacacacgagtgtttgaggctgcggtattcatgagtatttggtgttctcattagcaggtttatgaaccgtctctcagttgattaatggaaagaagtccagggctgaagttctgggtggacccaaaagccgcgcaggaaccggggctgggcaagagcggtacatgtccacctttctgggacag

SEQ ID NO: 656605 - DNA, 195 bp, Homo sapiens
gtccactaaggtcttcaccacccactggagaaagctggggctcacattgcagcgagggagccccaagggtcatcatactctgtgccctctgttgaggcccccatgttcgtcatgggtgtgaaccatgagaagtatgagaacagcctcaagatcatcagcaatgtctcctgtgccaccaaatgcgtagcaccagcg

SEQ ID NO: 656606 - DNA, 282 bp, Homo sapiens
ctagaggttccccccgccggtctcgcgcggctggccagagctagagcagaccctggctttgtagtgtgttgcctttctcgcggctgtatgttctctcactgtagctgctttcagcctattgatgtgacatccttgcatcgtgtagtttgggatgagtctgtgcacgattcgtttttgtcaagcccgctccagatacaccatctagatggaatgactagttaatctccgccagtgcacctcctccaaggatagtgtcgcaagctgttgattatgagttgataa

SEQ ID NO: 656607 - DNA, 146 bp, Homo sapiens
  misc_feature (13)..(13): n is a, c, g, or t
catgggtatagcnttttatagaacacttagaccctgtatcttttagcaattactctgaagaaataccataatactatatgtggaagacatcccattggggtgttattaaatgctatcacacagctccagaggaatggaatgaatat

SEQ ID NO: 656608 - DNA, 337 bp, Homo sapiens
cagatgccttcattgccattgggtttgtgactgtgatatagtgacgacctcaggagcaacaggtgggtcacaaccccgtggctgggcagatcttccgaggcgagggaccacatgaggagccaagaagtgactcagaacctgactgacgtggcatcgatctgccgcactggaggtgatggtgcgagcattgaccttcctgcctggtactggttggtccttctgcaaggtggttcctgctccagtgtacactgtctccagtgctcctggctcccttccgctcgtcagaggtcgctccagctctcaaggagattgtcgttcacccagaactcttgcagcc

SEQ ID NO: 656609 - DNA, 155 bp, Homo sapiens
gtttgattccgcctcacagttgatggagccaggcaggcaatccatggaccttgtggaacttgtgtctctttttcccacgctggctggacttgcaggactcaggttcactggttgcccgtcttcattcacgttgagctgtacagagaggcaagacc

SEQ ID NO: 656610 - DNA, 205 bp, Homo sapiens
agaggctgttgtcagtggtgatgacctggccgtcaggcagctcgtagctacttctaccaggcaggagctaggaagcagccgtggccatctctatgctcgaaagtccagtgacgactgtagccacatgctatctaccttaactgtcactgcactgatttccctgctacgggccggtgggtgtgtagcaagcttgtaagtacgctgc

SEQ ID NO: 656611 - DNA, 219 bp, Homo sapiens
gttctagcctcgcctagtgggtcacacctattgtgccaccatgtagggagggcgaggcataaggatgcttacgacaggagttcaggaccagcctgggcaggataggaagagccggtctcttaaaaaaaagagaaaagtggggccggggtcagggggtcgctagggtagtccccgagctcggctcgggcgaggtggggaggggtgccgagactcgaatcg

SEQ ID NO: 656612 - DNA, 246 bp, Homo sapiens
aatttccaagacctgtcttactgaacaattattggatgctaggtagtctgcatccttttattcttacacttctgtatagtctaagtgctcatctctcttcaaaggctttaagactttattagtactccatcatactgtgccacttgccttgtaacagctatgttcttcacagtaactgcctatctgccacatccttatatttgtgtgctctggaatttgtgtcccgtgcatgagctgggtcgacgc

SEQ ID NO: 656613 - DNA, 460 bp, Homo sapiens
cttcgggtaccgtttggccctacacgtctaccagcatggcctgactgtcttcctgggccaggtgacccgcttcgtgggcgacttcttgctgcatcactgcattgcccggtggattgcacagaagggtggatgggtggcagccctgaacttgggcaacggtcccatcctgaacgtgctggtggttctggatgtggttctgcagcgccagttcgaggtgcgaagattctggagcccgagactgcctaggctgcccattagcgacccgggtcagacccatgcctagacttaaccgaagtctttgccttctttgctcccctgcaagggtaccccgtcaagagtcccgaaaacaccccctgactcggctataccttcgaagggaccctgcgtcggggcacacttaggctgcagaggcaccttaacattgcatgatgctaaagagccctttctctgggcacatggg

SEQ ID NO: 656614 - DNA, 235 bp, Homo sapiens
tttttagcttaaacaacaggcatttatttctcacagctctggaggctgggaagtccaagatggtggctccagcagattcagtgtctggtgaggggggcttcctggttcacagatggtagcttctagctgtgtcctcacatggcaggaggggcaaaagagctccctcgggcatcttttataagagcactaattctatgcaagagggcagagtcctcaggacctaatcgcttcccta

SEQ ID NO: 656615 - DNA, 119 bp, Homo sapiens
cataggtggcactgtctatggtgtgtcttcacatggtataaggggttagctactgggttctcttttatgatggcactaatcccattcatgaaggcaccacccttatgactttattatct

SEQ ID NO: 656616 - DNA, 449 bp, Homo sapiens
tgcgtcctcgtcttccttcctcttgtgcttcgaccgtgttatttgctctcaatcctatgtcctggatgtctcgtgcatatgttcttcctttctggtctgagcctgacatgctgcacttggccgttgtctggggccctttgcttgccatcaccatcagcctttacatcatgatcctcgtatcttttgatatcgagctgcagagtccgtggccgcacacacgccgtggggaatctctgactacatgggtctgtcggggagcgtgaagcgggcatgggacacccaacacttcttccatttcttcagagggaaactcagatgtccaaactaattttaacgaacgcataagaggtttatttgggtacatggcccgcagtggctttgcccagaaagggaaagacacgcgggtagatgattctagcagcagaattactccgggtcaccatgggcac

SEQ ID NO: 656617 - DNA, 720 bp, Homo sapiens
gaaaaagtcaaaggaaagtttgtatatagatgatatgacagatatgattgtagagagatatatatctcatggacatcgtgtgaaaaacactatgtcctctactttgcagacaatattcattctctaggtcacatcattctttgatctggtcgctggtgcctaaatggattcccgcagattttccggaaaatggatcacaaactcacgatcgtatagttgtgcgtggtacgagtgtacggtactatttccatcagcatcgacgtcccatacaggtggctgctagatctagggctgtatgcccgatctatactctatcctctcgtggttgcaccgttggtccagcacaacgctcatcttcatactcaacgcacatggtatcttactagatatgtttgagaaattgggtaccaggcaaatctcatacgtgtttgagaaaacaggctcagagcacgatgttgtagaatagaggccaatgaagatagatcaatggcactttgcatcacatcgtttaggcccagtcccgagtccaagtatgactgacacggtgtgaagtttataatagctaagactcaagattcacatactaatcacacttacaaattaatttcctgaaagtagagattcagcaaaactcacccgttatagagaggagacgagagaaaatagcaaacctcacatgtcctcatggtctttgtctcggtagctctagcgatagcagtt

SEQ ID NO: 656618 - DNA, 198 bp, Homo sapiens
tgaccacgtccttcctctcaagctcagcccgagggtgggagcctcaaggaagcgtggggtcaccactggagtcatggtcacgaggtccagccccactcccaaagctcagccttgccaggctccctttctcttcttcccccggtccttcctttcagtctggttgttgcaccctctgcttggttggctggagcgtgcacg

SEQ ID NO: 656619 - DNA, 377 bp, Homo sapiens
  misc_feature (198)..(198): n is a, c, g, or t
  misc_feature (207)..(207): n is a, c, g, or t
  misc_feature (303)..(303): n is a, c, g, or t
  misc_feature (319)..(319): n is a, c, g, or t
atagtatgttttaaaaatcaaatggtatagacggacttactatggcattagtcatttctgcattcaccctctttcctctgctactggttttgctctgtcacccagactggagtgcaatggtgtgacctcggctcgctgcaacctccacctcccagtttaagcgattctcctgcctcagcctcccaagtagctggggantacaggcgntgccaccacatccggctaatgtttttgtattttagtagagactgggttcaccgtgttggccaagctggttttgaactcctgacctcagtgatcggncattcggctccctgcnaggattacagggtgaccaccgcgcccggcctatgtcacgattttcttattttagtcgc

SEQ ID NO: 656620 - DNA, 1065 bp, Homo sapiens
acctggcgccgcccggagcccgagccgcgctggggccccagcgacccgcccgccatgggggacgaggacgacgatgagagctgcgccgtggagctgcggatcacagaagccaacctgaccgggcacgaggagaagtgtgagctgtgtgagaacttcgagctgctcaaggtgctgggcactgggagcctacgtgcaacggtgttcctggtgctggaattgccgtggctgggcacgacgctggggaagctgtacgccatgaaggtgctgcgcaatgcggcgctggtgcagcgcgccaagacgcaggagcacactgcgcacctgagctgctctgtgtgctggagctggtgctgccagtgcgcccttcctggtcacgctgcactacgctttccagacgtgatgccaagcttgcacctcatcctggacgtattgtgagctgtggctggtggagattgttcaccgcagacttctaccaggcgccagtacttcaagggagggctgagggtgcgcggtgtatgggggtgagatcgttgctggccctggaacaccttgcacaagctcggcatcatttaccgagaccttgaaactggagagatgtgctgctggaactccgagggggccacaatttgtcctcaacggaacttcagggcctgatgcaatcgaagtttccttgacgggatgtgaagtacaaggatgcggggaacttcgtcacgttactgtggcaccaagtctgaggtacaattgtccccgcgaatattcaattcctggtagccaatgacagggcgtccattgtgcatactggcctgagtagcaacatgggattgccacgcccccttatgacaattcttgtgcctcccatccgaaacgtcattgacttgaagctggtggagcccatctgtgccaattttaccccatgtcaagtgctgcgaaaaactgtaaaactatgctgatgatcgttgcaagtatgatactaccgttaaggtgcaacttccgtagacaatgttagattcccacttcacatataccccaacatcggcggaatcgatgtccacatgtgatccgcacaca

SEQ ID NO: 656621 - DNA, 149 bp, Homo sapiens
ccctcgaaggatgcaggaggctcgaagataggaggcactggaggccagggacagcactgagccgtgaacatcgtccgaggggtctcggaaggatcctgaccgaatcattccctggggtctctcggccagggacagggcgctccccattt

SEQ ID NO: 656622 - DNA, 694 bp, Homo sapiens
agcggagaatgtcttcgtgctacagtgcccggcactaggtgtgtgtcatgtcccggctgcgttatctggggcccgatgggccctccttatgtggcaagtactgtggctactagtcaaggaggctcagactctggagtgggtcaaggagccgctcgagctcacctctaatcccttggggccgctgattcctggtcttcccagtcctcccattgcccacgggaatctccccatgcgcctattctcccagtagagccgtgggactttgatcagcatgggggccctctgcctatcctcagaagattgccaagatgccatccccaggaattcgagtgaacaatgtggttccagtttcgcttggacagcctgggggattcaggtctgggacgaagcaagccctctggaagcccgagaagctaggtttcattggagtatccacaggcaggggattttaaaaatggaacaatgtctgagttcacgacatggacacagaatgtcacgcatgtgatgcggaccccaaagaaagcgtggaaggcaaaccagaatcacaggtctaaaggcggttgagagcacttaggcttggacagaattagttgggacattgacaccgcccaactgtatcacagagaccttcaagatgtttagaaagagaaggagtttgggcagaattgaacattattctccagttacgagacta

SEQ ID NO: 656623 - DNA, 302 bp, Homo sapiens
  misc_feature (94)..(94): n is a, c, g, or t
  misc_feature (298)..(298): n is a, c, g, or t
ctgctcgctaccagacaattgaagagaacattaagatctttgaggaagacgcagtggaattcatcagtgtgcctgtaccagagtttgcggacancgatcctgccaacattgtgcacgacttcaacaagaaactcactgcttatttggaccttaacctggacaagtgctacgtgattcctctgaacacttccatcgttatgccgcccaaaaacctgctggagctccttattaacattaaggccgggacctacctgcctcagtcctaccttatccatgagcacatggtgatcaccgaccngcat

SEQ ID NO: 656624 - DNA, 911 bp, Homo sapiens
ccccacgagacctttctccaccaacggggccccctctctcaaaggagggggcacaccgtggcgccaagtccacaaacctgaggctcacattcaagccccccaaaggtacctcatatctagagaacgcgctgtatcgccgtcgtaaacaatgcaattgtagcaaaccccccccgcgcgtggcacagccgaacggtggtaacacccgaggaccaccaatctgccggaaaaacttctagagcagctcgccccggcaaagatctcccgcccgccacattctttaggcacggtccctctgaaaaaatttgcaagcatgttttgactcgggggaaccacacacttcagggaccctctcagcttaaaccactctggcgaatagtagatctgtttcgccgcacccccaacaaagggccagtttttcacaggttaagaaatgatcgttaaaaaccccttggggaggtagttccttttttcgaaactgctgttacgcactataggccactggtggatacctaatctcgctgagagacttgacaaagaattctctatcctcgggggataatataagagactgccgtaatattctattgttaggacacagcacactatgcaccaccctcttctacaatcttaaaccacctcttggttgactaacaacatgtctcccccccaactgtctttgttagagtgaggcttctcagacttctttctcccgcagggtgaagaaatgttttgacgcacactcaatagtaaagaaaacaatttctgtctttaagacatttcctactcgcttccacaaaaaacatttttttctcttctcataacagatagataaccagtattgtccaacagataaacatgaaacttaaaacatttcccaaaaacaaaaattacattcccgttaaaaaaaaaca

SEQ ID NO: 656625 - DNA, 480 bp, Homo sapiens
actgaactcagatggtggggaatcacataaaatggcaagagctggtacccaaaggataaggcctgggtcagagtgttagtagagggtgagaggacctttatctccaaaggcgaaaaaaagcaggtcaaaataaggatctcagccggatagtagcaatcttctagggtgctcagagggtgagaagggcacgctaaaatacgtgtttggacctccgagcaggatttcaatgagaggaagagaactcgttcttgaatgggagagagtgggagggtgcagagtaagaaagtgggaacgcgtcagtcccttcctgcaggagaggtggcggcaggagggggctcccagcagctacaatcccaacactgcttgcccgcagagaaaatgccctggcaggaaagccggccctgctcccggcttcggccgcggctgctccgacaagttgttgttggcgttggtggcggcggctgcggcggcggcggccgc

SEQ ID NO: 656626 - DNA, 281 bp, Homo sapiens
atgtatgccatttgttattaatctgtgccattaatgctgatttattctggatcactgtcggaggctgcaccactcgttgttccggataaatcatgcttcatccgcgcctgataattgcagtcacactgaacgaggcttctccacctttggctggtgtctatgtgtacgctactttggtgcgcgcgcttatatcctatgccgcatttatgctcgcggtggttgccgatgcggcaacgttgctgggcggtgcaaccgcattttgcgatgatgtagatttcagt

SEQ ID NO: 656627 - DNA, 275 bp, Homo sapiens
  misc_feature (7)..(7): n is a, c, g, or t
  misc_feature (49)..(49): n is a, c, g, or t
  misc_feature (72)..(72): n is a, c, g, or t
  misc_feature (116)..(116): n is a, c, g, or t
  misc_feature (140)..(140): n is a, c, g, or t
  misc_feature (227)..(227): n is a, c, g, or t
  misc_feature (260)..(260): n is a, c, g, or t
  misc_feature (273)..(273): n is a, c, g, or t
acgtagncactgtcatggagatatgaccattgtagacatacggcatggntggtagtttcaccttaccttggngttatgtttcttcacccataaaatatggtcatatcacgcctgcntgtagtcacttctgaagggttcancctgtatggcactgatttaatgctgtaaagttgtaggaaaatgcagctcattagacgcttgcactttgtgtgcccaagatattcctngcctgggggatcaaggttgttatagcttaaagnaggcctcaatganct

SEQ ID NO: 656628 - DNA, 105 bp, Homo sapiens
aaattattgccttcatgttgggacagaacaggtccaaatggaaaagaatgaaagagaaagacagatagacacacacacacacacagacacacacacagagagaga

SEQ ID NO: 656629 - DNA, 637 bp, Homo sapiens
ggaactgctccgctctcagctcatcctgaagcttcggcagcactatcgggagctgtgccagcagcgagagggcattgagcctccacgggagtctttcaaccgctggatgctggagcgcaaggtggtagacaaaggatctgaccccctgttgcccagcaactgtgaaccagtcgtgtcaccttccatgtttcgtgaaatcatgaacgacattcctatcaggttatcccgaatcaagttccgggcaggaacgccaagcgcctgctctttaaactatgcgcgagcgccgccaggcggctcatcgagctccagcgagctgcatcccctgacagctagggaacggtggctcaaactggaatgtggaagcacacctttagctggcttcggaaggaccactcagcctccaaggcagcgactacactgcgcactcgcctggcaccatctgcggcagcgcacgctgtggcccccacgtctcgcgccgcacgccaaggcactccgctggcacacggcatctgcagctaagatctaccacatctccctggagctacgtcaaacggactccgagagacagcaccttgccatcctcaaggcaccaacatctcagaggaggtgccggcccctgaggtggcgccccccctag

SEQ ID NO: 656630 - DNA, 1004 bp, Homo sapiens
atgagtctttgcaggaaactgtctcctccagcttctcctgccttggtctccccatattcttagcctttctatttatttcctggtgtataactttccttgctttaaagggatcttcctttaattccttgggccaatttactggccattgaacaggtcccttgagtcccaactgtgtctctggggaacctccttacccacccctgctgacctcccacttcccaccctgcagctgagtatccgtgattacaggcgattgaactgtagagtcctctctgcctctgtacctgccagcagcagcctcacagtgacccccacgccactggacaactcccaggagacctgtgcgctccgtgcagctcagctcagccgcctctcaggaagcctggagcaggtctgggggaccccccccccatcactctttacattaagctgagagtggggagaagctgtgcttggctccctgaggccaccctgatccacggggcacccgcacctctgcgttctggattcacagaccaagtctaaagcccgttcgttcctgagttggccgtcaaggccccctgaacggtactctcggtacttctgtggttttgtacaatttattagacaggacctgtcaaatagccactttagacactttacctctccagtatgcaactgttaactatatggtcatctaggacattctcgttacaaatacgaatgagcctgtccagtgtctgtgtacattataaagtgtatcccagaaaacaaacaaacacggggccgccaaaaaaacccgaggggccagtataccagtcccggttccggtcaagggccctagggggggatataagaagcagggcggttacaggcgggcgtgaaagcgcgcgggctgggacgaccacctcggggcactgggcacccagcaataccaggaaaaatagatggtcaccttttcgggaaccgcgtttatacacatcggtgtaccactataagtgctacaataatacacgaagccacac

SEQ ID NO: 656631 - DNA, 528 bp, Homo sapiens
taactcaattggaaatgcagaaatcatctgccttttgcgttgatctcactgggagctgcagactggagctgttcctattcagtcatctcgccagccacccaagaggatcttttctgagccaaagtttagcacctctgtcccagctccttccttagagaattctgaatgtgggttccacttaaagaacaacacagcatcaaggggcatctgacctctggtcatttggagacttcaaccccctattactttctatggatgaaaatcaaagcttctgctgtactgttctcagagccaaagcctgaggtgaaactcctctcctctgattttttgagcatggaatataaacaaaataattagccactcaagaggcattgcaaacattaactaacatgtaaccttgcaaaacagggaaggttcttatttgtaaatgccaatcactacacagaaaagctctaaggatttatatcctaggcaacagaaaattgctctgtaaaagaactcttcccacatgttttactaaatttacaa

SEQ ID NO: 656632 - DNA, 142 bp, Homo sapiens
cctctcgatttcactggggctaggccctatctcttgcgttttcttcaacaggcgcctttactgtgtaggtttaggttcccttgtttggcgacattgcctgggcaccgtttggtccgttcgaattacacgttgaatttttttt

SEQ ID NO: 656633 - DNA, 1155 bp, Homo sapiens
ataggggcagatctagctacatactttattcaaataccactgggaggcaaggggctaagaggcaagggcagaatgtagctatatctgcccctattattacctgtatctagcagacccccaaatcacacatgtaactcattactgtactcctgattatttatactacagtagtcccctctccatagccactcatagaccccatattaactactgacattaagcattccacataataaaattaaaggttccgagttacctgactatggtagagcctgacctaggacctgtctacttcatcatcttatcccatagtacatggtagcttcctcaaatgctatatactgaaactagctacgcagtacaatgcaaaggatagatcatcaacaagtctctctcatcacacaactacacataaataaaaaaaccaaaaacaaaaaacacacaacaacaagcaaaacagtgagtcaaacacagacacgacatttcaatataaagcaacagacagtcagaacagtaaaagcatcacttacacaaaatcagaacgtgactacgccaacagatagacagaaactcaaagtagggagggaggaggtggggcacgcgcaggggcaggcgaccgcaggggcagggagctacggagagaggaggaggacgacacaggagataagaggcgagaaggaggacggaggcgaggggagggcgagaagaaggggaagaaacgggaaggacacaagagagcacaagggaggggcagaggagaggagaggaagcgacaggaggcgagggaagagagaggacgaaggtacgaacgaagagcggagaagagagggggacgagggcaggagcaaagcagaaggaggaggagagcggccgggagagaagcagagaggagaaagagagaggagcgacgagcgaagagagagaggggagcgcgaagacgaacggggaggcaggggagcaagaggcaaaagcgcagacagcgagggggaaaggacgacgggggagaacgagagaggacggagaggacggacggggaggggcgacaagaagacggggcgagggaggaggtcaggagcggggagcgagggaaagacagcgagaggaagcgccagaagaagagagctggcgcgggcgcgaagaggggggggggacgga

SEQ ID NO: 656634 - DNA, 390 bp, Homo sapiens
tatgtggtacacatgttaattgattcgcatacgcttaactaatgccgtgccgattccaccttttgttgagaattttggcacctatgtcctttaggaatattgccctgtggtttcctttccgggttgtgcccttgcctcactttgatctctggtgctcctcacctgcctttaaccgtggtgccctcacctcactttaaccgtggttttgtagattgagtatagaaaggattaccctctcctctcaatttcctgaaatgagttccatgtatctcttccctaaatcccacgcttttctatatatgtctgacaattccacgccacatctctctgtggtcgtcgccttttgtggtgttaagatgttctcgcgtgcaatactcctacagcccgggg

SEQ ID NO: 656635 - DNA, 1380 bp, Homo sapiens
taggagtacccgccaaacaagcgggaccgagcaggaatccgtatctggggaacagagcccttggtgtcctcccttcagaaagtaaacggaacaccagaaatttcaaagtggtttagtgcccaagaaaaagcaggaatttcgtctcagcactttcttcccagaatcgctataggggtgcgtgacgtgaggattgaaagtggggcacccagaagaaataggagagtgctattgtgcccggtatcaagggaggctccgtggagttacaagtgccactgtggaggcaagttattaaccggggattaggacgggtggatagatagcatttccgggacacgtgggtggacgcccaaggaaaaccagggagtgcgatgaatagctcttcacaggcggagccgtggaccgtggagggccgtggagaggtggtgagaaacgtgggtgcaagacatttctcaccgggagtggacagaaagcaacaatcagtgggaatccactctccttataccgcggcgcgggggaaacagcgaatcagaggcgggggaactacagaaacccgcggggcgcgatgggatatgcggaagagcccaaatcaatgtgcagatggcataaacgcaccccgtggggacaagcaagtgcgtaatcaataacacggacgcagtgagagggcaaacggccatacaaaatgtggccgggaggagaaagaacagcgcgccaataaatataacccgtggagacaccgtgggacaccagaaagacactccgttaccccgtggtcagagaaagaagtccgcacaataatatcaaaagaagcggtggaacacaaaatgaggggcgacaaagaaccccccgtggggcgaacaacatccaccttacaagacgaggcccccccccccgagggggcccacacacggggcgcgcaaccatcgatagggggccgacgaaattataaaccgctgtgacacaaccagaaaggggcgtaaccaacaacactgccgacaatgggggtgccaaaaaagcataacaacaagacaaccacggccgcaatacccaaaaaccacccagcattatacctaaacccgtactcaccacatagcataagccgcagccagaagccccaaagaaggaaaagcagcttgggggacacgaagacaaaaatttgtgataaatagggcagcaccagacaaacaagtgtgagacacaaccagcgccccaaccaagagggtgcgacgccaacgacaagaaaaaatcaccggggcgggaggaaccacaaacggggtggcgaagagcaacatactacgcacacaaacaccacccgcacgagggcgtgagcaataacaccgctgtaacagcgaccacatctctggggtaagaaccaccccccag

SEQ ID NO: 656636 - DNA, 787 bp, Homo sapiens
tggagaaaaagtctcactgtttggcccaggctggggtgcaggggtgcaatctgggctcactgcaacctcagcctcccgagtagccgggattacaggtgcttgccacttgcccaactcattttggtattttagtagagacgggttttcaccttgtgggccaggctagtcttgaactcctgacctcaggtgatccacctgcctcggctcccaaagtgctgagattacgaggcgtgagccaccgtgcccagccaattcatgcctcaatttcttatatctccggatggagggattggtatcagattttttttttccctagtaccttccagctctaaaaaatttggaaatacgcttattaaaacgacaaattgaaaccgaattttactggtaatattttctggtcccagcagcttttgttttttggacattcgtggtaccacttttagggtagcatcctgcggtataaactatgtatgatatgcctcctgacctttctagtgccccccagacttttgacttttactttaaaaagaggcattttttaaggccttgaagtggataccgctatatacatctccagtgcttaggctatattgtggaagacttgtgtccgttaaggcaggagggagggagggaattttggagccacgaattttgtgggagtggccggttctataaactttaggggcaggttaaaaggtctgagaaaagggggaaaccgcgaagtggggtgcacacggagccctggagaggagggttctcaagaatgggggaacgaagacggcataca

SEQ ID NO: 656637 - DNA, 166 bp, Homo sapiens
  misc_feature (42)..(42): n is a, c, g, or t
ctgctttcaaaatacactggtggaggacaagcataagtaagncattcctagccaggggtagtggcttacacctataatcccagccctttaggacggctgaggcaggaggaccattttagcccagaagtttgagacagtttggccacatagtaagacctatctctat

SEQ ID NO: 656638 - DNA, 125 bp, Homo sapiens
ccagtcacagaggtatgaaatattaactacttacgtgtattggaggaactataagaaattcagtattgctagagcgaagaatgttctgaggagaattttgaggaaaaggctagaagggctttcta

SEQ ID NO: 656639 - DNA, 246 bp, Homo sapiens
gtgccaggtgatgagtgtatcaaggcgcatccacatgatagaggatttgactgctcgttcgactgggcgtcaccctcttagactgtgtccccgtccggagtcacatatgatgcgaattagtgcgacaccgatcggatagcgcatacagccagaaatcctggactcaagcgatcctccagcctcagcctcccgagtagcttggactaaagggcaagcgccaaccgcgcccgggaagagaactgcctg

SEQ ID NO: 656640 - DNA, 478 bp, Homo sapiens
atcagctcggtaccctcatgcctgtactcccagcactctgggaggccaggggacggatcacctgaggtcaagagtttgagaccaccctcaccgctatgccctcaccgcttaaatacaaaaaattaaccatgcatcgtggtgcacgacctgtactcccaactacatggtaagctaagagcaggggaatctgcttgaacctgggaagcggaagttgcgaatgaaccgagatatcgccgctggactcctgcctgggctagcaaaaagcaaagactccttctcaaaaaaataaaataaagagtaaacataaaaataaatgattagccaggtgtggcggcgtatgcctatagtcctagctactcagagggctgaggcaggaagatcacttgagcccagaacctcaaggctccagtaagctataatcatgccactacactccagcttgaatgacagagcaagactctgtctcaaaaaaatagaa

SEQ ID NO: 656641 - DNA, 148 bp, Homo sapiens
gacaggtgtccacatgcagtagagcaggcacggagaatgacggggggaaaatcatttaaccctgggtggaaggaaatcactggtgacctccagcgtgattcctccgtcgagcgcttttcatgttcagtcgtagggctttcaactgaca

SEQ ID NO: 656642 - DNA, 264 bp, Homo sapiens
agaatcacttgaacctgggaggcagaggttgcagtgagcccagatcacgccactgcactccagcctggtgacagagtaagactccatctcaaaaaaaaaaaaaaaaaaaaattcctttatttggggccaaaaggaaaaccccccggtattgggggcctctctccatttctccaaaacttcgggctccgtgcacttaagcctcaccttctcttggggacagggccctctttcgggaaaggggctgggtccatttcgtgctccccg

SEQ ID NO: 656643 - DNA, 514 bp, Homo sapiens
ggcacgaggccgaaccgcagcttcttggcttaaggacttttactaccaggggccgattccaaggccaactccagcaatggtttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaag

SEQ ID NO: 656644 - DNA, 133 bp, Homo sapiens
  misc_feature (11)..(11): n is a, c, g, or t
  misc_feature (46)..(46): n is a, c, g, or t
  misc_feature (55)..(55): n is a, c, g, or t
  misc_feature (90)..(90): n is a, c, g, or t
tctaactccancagaagccctagagagagcacagctcaagccaaangatatggangccagagcacatctgccgctctgagagggactccntctaagaagtcagaaccgtagcaaggagcatagcccaagcctt

SEQ ID NO: 656645 - DNA, 459 bp, Homo sapiens
acgcgacgcgcgtcaaatagacgcatcttctcctacgtaaaaatggctcgtcgcgatcaggggatagctagaacatgcaccccaccaggaacgcggcgacggttacagaatcggctcgcgcgtgaatggaaacacatacatcaggaatcccgtgctcatggcgagcggcggaatgaggatcttccgcgcattcgtcgggcgctgtggatgcccgcagccgcacaaaaatgaccgtgatggcgaacacgaggggcgaacaacggttgcaatcagcgtggtgacttcgctgtgattcacgctctcccctcgccttcctgcgagatccgacgagctgatatggcgacaatcgtttccccccatgcggactacgtgtgagtataccaccattgactcaaggctttcttgaacagggatctacaaaactgcgaactttgaaccggcggtgcggcgtgaggtacc

SEQ ID NO: 656646 - DNA, 994 bp, Homo sapiens
tgttcaggaagcgaatcagtgttctaacctctgtctacagtaatccctggtgggtggcagcctgtgtgcgccattcatgtccttggcaggtgatgtactaaaatagctgatattctatgggaaggctaattatctccaatgttttggattggtaacaggtgtatgagagtgatactgcttgatggtaggtcggattgatgtgtgtcggggtctctgttgctcgagatcgccagctaatgcatgaggcgtcatggaagggatatactggggcaaaggcccagtaaaaatgaaatgatgttgattgtcaaagaaaatcgagtttgaactatttcttgccttttggtgcaagtaatttccatatgagcttagtgacataggcaagctattgaatgaacgttaagatagaagtgtgtgtgtgatgggcgataggagaagggaatttcgcaaatgggaacgaggactagttggtgttagctggaaaattcgcggcgattgtgggcatagttgagttattgaggaatggaagcacgttcgcaaatgaaggggtagaaaggtgtaaaggcggtgaatggtataggtcacatcattgaatcaaaagtggctgtaataaaaataggcagaaatttttttgtcaatctatttcatgtaatattcttggttgggatgatctataaggagaaatgtatcgtgaaggtagagagtgggtgggatacgtgatggagagtcagtgcggatgactagtcttcagagatggtggatgacactcttcttagtgcaaacatagcgattctgtgggggatcaagagtgtgcaactctctggtagtgattacatatacagtggcttatgaattggattattctcggacaggaaattgtgggggctaaatgaggacaaggtggggagttgaacagccaattattcttcttgattggatttgtggaaacattgtgacttggccatgatggaaagggaaaaacgaaaagggcggctaa

SEQ ID NO: 656647 - DNA, 124 bp, Homo sapiens
catggacctgcgtggactgagagatcaccatggtagagcagcacatctctaagttgaagaagaagcagcaacagctggaggaggatggctgccaaggcctgcccgagccatgagaagcccgtgt

SEQ ID NO: 656648 - DNA, 455 bp, Homo sapiens
agctcggtaccggaagcatccctaagcaggaggaatgaacaactccggagccgctgcttaagagctgtaacactcaccacgaaggtctccagcttcactcctgaagccagcaagaccacgaacccaacagaaggaagacactctgaacacgtctgaacatcagaaggaataaactccgaacacaccatctttaagaactgtaacactcaccgcgagggtccatggcttcattcttgaagtccgtgagaacaagaacccaccaatttcagacacaccaccatataacagttgctcaataaaatgcttcctctttttccatttccttttgctctagatttaacattgggaaagactcaggtccagacttctttaactaaccaaattctaatttttctccagggttcacatgcggaccccagttcatggagcatttgacctcatcttccctggtctct

SEQ ID NO: 656649 - DNA, 1709 bp, Homo sapiens
  misc_feature (362)..(362): n is a, c, g, or t
  misc_feature (381)..(381): n is a, c, g, or t
  misc_feature (447)..(447): n is a, c, g, or t
  misc_feature (469)..(469): n is a, c, g, or t
  misc_feature (474)..(474): n is a, c, g, or t
  misc_feature (783)..(783): n is a, c, g, or t
  misc_feature (866)..(866): n is a, c, g, or t
  misc_feature (1709)..(1709): n is a, c, g, or t
gacggcagatgtcgcatctgctcatcgagcggagtggtccgcagccgcagttcgtgatgcctcggaatatgacttaactgttacaaggcttggttaatgcagttaggagacttgcgagtgccgtgaggtgcaccttactgccttggctctgtgacgccggggtatcgtactgaaagtgttcataacgaagtagcctacgactgcatggatctcactctgtgaggctgagactgtacaaaggatcgcgcaaacattcccagcctggaactgagagaacaacgtcatgcgaacactgtgtccatccagtgtgagcgacacatcaaagccgaggcccatggccaaccgggtctctcgggacagcnactccactgtgtcacatgncttcaccttatcccggggcgtggctccagtggtgccatggattccgtgtcgcgctcggtatcgagntgtgcgatcgtgcgatctcgangaganagctctcataaccgctctagaaccagctcgaaagcgcgatcgttgcgattctgtccgagacgattccgatccccggcgtaatcgcccaaagcacgaaagaaatcggctaagagatacattgcctccggtgcggactgagaacccaaagcgcaagagagtcccgcaaccctctcagcgcttgacctcaaaacgagagagtttgtggcagtgtcacaaacacagacacttacgatggtggccaggggcgggaagttgtggtggcctacggaagaactccctaaggtgcggcgacccaatcttccccacctnttcgtcttgttggtattgcaccacggcactgccccgaccaaaaaggagaggtggggcaccaagaacttacaactcgggtgtcngcacgaacgaacgagacacgattttccgaaattggaacttcgaattggagagcgtggggcattattggaccaaacaggtttccaccaaaagaaaaaggtgccgcgaatttggcgcgcgggcgcacatagggtttatggaccaaaggggcgccattcgtggggggggcgcgggccgggagcgtcgggggggcccccgaagaaatccttcttaaaaggggaattttccgtagcctaagtgtcagcgcgcgccctctgtgtttagagagggcgcctcctgccgttcgttctgcgcccacggggggtgggggtgtcccttcgggctctttgggattatacgccgagaggggggagcgcgcgcccccccagttgtgttttcactgtgttgccgctgtgcgaggccacacacgcgccacctggccgcaggggttcacagctctcttttcttccaccggaaaatctgtcaagtgtactttccatcctctttgggtgccacaggagagggcgcagttcgcacacagtctggcgcgggttttacaccccttttacaccccgttttttcctcttctttcatttacgctggggggaggacaattgggtggggacagtttcactccggtggagggcccgcatggggggacggagcaaggacggcctgcgggggcccctccgcgcgcgcatacgagcgcggttctctagagaggcgcaaccccttgggccctgtcttttggtgcgttttgaagacacgcccacggggttgcctcgaagagacacgcgagaggttccgctctgacgggccgcgacgaggaacgcacactcctctcgggcatctctgtgtgggatccn

SEQ ID NO: 656650 - DNA, 152 bp, Homo sapiens
gtcgatactcagatacctcgttccgcttctcggcgccgacattgccttcacttcggacttgatcaaccgacgtggcctgattattccgcccaagtacccgattaccgaaggcaccagcctcacgccctcctggcaatcaatacagcttcatt

SEQ ID NO: 656651 - DNA, 520 bp, Homo sapiens
  misc_feature (86)..(86): n is a, c, g, or t
  misc_feature (97)..(97): n is a, c, g, or t
  misc_feature (99)..(99): n is a, c, g, or t
  misc_feature (102)..(102): n is a, c, g, or t
  misc_feature (114)..(114): n is a, c, g, or t
  misc_feature (120)..(121): n is a, c, g, or t
  misc_feature (125)..(125): n is a, c, g, or t
  misc_feature (229)..(230): n is a, c, g, or t
  misc_feature (385)..(385): n is a, c, g, or t
  misc_feature (453)..(453): n is a, c, g, or t
ggtttcttacgctgctttccggaactcggaacgggccggaattcatgacggagcgctcagtgcgtagagagcggggcgatccaganccgatgagccntnacngctgcgattagntagggnncgcngccaccggcgaggacgatgccgattccgaagatgaaggatccgcccaccacggccgcgagcgcgagcgtgggaatgttcgggttgatccacgtgcggcgatcannccgttgacgcaaccgcctgaatggcaatggcaacgaggaaggcagtaagccagcgggtggatcccgaaagccacacgtcacggaaggctcccgtgacacagaacctgcctcgctggaacacgaatcctaggcctaagcccagtagtagaccggtnataatcatagttgtctccaggtatgggggtgaaaagtgttaagtgaaggcaccctgagatgtcgaagntgaccacgaattgggtatggaacgccccgtcgacgcggccgcgaatttagtagtagtaggcggccgc

SEQ ID NO: 656652 - DNA, 1449 bp, Homo sapiens
ggaaggaggcgtttgcgctgatcgtggtccgtcgtgcgccaaagccagagtcgcagccgaggggagccggggccggagcctgatcccgagccaggagccgggatactctgagcgagacggtggagaccgtgcccccggctcgtgctccgctgccgtcagcgagccattgtccaggacaatgtagggaaggatgtgccagggtagttctcacatacatgatgactatcagtcatctcgcaggctacgatggtgcaattcagggttggctacagttcccgctagtacgcgttatgagcggaattatgacgatttgcggctagttgaatcctttgctaccacgatatttcagacatcacacatactagagcttattgctctcatcgtggtaaaaggggtgccatacggttggcttggacctttcacgcattttgaatggcattctcaacggaaagtttggtagcgcacaggggtgcctggatggcggttgacagcaaatggagttgacatataaatttatttgaatttatacggttaggcttacatcgcaggggatctagtacctggaagtgttgaaaccaaagagtttctgccttactccctatgggttccccattgttgtgcatgcgtttgggaacccagtttttgtttgtccatggagaaggccatttcaaaaggcacggacgtagtacaaaacgctgccgaaggtggccattgggagtggcttaggcgtattgcttgtgttggaagtccccagaggtgccttatgggcgtgatgttaccccaatggggttggggtacaccgggggacgccaagatggtgccttccgaaatgttggtttaaccggtttcctcggggtaggggagaggggatttgctctttggcgaccggtttccttatacgaagatgcggacacaactacctcgttagagggttgccccccggcaggttctggagccacgaacggcatttataaatacttaggcggccgctcaaagagtccatagggttttgttgtaacagcgtccggctggacggacttttacgcttgacaggggtaggcgccttgggagaaaagaatttgccctatgccagcttcgatgggagagcgagatacggtcgctttagcacttggcgtttgacattgagagccaatttgactgtggcaaccttccttagtgtggtgtgaccccggggacatgggcctggctcggtactacaatattagccagagggccttctttgagagcccttggtacccatttcttcttggcgttgggggtgtatagcatacacacttagcgcccatggaattctggatagcgtagaggagagtacggttctactactgttcgatgtggagacggtgatactcttcgctgctattgtgagcttcaccagggttcattacgaatatagggatcactgtacatgtgcgcgcattattctgg

SEQ ID NO: 656653 - DNA, 257 bp, Homo sapiens
tgtaaaggtccagccgcatttcatgagcagagaaggagcttggagcgggtcaggacagaggactatctcaaacggaagatacgttcccgtgcggagagatcggagctggtcagggatgcacattttgggaggagagctcgggtggagccattccttccgggccaggcggttgaggctgaggagagccagattagccggatgacctcaatgagaaggatggcccagggggcctggcccccatgggaggctgggtggga

SEQ ID NO: 656654 - DNA, 471 bp, Homo sapiens
gcgcatgtgaaaaatgtagcgaatgatttgatcataagatcctgattgtccgactaaaaaatgtcttcgacatgacactgttacaatattggcatctacaggcaactgctctatacaatcaagtgatttggaacctgaaggtgaccagtgtgtctatggtccgatcggccctacgtgctctagatgttagcttggctctgagatattatgacagcatctgtagaaagtgccaatgtcacggccatgtggacccagttaaaactccaaaatttgtaagcccgagagtggtgagtgcatcaactgcctccataacaccactgggttttggtgtgagaactgcctagaaggttatgttcacgacctcgagggaaattgcatcaagaaagaagttattcttccaacacctgaaggttctaccattttggtttccaatgcctctttgaccacatcagtgcccacccctgttataaa

SEQ ID NO: 656655 - DNA, 584 bp, Homo sapiens
ctcttaatacggtgctagaactgccatcttatgtctggtatcaagaacatgtgtggaatctgcgtctatgtatacgagctatattctactgtgatcaatagatattctctaagcgtcaatctcagtacacagtactcgattatctagcacgcatggtcctctatacggtctgtatgctaatattctcctccttaaatccaaactgaatggtctaaaaaagcatatcatggccatcttcgtgatacccaagttgctatacgacgttcccgtcgtattcattgtgtgatataacgctcgcatctaatgtagtgtatctttcttctacgtggctggtactgtacatggaatcttatgccatctcttctcaacagcaacttgataatgcacttgctctggatctgttcttaggcagtggactcagaaagccaacatgtggctgcctcacagcccataagccagtatttttgctgcttctgaatacaaacttggttggtctcttgacttcagacttgaacttactgtagcctcagatgatttcccccctccgcctccaggaagaaagaatactaccgcgcgtaataaat

SEQ ID NO: 656656 - DNA, 127 bp, Homo sapiens
  misc_feature (35)..(35): n is a, c, g, or t
  misc_feature (69)..(69): n is a, c, g, or t
  misc_feature (84)..(84): n is a, c, g, or t
  misc_feature (97)..(97): n is a, c, g, or t
tagctgggactacagacgtatgccatcacacctgngcaaatttttttatttttcagtagagacggtttncgccgtgttggccangggtggtctcaangactcctgggctcatggatctgcctgcctc

SEQ ID NO: 656657 - DNA, 425 bp, Homo sapiens
  misc_feature (130)..(130): n is a, c, g, or t
aacgccgaaatggccaagattaaggctcgggacctgcgcggcaagaagaaggaggagctgttgaaacaactggacgatctgaaggtggaattgtcccagcttcgggtcgccaaagtgacaggcggcgcgngtccaagctctccaagatacgagtcgttcgcaagtctatcgcccgagtcctcactgttattaaccagactcaaaaagaaaacctcaggaaattctacaagggcaagaaatacaagcccctagacctgcgacccaagaagactagagccatgcccgccggtcaccaagcacgaggagaagctgaagaccaagaagcagcagcggaaggagcggctgtatcctctgcgcaagtatgcagtcaaggcctgagatgacaacgacaataaagtgcgagactgactggcaaaaaaaaaaaa

SEQ ID NO: 656658 - DNA, 672 bp, Homo sapiens
aatgaatcttggccaggcgcagtggctcacgcctctaatcccagcactttgagaggccaggtgggcaggtcacctgcaggtcaggagttcgagaccagcctggccagtgtggcaaaaccctgcctactaaaaatacaaaaattagccaggcatggtggtgcgcacctgtagtcccagctactcgggaggctgaggcaggagaatcgcttgaactgggaggcagagggcagatcatgccatgtgaattgccgagactgggcaacagagtaagactctgactcaagaaattgaattgaatgaatgaatgaacgaatgaatgtactatgtagctgattactgggattgcaggtaccgagtttgtgctgaatgatatgttggggtaaatcagggtgcttatagaatttcggcgtaatgctggaagctgccactaattttgcatttaaatagagcataagaggaatgtatttttacaagaggagtgaatgaggttaaaatcagagattgcgaatgggtgataaatatgcgaagctaattcaggtgtaggatatgatgactttcttatggctaaatatgttgctttcatacgttgcagtgcttacagttccgacagctttacaagaaaacatttccatatcgtgtattcgtgggtatacttaaataattgtcacaata

SEQ ID NO: 656659 - DNA, 613 bp, Homo sapiens
gggcctgctcaccgacagcgtaggtgctaccaacgctgtcgtgcgccgccgccatttggatggcaggaagagtccggttctgggacagctggagacagtggtggtgaatgaaataactgtgaccaaaggaaagctatttgcgaacgtatcattctcccagctggggatggcctgaatgtgctgttgtaacagatgcctaggactggtttcctatcgtcccaggatttagctctttctagtttaaaagggttgtccaatcccaagagcctttatcgactgcgaggatcgatcaggttgcggatgagtcttcagtgtggctgcatgaaaccgtccagatgtaatgctctcgaacagtgtgggccgtgatgaaaactatgggaccgctattgggacctcaagattaaggaggttcgaagcttcacttggagagacaataggtttacgatggtcacaatcaaggggacgggattccacagaagaaaagcctggttcattacaaacttagcctgatgtactagcagaacctttatcaagtgataggaatgaggttaggtgatgggacaatatgtgagtgaaatgtcaggggtaaatgatgccctgttgggaccagaat

SEQ ID NO: 656660 - DNA, 411 bp, Homo sapiens
gtcgactaaataaaatgaaggcaaccaggaaagtgatatggaggaaggggaaaggcacagggttactgagaatgggacagagatcaaggctccaggaacattaatagctgtaagatgcgttttgtgtgcctggggtgcacaaaaacacatggcagcagataattgttaaattcgagtacatgatggcccttgttggggctgattttaatgctagttgggactgcttttgaatccaagtgatgttcttctctgattctggtcatatgaaagacaaaattggagatgttaagtagaaagcctgcgtaggctggtggtaaagggtcagacactaacattgttttgctgaggggaagggtaactgtgactcatggtttcagaagtgtcagtccaggaactgctctatccattgct

SEQ ID NO: 656661 - DNA, 197 bp, Homo sapiens
  misc_feature (85)..(85): n is a, c, g, or t
ctgtgttggccaggatggtctcgatgtcctgacctcgtgatccgcccgcctcagcctcccagagtgctgggattacaggcgtgancaccacgcccggcccatcagtacttctgaaaagttgttatgtagcatatccagtaaccttcattcattgtttcctccaacaggcatttgtttgaccaggtactgtctgcaac

SEQ ID NO: 656662 - DNA, 186 bp, Homo sapiens
gatgataggcttatgatagcacgagatgaagtggtagtagatggggaagcttagaaaacgagtaacataatcaatcttttgagatttaattttgttgtggctgaggttgaatttctttaatgatgagttgcattgactgactgaatttgcagtcacagcctcaatttcattgaaccggatagcttg

SEQ ID NO: 656663 - DNA, 493 bp, Homo sapiens
ttagtgtgggcttcagcgcactggccacctcccgaacactccatgatgtcactgtactacctagatgccaggagctgctgggaaggggtctctaaaacaagaggctccagggcagatgtggtggcttacgcacgtattccaaacactctgggaggccgaggtgggaagactgctttaggctaggagttcaagaccagcttgggcaacatagaaagacccgatctctattaaaaatttagaaattcagctgggcacggtggctcatgcctgtaatcccagtattttgggaggccaatgggggtggatcacctgaggttaggagttcgagagcagcctggccaacatggcaaaaccccatctctaataaaaatacaaaaattagccgggtgtgtagatgggcacctgtaatcccagctgctggggaggctaaggtggagaatcgcttgaacctaggaggtggacgttgcagtggtgcctggagtaccgagctcga

SEQ ID NO: 656664 - DNA, 318 bp, Homo sapiens
cctccttatttatcaacatctttttcctccccttccctgagagctctcagagcaatgtttcaaaagccccctttggacagggtttcaacaactcagaaaggtttactttttttttttttaaaaaagaattaaaatccattctggtggggcccccttttttcttccaaattccggctggggttggggggaatccccgttcccaaaccccccttgttgagttggaccccctgtaaccccttgggtacctgccaagtcatgatggagacttcaggttgttctgtataaaatgcaaaataaatgtttttattaccaaaaaaa

SEQ ID NO: 656665 - DNA, 858 bp, Homo sapiens
acacggaaagggtacagaacccggaactgtctaaagatagaacgcccgctggaacccgggtccaggcgggaaaatacctccgggaactgtggtctacaggaccttcatagaccccggtgcagatgcgtcccaccccaggcagagcccggcagcgggggaggtcccagtattccgggccccacaatagctgtgagtcccccggccaaatgggatggcgcgtgcgagtcccaaaggtggctaaaaaaaatccggctgcacacggcaggggaccaccaggaggagcgcccaacagttgcgcaggagtgtgggactatcagaccacgtctctacgaggatggatcgtgcagctcccggctccagtgtgaggacccgggtgccctcatgaaaaacttgtagagcccggatttgagaacccccctgtgcggttgtgcggtcccccaggctccctcacgtaggtgcaggttacgaagggcaggcccgtcgccccccgatgtggcaagtcgccggaaaaacaccgggggatagagggcccagtccccggcccacgggctgtgtagcccggtggaaaacgacacagctgcacagcctgtggcgcgcgagatgatcgcctgctggacgccgcaccgcggaggaaacgggaagacgagatcaaacttgcggcggatagcaacacgtgtggcagcccggcaactcctgaccggcacgcgccgccaggaagcccgccgccccctgcgcagagtgcagggaccacaatagttgttggagaacaggacccaaagtggtggggccctgcccccgagagccggggacccttggggggccgggggcccaacaaaaagccaagcgttaacaataaca

SEQ ID NO: 656666 - DNA, 375 bp, Homo sapiens
aatgaaaagattataagcaaaccctggagaaccaaaatgagacgaaaagtctgttcgcttcattcattggccctcgacaatccgtaggcctacccgcgcgcagatactgatcattgctatttcccgcctctatagatccccaccgccaagtatctcatcaacaagcgacgaatcaccacgcagcgatgactaatcaaacgaaccgcagaacaaatgataaccatacgcaacgactaaaggacgaacctgagctcttatacatagtatccttaatcatttatattgccagcgactaacctcctcggaactcctgcgcttactcatttacaccaaccagccaactatctatgaacctagccatgggccatcgggggg

SEQ ID NO: 656667 - DNA, 289 bp, Homo sapiens
cgtctggtgctgcatgtggagggcacacagttggtgcaggaaggagtggagcatgggttacagggcagcctgaggagaaagtctaagagaaaccggattagtagagaagggccactcgggcacagggtcctggccaattctccccttcggatgcctctcaaacccatcttccgtgctttctctggccagactccctggtcccaacctccggcatctttgccttgagtacaccttcatggcgcttcctgtaactggagtctccccaaagcccactttggggacccttcct

SEQ ID NO: 656668 - DNA, 105 bp, Homo sapiens
accggcaaaatcatttgaagaaaacaatgaagcggaaatcaaaccaaaaagcacgaatcctactttcttatattaaacccccatacgggcctacacacattttta

SEQ ID NO: 656669 - DNA, 223 bp, Homo sapiens
  misc_feature (9)..(9): n is a, c, g, or t
  misc_feature (36)..(36): n is a, c, g, or t
  misc_feature (171)..(171): n is a, c, g, or t
  misc_feature (183)..(183): n is a, c, g, or t
  misc_feature (194)..(194): n is a, c, g, or t
  misc_feature (215)..(215): n is a, c, g, or t
tccaggctnagtgaaatgtggatctccactcaccanaacctccgcctcctgggttcaagcgattctcccgcctcagccccccgagcagctgggactacaggcaggcgccactactaattttgtattttcagtagggcacgggttcccccacgttggccaggctgaggcagnagaatcgcttgnacccgggaggnggaggctgcagtgagccgagntcgcacca

SEQ ID NO: 656670 - DNA, 98 bp, Homo sapiens
aagaaggaaagaagaaaggaaggaaggaaggagaaaaaaagaaagagaaggaaaagggaagggaagggaagagaagggaaaggaagaaggaaagaagt

SEQ ID NO: 656671 - DNA, 125 bp, Homo sapiens
  misc_feature (90)..(90): n is a, c, g, or t
taaactaagtactaatttcagatcatctctctatgaatgcatacagctgactctacacctttcagaaaaagccaggtcaccctcttggantgctttgctgccttagaaaatttcttccacccaga

SEQ ID NO: 656672 - DNA, 1055 bp, Homo sapiens
aaccccaaggtgcgtcccaacccagcccgcttccatgcagaactgccgggcacctggtggcttcatgagcaaccgcttagtagaaacccaacctcttcctggcaggagcattccagcatccaaagcagcccagccgcagacagccaacaaattcttccaggcagctgcagcaagagcctggcacgcattccctgaggatttctgtcggcacaaggtgctgccccagactgctgaccgcacttcgagttcggcaaatgctggggaccgattgtcctcacgccaccatctatcaaggatgggcaagttcctgagcgctgaggagtatcagcagaagatcatccctgatggatggtcaagatgttctcatccactgaccgggccatgcgcatccgccatccatgcagacagatggagcagttcatccagtaccttgaccgagccaacagtcaacacccagatcttaccacccacgatcgtacatggcttcctggacaccaaccctgccatccgggaagcagacaggtcaagtccatgctgatcctggacccaaagctgaacgaggcaaaccatcaagtggagctgactgaagcacattgcacggcatacaggcccaaggatgaacagggacccaaccgatgaaaacaccacaagtcatgctgggcaaaaacgggtacatacactacaagggcatagcaacaccacaacaggagacataacactctggccttagacaaaacaataaggaaccagaatgacacgatcaagggaaagaagaatgttcatagatattaagtaaccaaaaaaataacgtacaaaaaaatgtgaccacaaaacaccgtcccgctagcacaaggacacaacggacgaccccacagaacaccggagacaaacgcggcaccacacgaccaaagaaaactcaggagaaaaaggcaccaagaccgaagagcaacacacaagagacactatacagactaccgaaaccagacaccaccgagaacgaacacaccaacgacgaagccacacaacgacctcaacacacgatgcccacacaaccc

SEQ ID NO: 656673 - DNA, 167 bp, Homo sapiens
cgtgtgtcacaccgtctatgtacaaaatagtgggaagatttataggtagaagcgacaaacctaccgatgctggtgatagcttggttgtccaagatagaatcttagttcaactttaaatttgaccacaagaaacctctaaatccccttggtaaatttaaccttgttag

SEQ ID NO: 656674 - DNA, 615 bp, Homo sapiens
catgctagctatttggagaaggatgggaacagatggatggcaccgtcactactacaaggatactccgtgtatgaactccttggagagacctactatagctgagtgcttgacatacactttgataataggtagttcgtgtatcagtacgggtactcgtcctgtgagtagcactacccaggcttgtgtaagctcacgtgtatgacaggtaatagaacaaggactcctaatagtacgataggaccatgagaaacctatataacaacttagtgactccatatgtactgatatgttgcgtgagataggagcctgagcatgacggccagggatgcaatggtgaacatggctaggtacgactatgtctactagagggacttcatcaagagcaatgtgttactatatagcggagactacataccgagacatcggcaacttgggaataccaacggaggcgatatgccagccaattagcactataaccagggcattcaacgaggatttcatgcgccacttgcgggatcttgacccttaaatcgttggaagacttggatgacactataaggtgcttctctaatctagtttgggcccagacaacgagttccccatgttacaatggca

SEQ ID NO: 656675 - DNA, 168 bp, Homo sapiens
gttcgccaacacggtgctgtcgggcgtgcccaccatgtatctgggcattgctgacaggatgcagatggagatcaccgccctggcgcccagtctaccatgtaagtatcaagatcatcgcacccccagagcgcaagtactcggtgtggatcggtggctttcccctgccct

SEQ ID NO: 656676 - DNA, 446 bp, Homo sapiens
  misc_feature (359)..(359): n is a, c, g, or t
  misc_feature (394)..(394): n is a, c, g, or t
  misc_feature (417)..(417): n is a, c, g, or t
ccagaactgggttctgacaggtgggagccagcagctctgaaggctgggggcagagggttttgaggggacccaggttagtggggcattggctagccctgggccgtgggtatcactcagtgtcttgcagtaggtgttgatactttcgaagccacattgtttcttgggttcttacacatctttatatcacgtttttataaccatcaccctttccaatcaaaatatttattgccaattttttcttttaaatattttcaattttcaaagtgtgtagtgcgtgcattgttttaaaagtttggtagtactttttggccgtttgatatttaactccgtttctttttttttgagacgggagttttgcnttgtcgcccagtcccggagttgcagttgacgtgantcttcagctcactgcaagctttngccttccggggttcaaaaccattctcttg

SEQ ID NO: 656677 - DNA, 890 bp, Homo sapiens
  misc_feature (9)..(9): n is a, c, g, or t
  misc_feature (66)..(66): n is a, c, g, or t
  misc_feature (69)..(69): n is a, c, g, or t
  misc_feature (86)..(86): n is a, c, g, or t
  misc_feature (93)..(93): n is a, c, g, or t
  misc_feature (95)..(95): n is a, c, g, or t
  misc_feature (131)..(131): n is a, c, g, or t
  misc_feature (138)..(138): n is a, c, g, or t
  misc_feature (151)..(152): n is a, c, g, or t
  misc_feature (170)..(170): n is a, c, g, or t
  misc_feature (174)..(174): n is a, c, g, or t
  misc_feature (184)..(184): n is a, c, g, or t
  misc_feature (190)..(190): n is a, c, g, or t
  misc_feature (194)..(194): n is a, c, g, or t
  misc_feature (206)..(206): n is a, c, g, or t
  misc_feature (241)..(241): n is a, c, g, or t
  misc_feature (291)..(291): n is a, c, g, or t
  misc_feature (297)..(297): n is a, c, g, or t
  misc_feature (324)..(324): n is a, c, g, or t
  misc_feature (349)..(349): n is a, c, g, or t
  misc_feature (355)..(355): n is a, c, g, or t
  misc_feature (357)..(357): n is a, c, g, or t
  misc_feature (361)..(361): n is a, c, g, or t
  misc_feature (367)..(367): n is a, c, g, or t
  misc_feature (414)..(416): n is a, c, g, or t
  misc_feature (548)..(548): n is a, c, g, or t
  misc_feature (602)..(602): n is a, c, g, or t
  misc_feature (813)..(813): n is a, c, g, or t
  misc_feature (859)..(859): n is a, c, g, or t
ctccctttngcctttttgagggaaccaggcagacctggaagtggaactttgttgttagcaccaggngcngcccacagctgggctcngcaacangncagcacatggccctgttgcctccacctgagagtctngggaggngctggtggcaganngctccctgcaggatgtcncctnaatgactctnagattnacanaccccctcttcncccacaacccctgtaaacatgagaatgggctcgtnacaccctcaacacctcaggacaagatgagggtccgagatgtgtggcttgnctttangcggcccaggagctgccgggctttctnctgcatgaaaagctggtcccttgtncccccncntgcnaccgtnttctaggcactgtttttttttggcatgtgtctgtgttagtggcttcnnngcttctgggccactgctgccttctcgggcttggcctgcaagaagccctggttgagcaagctgttgtcttctttgatacctgacagggtgaggctggaagagtttgaaggggcagttgtcggcaaggataganacttgggcagtgtggacatcatcagcttcatatcctcatccacaatgtcaaganccagagacttccggactttcttgatggggctccgcgcagcccaggcttcctcttctgcttctcgggcctgatgtcgtcctcgatgatgagttcgatgccagcctcagaacgcagcacctccttcaagtcctcctccaggtgcggggtctgtggcaggggcttcagggggtccgtacttctccagggcgttcttgaacggggttggcgtgtngggagtgttgtccatggagtacttctgatctggggttacaacgcancatgtttctggtgcagggtgtcttgtccggt

SEQ ID NO: 656678 - DNA, 348 bp, Homo sapiens
aattatggttagcactgtctattaaatatctcgattaattttcaaaaaaaaaaaaaaaaaaaaaaaaaaaaaaaaaaaaaaaaaaaaaaaaaaaaaaaaaaaaaaaaaaaaaaaaaaaaaaaaaaaaaggggggggacagggccccaaaatacacataaaagggagaaaaaaaaaaaaaaagggggcaggggtaaaaaataaaaaaagtgggaaaaaagccgaggtatcccaagcaaaacggagggcgcttttcaaaaaatgggaaaccgtaaagggaaaagggaaaaataaaaagctaaaatattttgaaaaaatcggataaaagtttgggaaagggcaacatttcg

SEQ ID NO: 656679 - DNA, 403 bp, Homo sapiens
tagctgtcctggacgcgtggttatccttgagtctggacagtactccgagtacagcagatggaataggttgagttcttaatcatggagtttacaaggtcatagttcagtatttcagagagaagcctaacatagacgatatgtttgcccacaaaaggaataaaaagactaatgaaaatggtaaattattggcttagggctggaatgtgagtacctaggtctgcctacatggtgccagtcagaagcatgattggtgttgtacatgcctttatgtagcaaaatataattctttaataaatgcagttgggtagacataatcttttaagacacaggacataggggagtaaaaagaaggcctgggtgataaaaaagtttgaaaccactgaattaaattaccttcaaatcc

SEQ ID NO: 656680 - DNA, 81 bp, Homo sapiens
tccgccccccccccctccacgcgccccgcgcgcgcgggagggcgcgtgccccgccgcgcgccgggaccggggtccggtgcg

SEQ ID NO: 656681 - DNA, 327 bp, Homo sapiens
gagtacagaacagttcagaacaaaaacagattcgcaagctgctttcattaattcaactaaatggcatgccataagaatgcaattcgacatagaaggaagaggatgaatttgggaaaagtctgcaggccgtaccatggtcagaaatcatggactgaatgtgggaatgagaaaaagctaggagttaaggtttctggcttagtgaatgttactgctatattctcgacaggggaatactattgaaggagggggactgtagaaaaagatgatcaacacatttcggacatattgaatttgaggtacccattagacatttaaagtgacatcaga

SEQ ID NO: 656682 - DNA, 469 bp, Homo sapiens
  misc_feature (144)..(144): n is a, c, g, or t
  misc_feature (148)..(148): n is a, c, g, or t
  misc_feature (155)..(155): n is a, c, g, or t
  misc_feature (157)..(157): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (170)..(170): n is a, c, g, or t
  misc_feature (173)..(174): n is a, c, g, or t
ggccgcgtcgactttttttttactttttttggtcacagaaaattttaagttttaagagaaactcctacagtgattggcatcaaagtaggtagtgttccctccctcccaccaaacaaaagaagtcccttatcacctgaggaatgnccantaaatantnantnantatttanttnnatggctggctggctatattaagctgttttgtttttaggggaaaatggtgttacttctaacacagaaagagtgctgaattaaaatctttctctgcagcaatatctattgagaggtgctgactgttttgctacagcatgcaactcaaaagtggctgaaaatatgcagctttgggagtctacagatcattgcaggagctaaaggtctagtcatttttttttaaccaaaggtaatctgcagcagctggtaaccgtggaggtctctgcacaggtttgtgccaagaatatgcctgtgtgaa

SEQ ID NO: 656683 - DNA, 1136 bp, Homo sapiens
cgttgggcgccttggccggggtttggccgggtagctcctgtgctgtgtgtccccgtggtgtacgtcggtgttcctcgacccgtctcccgtcgccctgtagtgtgtcgttcgcctttgtcccgttttggttccctctttggtcctacgtcagctacagttccggtggtgccatcgttgctgtctcgggtctcccatgcttgcgtgcagggagctatcctttcgtgctgcctcttggttgctcgggcctctcgttatctctctcccgccggtgtccactgttgttcgttatcatcgctgcggccccatctcaagcctatggtggtgatcataggtcgaagctctcggccactattgaaaccttaaaggccctttcggtttgggatatggacacgctgggacatccttcgattccggtaagcattatgaagcaagtagtgttgtcataagtacatgccgtgtactagggtctcggatcgaggttgaaggttctttggtcaatgttacgtaatgagcagtgttgggccccactgtctggggagtacacgtggctggtcttgtccagggcctctagttggtacatcatggggtgtctcattggaaagctctctgatgtgcacctcgcttttgtgcataagttatattgctgtctcgagcaatagtcagatattccgtgtctttcaccccctgaagctaagacatcagggagtatttcagaggccagcgtatggagtcatcgacaagcgaaaagccgatgaaacccagggtccagtcagtggtagcctcagcagactcagggcctggtccattgcataattgactgtcacgggtggagtttgatctggccagacccgatcctccttcatgaacacccagcaacctgagcaaagtccgcgagccctgccactcatgcgagcaccggacatggcagtaccacgggacagctcagtgttggagggcacacctcgaaccacgagccagggtctggggcttgcatgtcattgtctatgacagcgtcaagactggcccttaggcaccagtagctgtgatggaaaccctcccctctgagactccacgtgaggacgtggctgagtgaaatcttcctcgtcagtggtgcaattaccgtcatcgataagctc

SEQ ID NO: 656684 - DNA, 361 bp, Homo sapiens
  misc_feature (33)..(33): n is a, c, g, or t
  misc_feature (70)..(70): n is a, c, g, or t
tagaaaaaaagtgaaaagaaaagtgaccaaaanctagtttgcaacaaggttaaaatcaccccttacaagnacaaaccagaaccatgggtgaagagacgtcatgcatcaatgtcttacagcggttgcaagcttagaatgaattcaccttttcacagtatccgagatctatgattacaacagtgtcatccgcctgtacctggagcagcaagtgcattttcacgatacaatcccaagaaagctgaggcaccccctcagccgctttccagtgatgtaggacagaacgggccttgaagagaatgccgcgtgctttctcctgacttggggcaatgcaattcaaaactttttttcccctattattcag

SEQ ID NO: 656685 - DNA, 135 bp, Homo sapiens
acggcgagaacgctcaattatattccagtttaaggccactcctcctgctgtgacttttgaactaactggggagacagacaacagtatttgtgatagaacggagagggacttctagtattacaacatgagccttgg

SEQ ID NO: 656686 - DNA, 958 bp, Homo sapiens
cggagggtgctgctgggggggttttcagcgccgtgtgtggattcgcgctatgtgggaggccctggccggtggtggaccgcgtgagggctgtgggggggtcggggtgcggggatgtaattcgctggccggcggtggcttggaggaccaggcgctgggcagggggcgtgaggtcgagcctggtgggtagtcttggcgggcagggggtgtgtaataagggtgggtctccacaatcgcggccgtgcgggcgcgcggctcataagaattccccgagcgcttgtgtttttgtggcagaccggctggctctacgcttggggacaactgtcgatgtggaaacaccgagtgttggccgcccggagtagtcagagaagcgtgggccgggtgcatcagactgtcgggattgttatgctctctgggcggcgcgggctggggttacaaggatgtgtggaatcgcgggggcaacagctactgggcctctcttggaaggcgctatgtttatgggggatatagatgaggtccgctggtgtggcacgggaagaaaatagctaggtgtgtgggcacgcgggagtgtcgggagacttctcccggggacgatttattctaccccgcgcgttaacagggtttttttcgagttatgcaagggcacacatgcgagtggacacagtcttagccgtcacacagagcagggttacctccgttgatattccctatggatcttctggcaaccgtgatgctagaaccctcgcgtctgaatggagaaatatcactgtggtttttgtattatagctgactgctaggaggcgccgctctggacctaagtctctgcttgggaattgatgcccacactattgcacaaatataactcccttccaccatataacctttttttcggccttccatcattttgacccttaacctcaaaatttaacgaaaaaaagaataaccccaaaagataagatta

SEQ ID NO: 656687 - DNA, 556 bp, Homo sapiens
atagcgttcagaggatacggaaggactcggccaacagtatgacaaaaagtgaagaatctggataatgcgttaatagcaattataatgtattattggtatattgtacgtaaactaaagaactattgagaacaatcctttgagataaatggagcagattcgatccattatatgaagaaagcaatgtaaagtattcatgtcttgcttaggttcatactgatgagtgacagccaggaaaagaatgcactacgacttgaaagttctataatgctcttacattagtaattacgagtctttcactcccaaatctgtgagtcctaagagaacatagtaccctctcatttatctgcatcagtggagatgtatgtaagaacatatttcaaatcatcacttagaggctgagtaaaggtgggtacccctgagatcccctcacctcactccttgaagttcggctagagaaggacagttgatggaaggtaactagaaaaatacaaaggcggtctgcatctgacttgctagtataggcagcagaattatagctgaatctatatacttaccc

SEQ ID NO: 656688 - DNA, 361 bp, Homo sapiens
gtatcgttgtttaaaccaggcgcaggatagtacacttttccgatcatcccctcttgacgttcttcaattttattgacaattggtaacaatgttgcggtggtgtcattcacataagaaattgaaccggttggcgcaatcgcatgacgataggcatgatacatcccatacttcatgacattttcctttaattctaaccagtcacgttgtgttggcacgtggtgattagcaaaggcagcggcaacttttggtgtttttggtgcccaatcttgcgtgagatacttatcaaaatatgttccctcggcgtacgctgtacttgtcaaactcaaagaacttttcttgggcgtgtctctgtccaacttca

SEQ ID NO: 656689 - DNA, 1799 bp, Homo sapiens
  misc_feature (149)..(149): n is a, c, g, or t
  misc_feature (528)..(529): n is a, c, g, or t
  misc_feature (697)..(697): n is a, c, g, or t
  misc_feature (1433)..(1433): n is a, c, g, or t
cggtcacacgaccttaaggccgaacaaagtgaaaaccattatgctgagtgatatcccacttaacccatggcccgggggggagctccagctgccatagctattcgaactatagcttaaggaagtgtaacaagagaaaagggtatctctanctttgcctaaaagtcccctgagtgtccgacctctcctaggtacctcgtccggacgtttaacgggtcctagtataagaaaaccccctagtaacagtaggacagccctctccagtagacataccaatcaagggagtaagaactgaagacaccaagggtgtcttctccacccacctgatcgtcctcctgaccgtcatttcgaacacgtgggacatctacgcaactaaagttttataagaaccaacactaagtaagccacttttaggtctcttctgtgttacctacaagcgacaaatccgaccccagcttactgaaaatgttataaaaactcccgtcatagtcccctacctccacttgttagtccacaacccggacaactcgnnaaagataccaatgatcaaggacctcatcattgacgatggagtctccgtaatagtcaagaaccccttccacgggaacgttaaagattcctcgttccaaagaaacattgtcgacacaggtactctagtgtgtctttcaagagtaaagacttcctttacataggtctcttngtctaccatgttaaaggtatcacattaaagagaagaaacctatcctgaggaccctttcgtaccccttcggttccaaggatgtaggtaatgtgcctcaattacgaagggtttcaggactaccgggtgtgcataaaagtagtagtaggagaagaaggtgaagaggaccactgtttaactaacatctactccaagaatgtgagaccgaaggtaaaaagggttcaagaaggagactttagaacgagtttaatagattcgatcgaccagactataacacaccgtgttcgagaagtttgcttattaggaaaagaactgtctcaaaataaagtaggttctcaaaactattaagaggtcactgccaaagtgaaaaccagaaaacccttcctctgagttgtcctctactttacacacaaagaacacaacgtagaaggacatgtccggaagctcctgacatctagaagggtgcggaagatttatgagaacattctcacaacgttagacctctctaaagactctacctacaagaaagtcttacaggttctgtcaagatggattcgataggaaatacaaccgtagttaaggacaaagattgtcttgagcatgttgtaggtggaaaggtttgtttcgacgaagtacttcacgtgaggggaaaagacaaactgtcgagtgtaggtaaggacggaggtcgtcgtggacgtgctgacgaaacaccggtaacgcgcgtcgttccacttcaccncacacgaacgctcacaacgtcgagtaattcaatcctacacgtgactactagtaaaaatggtgagattcggcaggcatctcacggcctttataccaacatatacgcgacgcttgtgacttgagatgcggtgaggtgtttactacaaaagtccacagtacctgacaacggtggtacataagtaggtctcaagctaaggacgtcgggccccctaggtgatcaagatctcgccggcgtggcgccacctcgaggtcgaaaacaagggaaatcactcccaattaacttcggcttaagacgtctataggtagtgtgaccgccggcgagctcgtacgtagatctcccgggttaagcgggatatcactcagcata

SEQ ID NO: 656690 - DNA, 182 bp, Homo sapiens
gagctagtctccaactcaaaaaaaaaaaaaaaacccaaccttccccttccttaaaggggccccacccccgggtttaatggtttttggggcccccctgcaacccttggatagccaaaacccccaggggggcccgggcctggatttcaaaatattggcaaggcttgttctttttcggaaaaaaa

SEQ ID NO: 656691 - DNA, 133 bp, Homo sapiens
actgaccaagcgtagtacccaaaaccacaaacataaactgggtacctggtatttccataaacagtgcagctcaagcaaaccagtttcagcagcacaacatttaaccagagattcaagcattatatcccattct

SEQ ID NO: 656692 - DNA, 144 bp, Homo sapiens
tctgctacccaagaacgagaatacagcaacatggtccgttgtaggcattggccccgtgtgtgatttttttcccaaaaagctatccttggcattcttgctggagtggccttgctccaccctaccttgtcattggcccttatcgag

SEQ ID NO: 656693 - DNA, 434 bp, Homo sapiens
ccccctctagctgccatcaattgtgctgtaactcatgtcactaatcaacaggtttttccatgtgacttctcctaactcctttcagtctattcgttacacagcaccccaagggaggctggcaccccaagggaggctgttaaaaagtaagtcaaggctgggcgtggtggctcaccccttaatttcagcattttgggaggccaaggcaggcggatcacctgaggtcaggagttcgagcccatcctcgccaacatggtgaaacctcgtttctactaaaatacaaaaattagctggatgtggtggcacacccctgtaatcctagctactcaggaagctgaagcaggagaatcacttgaacccaggaggcggaggttgcagtgggccgaggctgcgcccctgtactccagcctgggtgaacagaatgagactttgtctca

SEQ ID NO: 656694 - DNA, 1541 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggatgtttttgtttccggatgatgtcttgtgggttccaagaagttaatggaccgagagccagtgaagctgctggtgcgaaggctggagtcaggtgtcctccggggactcaccacccgcccgagaggggagagacacatgcgattctggaagctgagagcattgcttattgttgattccttggttgccgtgctgagtcctgctttaaggaagcaggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccag

SEQ ID NO: 656695 - DNA, 252 bp, Homo sapiens
  misc_feature (6)..(6): n is a, c, g, or t
  misc_feature (34)..(34): n is a, c, g, or t
  misc_feature (78)..(78): n is a, c, g, or t
  misc_feature (82)..(82): n is a, c, g, or t
  misc_feature (166)..(166): n is a, c, g, or t
  misc_feature (214)..(214): n is a, c, g, or t
cagggntctcctctgagaaccacctgtgcctctnggcctcctgcctagcctgggccttctggcacagggacccctgcntttnagccagcaggctaatggtagggagtgagggttgggagacagctaagggggctgtggtcagtttgagggggctcaaattccagtntgcccctttaaggcccctggttggctcagaatctcctgaggccctggncaggttaaatttgtcctgtctgtcattagccttgactt

SEQ ID NO: 656696 - DNA, 373 bp, Homo sapiens
ctcaggctggaatgcagtggcatgatcttggcacactgcaacctccatctatgggagtcaagcgattgtcctgctgcagcctcctgagtagctgggattacaggcacctgccaccatgcccatctctactaaaaatacaaaaacaacaaaacaaaaacaaaaaacacctcagctgggtgtggtggtgcaggcctgtaatctcagctgctccagaggctgaggcatgagaatcccttgaaccacagatgcagaggttgcagtgaactgagatcgtgccactgcactccatcctgggcaacagagtgagactcggtctcaagagggaaaataaggcatttttctcatttaaataataaatagtattccattaaaa

SEQ ID NO: 656697 - DNA, 218 bp, Homo sapiens
atgggtgggctgtgtatgatatgacatgaaaggctggaatgaaaggcgggtgggtttgaaggccaggacccatgcgccctcatgtccgcttctgggaagggacagccttgaggcacatgagtcctggccatgccatacctacgccatcactcacattcttaacttctgacaaatctagctcaccactcatctgctttgtcattgcactacgttcaaca

SEQ ID NO: 656698 - DNA, 1586 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggatgtttttgtttccggatgatgtcttgtgggttccaagaagttaatggaccgagagccagtgaagctgctggtgcgaaggctggagtcaggtgtcctccggggactcaccacccgcccgagaggggagagacacatgcgattctggaagctgagagcattgcttattgttgattccttggttgccgtgctgagtcctgctttaaggaagcaggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagaaaaaaaaaaaaggggggcgcaaaatttcctagaggggccaattg

SEQ ID NO: 656699 - DNA, 156 bp, Homo sapiens
gagaggatcccctgcttggcgagagaggagtcgcccgttaaaagcacaatcacggctactacattaacagtaagtgggaacggaaggaatttagagatgctgtcatagacatttcgtccccacataactgctttaacaaggctggtaaagttgtca

SEQ ID NO: 656700 - DNA, 393 bp, Homo sapiens
cttgcttgcaactgttcagcagccaccctgcggttcttattgtccgtccatggccgtgcaggtcgccgctggtaggagctggggctgtgcgggaattagcatgtcacaggccaggcactgagtcgcgtctatcttgttgaagaagtggcacctggccaatcccttgaaaggatctggttgtggtttagcggtttctttctccatccattcctgacgccggcttctcaattttcttatttctgttctagcatgtattcctgtgcagtgaactccacggtcttgtcgggcagcttggtgcttatgaaccgcagggtctcttatgtgaaatttgctttgcagatccttatggatctcatcgtcatcaaagctaaggatacttgcatacagaacagg

SEQ ID NO: 656701 - DNA, 1251 bp, Homo sapiens
  misc_feature (1079)..(1079): n is a, c, g, or t
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggggaagggtttggacgtccagcctctgcaagcaggagcccagcctgtctgccctcaccccngaagtcccagtcacagcagttttgtgggaaaatgaaaaactcacagagcacaagacaggcgttttcttgagaagtcaagcagctgaagcctcctgggactcgaaattacacaactttttagcatattttgatcttagtcattttaagcatgataaatacttgagtcaaaaaa

SEQ ID NO: 656702 - DNA, 397 bp, Homo sapiens
  misc_feature (159)..(159): n is a, c, g, or t
  misc_feature (353)..(353): n is a, c, g, or t
  misc_feature (355)..(355): n is a, c, g, or t
  misc_feature (385)..(385): n is a, c, g, or t
  misc_feature (389)..(389): n is a, c, g, or t
aggattgcgttcacctgcaagctcaggcattcgtgccgcaaaagggctttgatgaaaaagccgcctacttcggccacaacctgcatgaccatgcctgcgcagcagtgcacaacctcagtgacgacggccaaccatttttgaacgtagcgtgcactacgncgccctgagcctggcaagtgtcgagcatgtgcgtgaggtggtcgccaaggatggcatgcagacgctgcttgccttcagccaccttgcagccgagctggaaagcgtcgatgagcccagtgccgagcaacgccagcgcatcactgtcgggctttatttctacactgaagctaccgatcccgattcgtcgaagacancnggcccatgactcttcttgcgcgctgcctcngtgncccttggg

SEQ ID NO: 656703 - DNA, 251 bp, Homo sapiens
  misc_feature (11)..(11): n is a, c, g, or t
  misc_feature (58)..(58): n is a, c, g, or t
  misc_feature (83)..(83): n is a, c, g, or t
  misc_feature (87)..(87): n is a, c, g, or t
  misc_feature (199)..(199): n is a, c, g, or t
gacttttcctnattcaagtacatggatcttccaacaaggcccgatccagcatgtgctncatctggagagttcccatgagagancagncaactcaagccttctggccgcatggacccgatggctcgcattactgtgtagtgttttacgtctccatggtaactgtgccctgcacccctcggtagccgccctgttagttttnagtctccttttctttctcacctttatgcacttccctcactgccctacccggt

SEQ ID NO: 656704 - DNA, 3210 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 656705 - DNA, 198 bp, Homo sapiens
aaggtagcgcggaccaacaggcaggttgactgggcatcgattttatacagataccctaagccgtcttgaatttcccccctgaaaatcagctcttccttttgatcggacttggccaggctgcagtatttgtgcaaactgttaggtctccacttctcattgaagatagatagttccaagcttggaaatcactttacttat

SEQ ID NO: 656706 - DNA, 3096 bp, Homo sapiens
tgcaccgcacaaagcgcatgcacgctggagagctgtggttgtgtgtgtctgaaattcacatttgaccgggcgtattagccagttctggccctgattccctggaagggcatgcgccggtggccttggaaactgcgtctcaccctggctgtcccttcacaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgggaggtgcggcagaaggtccagctcaccattgctgaggcttttggcatcagcgcatcctcgctgcatctgaccaagcccaccttcttctcccgcataaacagcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 656707 - DNA, 3334 bp, Homo sapiens
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattctggacttgcactcaggggccctgtctgtcgggaagcactttgtgaacctgtacagatacttcggggataaaatacagaacatcttctcagaggaggacttccggttataccgcacggaagcgcggacggcgcacgacgagtactggcatgcgcacgtggacaaggtgacctacggctccttcgactacacctcgctgctgtacctctccaactacctggaggacttcggcggagggcggttcatgttcatggaggagggtgccaacaagacggtggagccgagagctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 656708 - DNA, 3693 bp, Homo sapiens
ggcacgaggcacagctcacgaggctcagctgtcctccatccttccccctgtcctttggtgcctctgtttgcaagatgtgcagaaacaccagagggccagaggagaccctccttttactgaatgctggcagcctcctgagaaccacgtctgccagcagcagagagcagagagtgtggacgagcatgggcgactgaggtcccaaatggcgcgagccgctgggccctcctgcttgtgccgatgtctcaggctcgattgaagctggaagaaaccaaggacaatgtgtcctttaaaagtgtaaggttagaaggtgccctgactccagccgacctggaaaaggacgtgtcctgcatatctggaggtggcccacagggtccgggaaagatcggctgccttgcctgcatcccagggcgcttcccggcctccattaagaggtgaccattgcatccacgtgatttcttttgctccactatttccaggcacagtgcaactgactccctcttgaagctagaatgccctgcacacccgggatggacttctctcccctttcaaagatcgagtgaagtttgcaaatgtgaaaggaaggaattgcatttccagtggtaacctttgaaggggaatgaaattgtcacaggacgtcaggagccacgtgggggagcccggtgtcctctgagtctcaacgccccttgcttcccgcttggtgacggtcgatggctgtgtccagcggtgaacgctttaccacaggactctacggtggggtaggcagcgccacttcaatgtgaagacaaatgaactggcgtctcttgagataggcccctgcctccaggacctctcaggccccgggccctggttactgccgtggaagctgcctgttcagacgtcatctctatcaccccttgaagggagacagagaggtgtttgcgagttggatgttttatcttgtctttcctgattctttgttagaacacccccagggcttggtttttgttctcaacctgtgattagaaataagatcctaaagtgtcagatctggaaggcccatgagagctgaggagatcaaatgcccggagctcgggagatcagatgacctggggtgtctggagccagtggtggcctcatctgcagcatcttcctctgtcctgcccaccacagagtccctgctggccccggggggcccctcctccgccacagggcccctgagcattgctgcgtttgtttctccagctcctccttcctgcagaagcagttcccagaggggcaatttctccagcctgcctggtcgcgtctccttcttcacctcggggtccgagaacctacaccgcgtggagaaggtccactggggcacccgttacgccatcaccatcgccttcagctgcaaccccgaccatggcatcgaggacccagcgttcccgtagccagcagccgggccaaggtaacttcaggagggcccgtgtggaggcagccgcgccagtcgtgcacccacccccacgtccacccgctcctgttgcacagagtgccttaggaattctctgattttgatttgctgacgtgttaatcttttcatctgtgagtaaatgaagggaaccagcttttcacttctccagcatcatgtgtgcttgggctgtaggcctgggagcctgaggtggaggccaggaaagggacccagcaggacggggcacaagtccccatctgtgaatggacgggactcatccacccaggttcagcaaccccccgggactcgtccaggttcagcaaccccccggcccatcaaagactggctaaagcatcagccataaatggggacaaacgtggggccagcagcttctgttcggggtctcggcatcagcaaaccgcagcagctttggagaagggtccgtgagtggcggctctggaggcagcaacggggtcctttggggtgggtgggagttctgctggattcaggtggaggtgaacatctgccgttcccacagccctgcgtgcacccccaatgctgctggcccacaaatcaccgtgggccacggccccaccacaccaggcttggccctgtcagcggccagcatcccgagggccagggtccgagtgtcctcaccaaggaggctcttggcgtcgctgtgccggctcccatgggccttctgctgggtcgagggtaggtctcctcctccccctttgccctggcattaaactgatggtcaggctgggcgcggtggctcacacctgtaatctcagcactgcgggaggccgaggcaggaggatcacttgaggtcaggagttcaagaccagcctggccaacatggcgaaaccctgtctctactaaaaacacaaaaacaaattaatcccagctactggggaggctgaggcaggagaatcgcttgaacccagggggcagaagttgcagtgagccgagatcgtgccactacactccagcctgggtgacagagtgagactccatcttaaaaatataaaaataaagtggtggtcagaggagccccgaatagaccagttgtggagaggcctgggtggggtggctggcagggagggcaggccaagcccagtttctgcccacagtcacctcgaggtgactgtccagggctttgggcaccttcccgggagggggacggccgcccaccctgagtggtgttggaagctgggctctcctggatgccctgacccagctgcctggggagagccctgggcccctcctccctcagcacctcctccctcagcccctcctgcctcggtccctcctcccttagcctgtctggcatagatccatgttccctagcccctggcacaggtgcctctgactggagtgagggcctactgtggcccgggagctgctctgggggttgataaagggcagcattattgggtcctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggaaggagcgggcgtgaggccagctgaggcatggtgacccctgggtatgggggacttgggggccgcaccttggtttgcccagggcccctcctgcaccacgggccacatgcggaggacggcgtgggataggctccctgggtccacagcttctgcccgtgtatggggaaccctccttggtcagggctgcaggctctgggcagatggggcaggaaccctgaggctcccgcgccctcccatggcctctgatgtgggacactggagcgaggcacgattctgaaggactccatggatctgggaggatgaggcccacctccggttggtggccaaagccgtccttgcggggccggctgcttcacggacactctccgggtcgggctggtgggccccatcgtgggtgggaagtcgcctgagcctgggccgcccttgagcttctcccagtcttgactttccagagggtccgtggctgtggtcatggtcggggcaggtggaaaatgctgcatggaaacctgatcctgtcaccttggagtaaatgatgatgtcgccggcttctcgccacgtctaaaggataaatgcatttgaagaaagtgggtgttgggtttgttatgggttaaagtgcttttgaaataagtaaattattagtttgattttc

SEQ ID NO: 656709 - DNA, 460 bp, Homo sapiens
  misc_feature (13)..(13): n is a, c, g, or t
  misc_feature (16)..(16): n is a, c, g, or t
  misc_feature (33)..(33): n is a, c, g, or t
  misc_feature (37)..(37): n is a, c, g, or t
  misc_feature (45)..(45): n is a, c, g, or t
  misc_feature (89)..(89): n is a, c, g, or t
  misc_feature (124)..(124): n is a, c, g, or t
  misc_feature (163)..(163): n is a, c, g, or t
  misc_feature (198)..(198): n is a, c, g, or t
  misc_feature (205)..(205): n is a, c, g, or t
  misc_feature (390)..(390): n is a, c, g, or t
  misc_feature (437)..(437): n is a, c, g, or t
  misc_feature (448)..(448): n is a, c, g, or t
tcgagatcttacnccnaaaatttgacccatggnaaangtccatcngtcataccttgttttttaatgaaaaaatatctgaaccattcacnaagtctggtctatgtgcttaatgaaatgcctgttncttgtataccactggacaaccacaaaccatttctcttcnaaataacaatatccgcaagcagatatatagagacnatgtgtntaaaaattaaatgaaagcaaagctctggaaactcagcctcctctctcaaatgaaaatactacagagatagcacaagataaacgggagccctggttctgcagagctcttctggacgaaagagtcattttctccctttaacaactatcaagaaatttttttgttttagatccctcctgctggtcacntttagaatggctcttaaaaaggttctgaactattgtctcctcagttnaaggtttcagngactcaaagtca

SEQ ID NO: 656710 - DNA, 1128 bp, Homo sapiens
  misc_feature (663)..(663): n is a, c, g, or t
gcggccgccgcctccgctctgagccccgccccgctcggccgccgattgctcgggcctggccgccagcccaggggccgatggccgagcgcgtcgcactcgcgtccctgcgccgtgcctgcctcgcgctccctgttacggcgttcgtccccgggcctggcgcccgcgtccggcccggctccgcggcggcctggtccgatggctcctcagcggagggccgcaaccaaggcgcccgagggcaacggagcggccgagcgccggaaccggagcagcaccaagaaggaccgagccccgcgggaggtgcagaggctgtggcagaggccgtggctaaggaccgcgggcctgggggctggctttgtgctcaccgcactcctgctctggagcagcttgggggccgacgacggggtcgcagaggtcctggcccgccgtggcgaggtcgtggcagggagattcatcgaggtgccctgctctgaggactacgacagtcaccgcaggttcgaaggctgcactccccgaaagtgcggcagaggtgtcaccgatgtcgtcatcaccagggaggaagcggagcggattcgcagcgtagctgaaaaggggctctccctgggaggatctgacggaggggcatccattcccggaccggcgtgcctgcctcgtgctccgctgttncggcgttcgtccccgggcctggagccctgcgtccggtccggctccgcaggtggcctggtccgatggctcctcagcggagggccggaagcaagggcgcccggagggcaacggagcggtcgagcgccggaacctggagcagtaccaagaaggaccgagccccgcgggacggtgcacgaggctggttggcagaggcccagtgggctaaggaccgcgggcctggagggctggctttgtggctcgccgcactccctgctctgggagcagcttgggggccgacgcacgtgggtcgcaagaggtcctgggccccggcgtggacgaaggtcgcgggcaagggagaaacactcgagggtggcacgggagctggagggagtaccgacagggcaccagaaggggacgaaggcgctgcaagacccagcaaagatgcggccaaacagtgtcaaccgaagagtaggacaaccagccaag

SEQ ID NO: 656711 - DNA, 900 bp, Homo sapiens
agcgggaggggactgacgccgagacgcgcgcgggtcagcggcgcggggacgcggggcgctgggcgcggggctgggggcgcaggccccgaggccgcaggagcgcacggagcggcgatgagcaggcggaccggtggaccggggggcgcggagcccgtgacagcctcggccaggcgggcgctgtgatggaggccgagaggcctggaactggctcctggtgccactgcaccagctggtgtcctggggtcgcggccgcggcgcatggtcttcgagatgggtgtggtgccctacgtcccgtcgagtatctggagacattcggcaagggacgcagtaacgccgacggtttctccacctactgttgtgctcatggtgctgctggtgggcaatattttgcgggatagtcttctgagtcttgctctgtcgccaggctggagtgcagtggtacaagtctcggctcactgcagcctctgactcctgggttcaagtgattctcctgcctcagcctcctggagtagtctgggcactacgaggtgcctgccagcgatacccaggtttggcaggcgctttgagtccccgctgctgtggcagagcgccatcgatgatcctgacatgctgcttgatgcttgaagctgtgcaccgaggtccgtgtggcccacgagcttcaatgtctggtgccgctcctttgcaggttgcgatgccgggtgtcagaagtcatgttgcccccaggcggtcctctccggcctcaggatggtgctcctgtggacatgcgttgagccttcaagacggtctctctgctgagggtgccctctgcgtttccgggtgccgctgctcgcggtgcggggcgctggccctgggcggccggcttgcgtcccccgaggggctccgtgcccgggcggccgcggg

SEQ ID NO: 656712 - DNA, 515 bp, Homo sapiens
  misc_feature (449)..(449): n is a, c, g, or t
  misc_feature (477)..(477): n is a, c, g, or t
taattcaattaaaacccttcccttaaaatttttttctttcgaaggggggggttttttaaatttgaattaggaacggtatgaagtcatagataataggccctgtccccttaggtagtaggaaaaattccaatttttttaaatcatttatttggatttttatgttttattagcattttcaaaaagacgggttttttagagaataatcatatatatgcctacgtaaaaatggcccccagtgacttatttggagttgttagttgccccgccccctagtttgttagggcatttgagccccccttttaattttcctctaattaaaaagggcaggattttcagtgtcaaaaatatttaactatttaaagaatgatttccccctttatgttttaaaatcctaggcatctgcggtaaaaaaattttaaaaaaagtttggaatttaaaaaaaaacttgngttactaatttgtaaaacccaaatttgngcaatggaaaataaaaatcccaaagttgttttactaga

SEQ ID NO: 656713 - DNA, 209 bp, Homo sapiens
  misc_feature (186)..(186): n is a, c, g, or t
  misc_feature (207)..(207): n is a, c, g, or t
ggggcctgtagtcccagctactcggggggctgaggcgggagaatggcgtgaacccaggaggcggagcttgcagtgagccacgatcgcgccactgcagtccagcctgggagacagagcgagactccgtctcaaaaataaataaataaataaaattaagtagataatgtcattaccactggacattgngccagtttgtacttctaccgngg

SEQ ID NO: 656714 - DNA, 532 bp, Homo sapiens
attaaaaatctacttgggatgttggataacaaagtatcccagtaggatggcccttgtttattgttcttttaagacagagtctcgctctgttgccaggctgcagtgctatagtgcggtggcgtgatctcggctcactgcaaccctgcctcccgggttcaagctattctcttgcctcaacctccccagtagctgggattacaggtgcccaccatcacgcccagctaattttggtatatgaagtagagacggggtttcatcatgttggccaagctggtcttgaaactcctgacctcaactgatctgcccgcctcggcctcccaaaagtgctgggattacaggcgtgagccatcgggcctggccaggatggcgccttccttagagatgtctctcaatctttagtactcagtatggctagaaaattggtgtggggatccgaaaggttactttcctatgactagaaactcagtgaccctggttcatagggtaggttcatccaatccagtgtaagcctccgggaaaatcaagaagatcc

SEQ ID NO: 656715 - DNA, 779 bp, Homo sapiens
agcgggcgtgtgccatgaagacccggtccgggagcagtcgactgccggagactcgggaggctgagctttcctcggcctgagccagccagaccccgggcactggctcaccctcattcgccgccacgtccgcgaaggcctcacgcgcgaggccaggcgaggccccgagggcccaccattcacgacaccggagcgaacgggcgccagagggtggaacccccttgcccgaatcctgccggtgggaagtggctgcagtttgaatccaaacgggcacttcgcgggaagacagccgttcggaccaccgcagttcccgggggcttcccaaaggggcctttgtgaccggacgccgaccatccggcgtcttacgtccgcggaaagcacccggggaaacacaatccgaccctcggggagaacaatgcttgagatgcgaggaaagccgtgtcttgggaacatcggaattctaaccccaagggtgacagggatcaagacaggcgaggtgcaatcaatgctgaatttccaagggtcgaactggaagtttcgaacggaaagacagaatcgccggagaatagttattacaaaattcaatttttcagctggaatatctggtaccggttggtgaacaagcttcacgatgggttggtgccacggaaaaaaaaacagggggttatacagtgaactcaggtttattgttattaggaagcgcaaacaatatttttatggggtattggagactagaaagaagttgggaacagaaacgtattagtagaggattggggaatgac

SEQ ID NO: 656716 - DNA, 141 bp, Homo sapiens
ggggggggttttttttccccccccccccccttggggttggggggggttttccccccccagggggtgtttttttttcccccccactttggtttttggggggccccctttttccctttttttagaccccaaaggctgttttta

SEQ ID NO: 656717 - DNA, 141 bp, Homo sapiens
atatttcttcatagcagtgtgagaatggattaatagatacgtatgataaagtttataaattggacgcagtaagagattaacaataaaatagaacaattataataatacactataataaaatgtatgtgtaattctctaccc

SEQ ID NO: 656718 - DNA, 218 bp, Homo sapiens
ggcatcaaataattttatcatgccctctcacaggtattgtgttataattgtaagcccatattacttgtcgttcagtcagttatgtctctataggtaacataatgacagtagtgtaaagtttctgttccagaaacatatattgtaaagttactttataacaagatacctgccacaggaaatggtcttactttcaaatgacttttaaagcatgtattatt

SEQ ID NO: 656719 - DNA, 107 bp, Homo sapiens
tgacacttgacagattttcctgagtgaacctgcggacgctgcgcggtactacaatcagagctgaggctgggtctcacaccctgcagtgaatgcatggttgcgagttg

SEQ ID NO: 656720 - DNA, 146 bp, Homo sapiens
caattccattccagcgtatcgcaagcgaccgcaggtcagactctccaaattcatacttcttggaccaccccaggggtgcgtatcgtaagcgttctgggatgatcgcatgaaaccaggccagcaggaagtacgcgggaatggaatgg

SEQ ID NO: 656721 - DNA, 328 bp, Homo sapiens
atcctaactaaattggggcttgtaatactcggtattatgtgccaaggtattgaagaacctctacacagtgagaggcccagagcaaaggtggatcctcgcgccagcatgaagactcgtacacaggtgtttgtgagaagacctggtacatacgtgtgtggacatagttggaaatgccggctgaataaagtgagtggtttttagtgactaaaggagaataaccgaaaattgagagagtggggaatgttctatgttctatgtaaaagggaaaaagagagacatacggctccctctctggatttcaagattagatctactagccttttatcac

SEQ ID NO: 656722 - DNA, 574 bp, Homo sapiens
tatacgaatatcggcgggtagtaattgatttaaaacgtgaacatagggtattcccctgctgtcgttggtcggatcccgctgttcctcatctgttaaattggaccggacttctaccgatataacttggttcatggcgctaactcccttgtctgttctcccacatctgctaaatttatagtcttgtaaacccatcgagggaccaagtttccacttattcatgccctccaaaatggtcccctctactgtaggcaccggtgtgtattctttttgaccagctaacccattgtaattccatcccaaataggcaaatctcaaggcgatgaacctggtattatgtttagaaaagtcaaacttcttcggaccctttttcgccttgcttctcgtaccctcttcttgcgaaattttgcgctttttgttatcctcccccccctggaatttttcagaatgtggcttatttgcgttttctagttcagtgatccttcgtattagctgctctttggaccagtttgcgtaaatggagtccttcttactaacaatagcattggtacctgttgaaatccctttcattttccca

SEQ ID NO: 656723 - DNA, 216 bp, Homo sapiens
ggctcgaagtcgggcagagcaggtatgagcctgatgggttctgcccttcaccgccaggttttggtgttttcttaatttatgttagagatggagttcactcttgtcgcacaggcgggagtgcaagggtgcgatctcggctcactgcaaccttcaatcacctcccaggttcaagtgattctccggcctcagcctcccaagtagctgggattacaggca

SEQ ID NO: 656724 - DNA, 1751 bp, Homo sapiens
  misc_feature (1248)..(1248): n is a, c, g, or t
gcgggcgggagcctcggcgcggactgcggggcgcgtggcggctgctggggcacgcgggcccgagcgggactggccggctgcgagtgggcggcctgcggagctggggctgggaggggacggtcctgccgggaggaggcggaggcaggacagggtggggttgcgggcccggcgccgcccctcccggctcctggctcccctcgcctggtgccccgcgcctggccgggaggcggcgggtctcgatcgcgcgggcctccctggaggggcgcgggctctggcggcggggaggcccctgctcagcgcaatggcgggcttgcatccttgggtgattttttcgggccccttgtggcctttgctcacgcctagagagcaaaccacccgcaccacccaggagcagataaaatcgagaccacagcctgcaagggagcgcgcctccatcctgtttgcccctcgggtcgccgtctgagggcgggcccgtgcccgctcagagcctacatccgagtcgtataaagcgctgacagcagagaaagctgcggctttgctccgtgcagatgagcaggggctgagggaggacgctgtgctctcagtagccgcgcttggcccggggaccctgcaggcttagaaacgtgagtcacgcctgcagcgtggcgaggaaacgccgttgatgtggcatcctcagcctggggttgtggctttaagccagaaggtcaaaaaaagaagtcttcctgagctgagactgccctgagtcgctttaggggcgaaattccgagcatccggttgcatttcctgaggatgacacgcgtggtgggtgtggacggcctacaggggtccatcctcagcggcccctctgcagggcagagtctcgctctcactctcccagctgactcctctcaagcctgttaaccattgtacacgttcccaaggactccaagcaggttggacttcagggaacattgcagtttgggtcttggccattgtttacactccaccttgcataagtgcttgaggatcacacaaccagatacgtagatcatccgtagatcatcgcagtcacatcgaagatttgtttataataggaaaaaaaaaagctgcccactgtcatgcgctgggaaactggtgagctgaaggatgacccatctgtaaatggggtgctccctaatggacagggcacccttcagaagcctgtgctgtgtctccttgaccccactgtgagctccccgtcccgcacgctgatctaaatcaagctgctancctcatggagaggcgtccgcacggcagccccggccctgagatgcggggcagtcacccattcaattaggaaacaccagcaagtgccagaagcttctcattagcaggtcagctttcaataactggtttatccaggtgtgtgagacccgataagcagaagggaaagctcttagcgacctatccagctgctctgcactgggctcctgacatcccagaaatcagtacatctgtcttctggggtccaagaggtatttcagtttctctggctttgtttcccgtcatttgtacctggccctgcagactaccccagtatttccatcataatacccctgtgggcaggtgcatacctcatgacaatatttaatattaatagatttctgtgttgtctccagaatggaaaggggctgtctattccttgagctagttggcttgctaaagactattgacttcattcttcttttcctatctacctaataaaccagtgttcatacaacccaaaaaaaaaa

SEQ ID NO: 656725 - DNA, 1677 bp, Homo sapiens
  misc_feature (1174)..(1174): n is a, c, g, or t
gcgggcgggagcctcggcgcggactgcggggcgcgtggcggctgctggggcacgcgggcccgagcgggactggccggctgcgagtgggcggcctgcggagctggggctgggaggggacggtcctgccgggaggaggcggaggcaggacagggtggggttgcgggcccggcgccgcccctcccggctcctggctcccctcgcctggtgccccgcgcctgctcagcgcaatggcgggcttgcatccttgggtgattttttcgggccccttgtggcctttgctcacgcctagagagcaaaccacccgcaccacccaggagcagataaaatcgagaccacagcctgcaagggagcgcgcctccatcctgtttgcccctcgggtcgccgtctgagggcgggcccgtgcccgctcagagcctacatccgagtcgtataaagcgctgacagcagagaaagctgcggctttgctccgtgcagatgagcaggggctgagggaggacgctgtgctctcagtagccgcgcttggcccggggaccctgcaggcttagaaacgtgagtcacgcctgcagcgtggcgaggaaacgccgttgatgtggcatcctcagcctggggttgtggctttaagccagaaggtcaaaaaaagaagtcttcctgagctgagactgccctgagtcgctttaggggcgaaattccgagcatccggttgcatttcctgaggatgacacgcgtggtgggtgtggacggcctacaggggtccatcctcagcggcccctctgcagggcagagtctcgctctcactctcccagctgactcctctcaagcctgttaaccattgtacacgttcccaaggactccaagcaggttggacttcagggaacattgcagtttgggtcttggccattgtttacactccaccttgcataagtgcttgaggatcacacaaccagatacgtagatcatccgtagatcatcgcagtcacatcgaagatttgtttataataggaaaaaaaaaagctgcccactgtcatgcgctgggaaactggtgagctgaaggatgacccatctgtaaatggggtgctccctaatggacagggcacccttcagaagcctgtgctgtgtctccttgaccccactgtgagctccccgtcccgcacgctgatctaaatcaagctgctancctcatggagaggcgtccgcacggcagccccggccctgagatgcggggcagtcacccattcaattaggaaacaccagcaagtgccagaagcttctcattagcaggtcagctttcaataactggtttatccaggtgtgtgagacccgataagcagaagggaaagctcttagcgacctatccagctgctctgcactgggctcctgacatcccagaaatcagtacatctgtcttctggggtccaagaggtatttcagtttctctggctttgtttcccgtcatttgtacctggccctgcagactaccccagtatttccatcataatacccctgtgggcaggtgcatacctcatgacaatatttaatattaatagatttctgtgttgtctccagaatggaaaggggctgtctattccttgagctagttggcttgctaaagactattgacttcattcttcttttcctatctacctaataaaccagtgttcatacaacccaaaaaaaaaa

SEQ ID NO: 656726 - DNA, 1701 bp, Homo sapiens
  misc_feature (1248)..(1248): n is a, c, g, or t
gcgggcgggagcctcggcgcggactgcggggcgcgtggcggctgctggggcacgcgggcccgagcgggactggccggctgcgagtgggcggcctgcggagctggggctgggaggggacggtcctgccgggaggaggcggaggcaggacagggtggggttgcgggcccggcgccgcccctcccggctcctggctcccctcgcctggtgccccgcgcctggccgggaggcggcgggtctcgatcgcgcgggcctccctggaggggcgcgggctctggcggcggggaggcccctgctcagcgcaatggcgggcttgcatccttgggtgattttttcgggccccttgtggcctttgctcacgcctagagagcaaaccacccgcaccacccaggagcagataaaatcgagaccacagcctgcaagggagcgcgcctccatcctgtttgcccctcgggtcgccgtctgagggcgggcccgtgcccgctcagagcctacatccgagtcgtataaagcgctgacagcagagaaagctgcggctttgctccgtgcagatgagcaggggctgagggaggacgctgtgctctcagtagccgcgcttggcccggggaccctgcaggcttagaaacgtgagtcacgcctgcagcgtggcgaggaaacgccgttgatgtggcatcctcagcctggggttgtggctttaagccagaaggtcaaaaaaagaagtcttcctgagctgagactgccctgagtcgctttaggggcgaaattccgagcatccggttgcatttcctgaggatgacacgcgtggtgggtgtggacggcctacaggggtccatcctcagcggcccctctgcagggcagagtctcgctctcactctcccagctgactcctctcaagcctgttaaccattgtacacgttcccaaggactccaagcaggttggacttcagggaacattgcagtttgggtcttggccattgtttacactccaccttgcataagtgcttgaggatcacacaaccagatacgtagatcatccgtagatcatcgcagtcacatcgaagatttgtttataataggaaaaaaaaaagctgcccactgtcatgcgctgggaaactggtgagctgaaggatgacccatctgtaaatggggtgctccctaatggacagggcacccttcagaagcctgtgctgtgtctccttgaccccactgtgagctccccgtcccgcacgctgatctaaatcaagctgctancctcatggagaggcgtccgcacggcagccccggccctgagatgcggggcagtcacccattcaattaggaaacaccagcaagtgccagaagcttctcattagcagaagggaaagctcttagcgacctatccagctgctctgcactgggctcctgacatcccagaaatcagtacatctgtcttctggggtccaagaggtatttcagtttctctggctttgtttcccgtcatttgtacctggccctgcagactaccccagtatttccatcataatacccctgtgggcaggtgcatacctcatgacaatatttaatattaatagatttctgtgttgtctccagaatggaaaggggctgtctattccttgagctagttggcttgctaaagactattgacttcattcttcttttcctatctacctaataaaccagtgttcatacaacccaaaaaaaaaa

SEQ ID NO: 656727 - DNA, 956 bp, Homo sapiens
ccctgcagtcgtggagctggtgacctcctggttcctctggacaaggaaggaaaggtgcctcttcctctggccatggcctgtgccagtgcttggggcccaaaagaggagctggatttcagcttcacttgccctttagcaccggctctgttccagcccagtgcaatggctgagcaggtgcttgtgtgtgggcacagggaaagactatagcagagtgtccccataccatcttagcacaggaatccagcttgatggcaccatcttagcacagtactctccctctgtgtgtgtactgtgggcccccaccatcttagcacagtactccagcctaatgcacctattgtagaactttctctctgtgtgtactgaaaatcaagtaagctctgcaaagcaatcaatgttccacaaggtgagggggcatttgagacccagtggtgtatgtgcttccgaaagagactgcacatcctcttgccagctcccacatccagaaaagcctggtgttcccaaccctcaaccgtcaaaaatattttattataatctatgtatgggtctctctctgtctctgtctctgtctctgtctctctctctctctctctctctgtgtgtgtgtgtgtgtgtgtgtgtgtgtgtgagcgcgcgccttgtgtgtgtgttgtgtatttggcgcggggggtcacaagaacaattgggggaggtggctctcaaccatcacgtgggtcctgggagaaccacgtgggtgtcagctgggggcgttagcatttggaatgcctaacccaaatttacgggggtgccgacgcgggtggtaaccccggagtgggcactgtgcgacaatacagggcaccccttgattaaagcccaacagatgggattcacaaggcgcttagacacgcgtaatggaaggacaattgtgtacccctttgtctctaggatggagcccgccttcgtcatcgcccgaattt

SEQ ID NO: 656728 - DNA, 92 bp, Homo sapiens
ccctttttttatgggttttttttccggggggggttgcttttttctggggtctttgagccccaaaaaataaacacttcctttgggggggggca

SEQ ID NO: 656729 - DNA, 235 bp, Homo sapiens
tgcagagaatcgggcagagacctctgcagctttgaaaatagttaccgtgaagtcatcgtaaagaaaataacctttgcaaaaatctaccgtgtagctcataaaaccacgaacaaattagaccttgcgataaaggctatttacgaaagaacgaacactgaattaatccacatttacgaattaatcagattaggccattcatacaaaaagaatcttgcacagatagttttacagacag

SEQ ID NO: 656730 - DNA, 338 bp, Homo sapiens
atctctagagcatccccgatcgaggtctttccgctccatatctgctacagcttaggacggcattcacagcaagtctcagccatctgtcgttaataacatagaaccccactttggagcccagcgtggttgtcgctgtctgaatcaggggttcggtgtcctttatgtcaacaaggacgctatcgctgatcttgtccaggtgttcattagcaacgcgagcagcctgctcatagccatcggctattctgatagggtgaatgcctcggtctagcaattgtctccgtcttcttctaacatggcgaccagccaggacaaccactcctgtggttccatctccaatt

SEQ ID NO: 656731 - DNA, 719 bp, Homo sapiens
ggcagaaaaatgggcagccgcgctccggactcacgtgtgagtgaggaagaaaacctgaaaaatgacccaaagaagaagatgacaatgtgtaactggagcctgtagctgtcggtgctggaagacgatggccacaggacacttctgatacgtgacaggacagctgtggcatcgcgacacaagggaccacttttattcttgatgatgacgcaatagaagctgacagtgagcggtgatgctgatgcccctgtgaccaacatgaaacacttgaacatattgattcgggacgaatcaagtagtatggggcacctacatacttggggcttgggcgcagtgacattgctaacttgtgcttaaacatgttccctttcaaaggcaaatggcaacaaaccttccgcttgaagcaccgaggttaaacgaacctttaacgtaattttcctttggggttccaaatcgtaagatttacgcgcgaaaaggcttatggggacaaaaaaacgggggaaaaacaactaaggaataacaagttttaaatagggcaaatgtatagaaggaaccttacgaaggggattacaatttaaaaacaactaggtcgttggaataaaagaagggcttgggaagttgggtgacaaagtgcattgttggcagatgttaagagagcccagatgttgtaccaaggacaagagagacagaaaggaaatcttcggagaattgcaaccagggtc

SEQ ID NO: 656732 - DNA, 175 bp, Homo sapiens
tctccgctcactgcttagaatgagttggtgggatccttgtggaacgccaaactggagcggaagtcttggatcatgtcccatccagtccagtgaatccacgacccgcagaccttgcccccctgcaacatgttataccatggaatgcaggaccaggtgatactctcgcagcttgtgg

SEQ ID NO: 656733 - DNA, 645 bp, Homo sapiens
agagagaattccccccggcccttccctggaaaaatttttggccccctcccccccggggtgggcccaataaatctaaaagcctttgcgcgccccccccaaaaggaacccaggcccctacgttttttgccctagaaaacccaaaattttgacctcccccttccttttacctaaaaggaaaagaataagcctgcggccccaaattccagcccattttaagacatgatggaaattgtccaaaaattcactttccattctgtgagggctggaaccgcggccggggacttctgcttttggcccatcaacgggcggagcaaaaacttcggctcatgttgaaacttcgtgaaggagacaaagcccatatacctgggaatggtcaacccaggagtttctctgaacgggaataaagtatcataacaaggacagccagggggatggttaccgcatcggctttggccagtgtgctgaaaaagtcctgcctgctctcctgccatcatgagattttctctgctcttctgcaaacaaagggctcaagaacccctttaaaccctgtgactggggtcctccctcgggcagtaggcatggccctccattcaataacaaataaagccattgtgctctaaggccggccctgccaaaaaaacaaaa

SEQ ID NO: 656734 - DNA, 427 bp, Homo sapiens
  misc_feature (249)..(249): n is a, c, g, or t
  misc_feature (300)..(300): n is a, c, g, or t
attgcaccattgcactccagcctaggcaacaagagcgaaactccatcttaggaaaaaaaaaaatgtagaatcatccacaactcctctatctctcctaccttacaaacagtccatcaagaattctagttacctcaacttcaaaacatatctagaatccagctatgcctcaccacccccattgccaccattttggtccaagctaccattatctgttgcctggcttggtagcagagtgctctctctgctttnttcccacaccttgtacaatgttgttactctccatacagcacagagactgantttccaaaacaaaatttaattaaaagtcatttatttgcacaaaacccttcagtggtttccatctcaataagagtaaaaagcacactttacaacagcctaaatggccttacaggatctgacccctgtt

SEQ ID NO: 656735 - DNA, 1557 bp, Homo sapiens
  misc_feature (301)..(301): n is a, c, g, or t
  misc_feature (1484)..(1484): n is a, c, g, or t
gggataagcatgaggactgagaatgacagtccaggatacgctacgtgacggtgcgtatgggacgagcgtcgagggacctttgcggcgcccacgggtgagtcattggcgacggtgcaggcttggcgaggcatgtctcggggcctctgagtgagctcgccccaacggatgtgaacagccgcaaggtggcacacctgagcttcttgggatcttccttgggagaatgcttgagcgagaaggtgcagcgtcttgtatgtacacggagcgatttggaaggtgaaagtaggagatcagaggcacgtgnacgatgacgtgaattgatcgatattagttgagagggagttgaaatgacttgtaggtgaatgcgatcgcgtatggaattgtgtggattcgatgcgttgcgctagtggcctcgaggacgtgttggggtgcgagggctcaatgagagttgtaggtatattgtccattagtgtacacagataagtaaccttccgaaccgatcgcggtgtgccctcgattgtgagaagttgatcccgtggctagttacgcaaggaaagcgcgagccatcttctctgccaccaccgttgtgggggccagctcacttggagaatcgttggaagcgctgatgtcgacaattgggttcgaaccctaacacgccgaatagagcaaaccctggaggctaggcgcgactagttgcccccccggggacttggcggccgacatgctttttcggcggattggggggtccgatgcttgtggaggcggactttcttttcaggaaaggcgttccgaggggttcccagccgttgaggtgtgaatccgcaccttcaccccgtccggtgctgaattgggggcggcgcttccgatgtatcccacctgaaacggcaggtgttgcggaggctaacatgggccaacccgcagtggccccccttatggtgttgggcggtattggacacgccgcgattcctcttttctgtggagtcgcgacgaaccgctgcggggcgcttgaattggccaatgttgctccacagcgttccaccccccgtggttaggcaaagttagagcgacacgccgcccatgttcaaataccgcggattacttggtgagggagttcacacgtgggcggcttctcctggagcgcgctggttgtgtgttcgcctttgcgcccaaaaccattgcggtgtgccgccgtagtgtgtacattacctcctctggcgtcgccagacgaagtttgccaccgggggggtgggtaaggacggaagttcgaaaggacacttttgggattatatgtgccacatgaacatttttacttagggacagaatgggatttacatgtgcttacgtgaggaatttacctagtcttatatttactctatatttcgcacagttattattgtgggacaccacgttgggagagagctactctaggtgagttggacaacccacaggcttagtctgttgagaagagacgacgaagaataggaganaagcaagagacatagatggatcaacagcagggaaggaggaatataaagcaaagtcgatgagcgcgggggtaga

SEQ ID NO: 656736 - DNA, 256 bp, Homo sapiens
tgcagggtaaagtcatagtggagagtagagtcagggcatagaagacgtgggcgtgccaggaatcttcagcttccggtcatctgagagaatctgcagcagctcatagtcctccggctcctcctcctccaggtggtgttggtccagggcctcgcggatcacagccggagccttatctgggctggtcacctgcatcgcggcgggggatggaccatcaggaaaaagacccgggagcggctccccctgaagggagcccaaa

SEQ ID NO: 656737 - DNA, 524 bp, Homo sapiens
gcagagcccattcagaatactattggattgtaatgatggtgtaaaagtatagagttatatgcaaagttaagttgttataagcttgaaataggtggttgtaagtataagatgttccatgtaagcctaatggtaaccacaaagcaaaaatctttagaagcacaaaacaaaaatatcaaagcatactactatagaaaacaaaccacaaaggaatacagcaagagaggaggaaagaaatgaagtatgtacaaaacaatcagaaaacaactaacaaaatggcagtagtaagtccttacctagcaacgattgaatgtcaatggattaatttctccaataaaaagacatagagtggctgaatggataaaataagacctaattatatgctacctacaagagactcacctcacttttagacgtagactgaaagtgaagggatagaaaagaatactccacacaaatggaaaccaaaagagagtggggtggctatacttatatcagacaacatagactttaagttaaaaactctg

SEQ ID NO: 656738 - DNA, 780 bp, Homo sapiens
gccgcccgtccgccgcgtcggtcggggtcagagtgcgcgaggaaatcatcgagttccccatcctaaagctaatggccggacatggagattgagtctaactttcacatgtatgtccagcctgtagtccatccacagttaccccattctgtaccagagctcaccgggattattcacagccatggtggatggtcagccaagcctgcagcaagtgctgaagagggtcgatgaatgatggcgaaggaaaggcctcttagatccaaacgtcaagtcaattttggtcacctgtggagactgggacttaaaagtcatgctcccatgtggcagtgccagtcacttgggcttgccaagtgggcggacttactttcaagcagtgcattactcttgaaaaacgacgattgcaagaaccattgccaaccatcatgaagacactcgcctatcgagggcttcatcttcacagcagaccatcgaagccgtctgattggtcgacgccccaggcgctgggcgccggcacaggggtacgctgtttggcccaggcccagaatcctctttctcctctcaccagaggcggacgacggggcgaagtggcatagctcttgtgtccaagagtgtcccatgttgccctgtgggttcatgccttgggttgggttgtgtcttggcaggggtttgcccactttgcccttctggcgcgaaccttttgtggcccgatacgcagcctatttaagcagtttcgcctccattggcgctgttagtggccccgggcacggcctcctcgggaagggt

SEQ ID NO: 656739 - DNA, 710 bp, Homo sapiens
agaaagttgtgcatcattgctggcagaatgtgcgctgagtcttaacatcggctgacttcatcggtatattatcctggtgaccggtcaatcgactgccagctgctgtgccttctgatgtcatagatgatgtgaccttattctgccaaccaagggcactggtctagatcttgatgtgtccttctttcttcatagttgctgtgtctgcattcatctgtatcgatgcacctgtggcgtgttacgtcaccgctcagctggactggactggagcccgagtagataccattgcagccggcctgttggacatgcttgacatatcagattaatcctcatgacttgtcattgaacagccgtgagacagtggtcactgtgactatcgtccacttgttgcacatgactgagatcctgataatcatgcctatgctcgagggagcacgatttgatgccagcctctatgtacatagtgacgacagtcgtgatgtgtgagatcaccactatgagtgcattgcaggcatacatgatctgatcatgactgcggagaatcgatatccctttctagtagcactggccgttgatgccgatgtggatgatgcagctgcatacagggatgatgctactccgaatgacaacgacataattgcttatgcccttggagacgccattacggtgctgaagcaggttaccctcctagtaatctcggggtgcttcttgtc

SEQ ID NO: 656740 - DNA, 170 bp, Homo sapiens
  misc_feature (14)..(14): n is a, c, g, or t
  misc_feature (80)..(80): n is a, c, g, or t
  misc_feature (99)..(99): n is a, c, g, or t
  misc_feature (145)..(145): n is a, c, g, or t
  misc_feature (168)..(168): n is a, c, g, or t
aaaaaaagaaaganggtcttgctctgtcgccagccaggctggagtgtaatggcgtaatcatagcagctcaccacagtctnaaactcctaggctcaagtnatcctcctgccttagcctgctaagtagctacgactataggcatgtnccattacgcctggctcgtttctncc

SEQ ID NO: 656741 - DNA, 318 bp, Homo sapiens
  misc_feature (30)..(30): n is a, c, g, or t
gggaagtcgggatgatcttgaacttgtcancttctgcttggcttttaaaagttatcccaggcccagatagatgcctggttgtcacgcctgtaatccccagtgctttgggaagccaaggccgcaggattacttgagccccaggagtttgagaccagcctgggcaacgtggcgagacccccatctctacaaagattaaaaaaaaatttagccaggtatggtggcgtgcacctgtggtactagcatcaaaaaaatgcaaaaatttgctgggcgtggtggcatgtgcatgtagtcccaactactcgggaggctgaggtgggg

SEQ ID NO: 656742 - DNA, 934 bp, Homo sapiens
  misc_feature (9)..(9): n is a, c, g, or t
  misc_feature (79)..(79): n is a, c, g, or t
  misc_feature (88)..(88): n is a, c, g, or t
  misc_feature (207)..(207): n is a, c, g, or t
  misc_feature (248)..(250): n is a, c, g, or t
  misc_feature (260)..(260): n is a, c, g, or t
  misc_feature (262)..(262): n is a, c, g, or t
  misc_feature (268)..(268): n is a, c, g, or t
  misc_feature (272)..(272): n is a, c, g, or t
  misc_feature (278)..(278): n is a, c, g, or t
  misc_feature (309)..(309): n is a, c, g, or t
  misc_feature (321)..(321): n is a, c, g, or t
  misc_feature (363)..(363): n is a, c, g, or t
  misc_feature (382)..(382): n is a, c, g, or t
  misc_feature (399)..(399): n is a, c, g, or t
  misc_feature (406)..(406): n is a, c, g, or t
  misc_feature (436)..(436): n is a, c, g, or t
  misc_feature (581)..(581): n is a, c, g, or t
  misc_feature (751)..(751): n is a, c, g, or t
ccagtagtngtgtcaagccagagattcgggcagtagattaatgttcatttaactgatgcactttagtttttggtctgtnacctgtttnccagaaaatttgtggcttttaggcgggagttaggcgaccaaaccagtgagagccccaatccctgcagttttgtggcttcaagtgtgggtggacagtcctaatggggatctccagctccntcctgtggctgccacaaacagctacccccagaagggtcaannntgggagtggntntggctntganctgctntacagagcttcagtgtgagaggatcgagccnttgaaagctcantaccagtaggacataatttttggctctccctattcacaaccngtgcacagtttgacacagnggcctcaggttcacagngcaccangtcactgtgctatcctacgaaatcatttgnttctaagttgtgtttattcctggagtgacatgccaccccgaatggctcactttcactgaggatgctgtcctctgatttagctgctgcctccagcctctggcttgaggacttactaaaggcacattccttcctgttaaacccctgntaactctccataaaatttggtgattctctgctaggcctaagattttgagttaacatctcttgaagcccaaactccaccttctgtgctttttgcttgggataatggagtttttctttagaaacagtgccaagaatgacaagatatttaaaaaaaaaaagaaagaaaaaaanaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgatataatcggtgtaaataagaatcccat

SEQ ID NO: 656743 - DNA, 357 bp, Homo sapiens
atgtgaggtaaatgacgacacactgaatgccgtgcagcacgctgttgtgaaaatggatgcggttaaatctcaaacagacggactctgcaaggcattgcaacctgtggcgtctgggtcaatatgctttacagacctgggaaaactcggagaaattctcgcattttaataacctttaactggctatggaattactattctcccagatttgcctcaaaatttgggcgtaaataatgcgcatataatatcgccttcgttccctattcatttacatttttgaatcaatagtcttgtgaaagggcacgaatatgggggtactcagtgggtgccacataatttgtcgattcatttaatacccat

SEQ ID NO: 656744 - DNA, 160 bp, Homo sapiens
actggcgggggtaggagaaacccggcccccagagactcccgcagggtggacgccgggagcacggagccccatgacccaggccaggccctgtgaaggattcacctgcatgacagcctgtgtgatgcggcaggcttaacacgtaaaacacatccgtgcttga

SEQ ID NO: 656745 - DNA, 337 bp, Homo sapiens
gtgtggtgtgtgggggggtgtgaggtagtgtgcatgtgtgtggtgtgtgggtgtgtggtaagtgtgcatctgtgtggtgtgggtgtgtgggtgtgataagtgtgcatatgtgtgggggtgtgtggtaagtgtgcatgtgtgtggtgtgtgggtgtggtaagtgtgcatgtgtgtggtgtgtgggtgtggtaagtgtgcgtgtgtgtgggtgtggtaagtgtgcatgtgtgtggtgtgtgtagtgtgtggtaagtgtgcatgtgtgtggtgtgtgggtgtggtaagtgtgcgtgtgtggtgtgtatggtatgtgtgtgctcactgaaaatccatggac

SEQ ID NO: 656746 - DNA, 910 bp, Homo sapiens
gagaagaggacgagagaacagcagacggtaccgataggcggattacgtcctcactgcgtcgtctaatactcgggccctgagtaaatatgaaccgtgtaatttatggactagagcacatttgcgggtcatccccatctagggttctaaatgttctcgaggtctcatttgtttgagacacaagagccctcactttcagcgtatttgttgccccccttcgccgcctgtttgctgcctcctttggttcgccgtcgcccgtcttcaaccgggtggggataggctttcttccaagcctaaaggacgggtggccccgcgtcccttccaggacggagcacaacagggagaacacgggcgcacaccagaggtgggtgaaaaagccaggggtcaaccccaatgccgggacaaccacaagcggcggggggccagactcgcatggaccccctcattgcgagcacccccccatgtcatgatgtcgcccacaagaacgggcagatgtagggcacaccaagcggtgggcaaacaatataccgctgtgtgacgccccctcacagccccccggttaacgaggccggaaatgagaaccaaccccggggggggacctttcataggggggtggtcgtatgacaaagcaccaacccccccatagtatcaggaggtgaacaagttgaaaagattctggcgcaagagtatggcgccacagataataatccgggcggtaccaccgtgagcaaaaaaccccggtaaataaatgggggaaccacgccagaagtataaaccagaccgcgtggggcgaatgccacacgaacgtgacgaccccatgcagccacgagcaagaaaaaaacgcaccagcggaaatgtgcccaaattcttgctccaacattttcccccggggtaaaaagaccccacaaaaaca

SEQ ID NO: 656747 - DNA, 421 bp, Homo sapiens
tacaaaaacacaaaaaatcagtagcatttctatatgctaacagtgaacaatctgaaaaagaatcccatttacaatagataaaaataaaatacctaggaattaacctaaccaaattagtgaaagatccctacaatgaaaactataaaacactgatgcaagaaatttaagaggccacacacaaaaataaagatattccatgttcatgaattagaagaatcgatacattaaaatgtccatattatccaaagcaatccctatcataataccaagcgtattctctatagaaacagaacaaaactatcctaaaacttattttaaaaccaaaagacccagaattccataagctatcctaacccaacagcacaacactggaagcaccacatcacctcacttcaaactctactacagagctatagtaacc

SEQ ID NO: 656748 - DNA, 544 bp, Homo sapiens
tccgagacgcactgggggccggatgtagaatcctgcttatctgtgaaatgcagttaacacatcagctggacctatttcccgaatgcaggtaacccttctgttatttaaagatgtaaaaaatgcgggagacttgagaagaaaggccatggaaggcaccatcgatggatcactgataaatcctacagtgtgtcacgtcttgttgcccaggctgtagtgcaatggcgcgatcttggctcacggcaacctctgcctcccgggttcaagcgattgtcctgcctcagacctcctgagttgctgggattgctggattgttgatccgattgtcagatacttgtggtagccatacaaagcaggttcagctctacagactggacaccatgaagacaagaactctatctactgaaattatgtggcaacctttccccataataacaatatttcagaggcttgtgatcaaccattggtatctcagcagatagtgacacttcgatttctaatgtgtttagcttgaagagggagacaacatcggctaaatgcaagcaat

SEQ ID NO: 656749 - DNA, 293 bp, Homo sapiens
  misc_feature (73)..(74): n is a, c, g, or t
  misc_feature (80)..(80): n is a, c, g, or t
  misc_feature (82)..(82): n is a, c, g, or t
  misc_feature (122)..(122): n is a, c, g, or t
  misc_feature (149)..(149): n is a, c, g, or t
  misc_feature (170)..(170): n is a, c, g, or t
ggggctggagcgatggcccggggctggagctcgcggccgccgccgacgcaaacgactgaaactatttgctgcnntttcgngncgggagcagccgcggccgaagccggagcaggggccggagncgcggctggaggggggcctgcgcgggngagtggccgagagctgcccgngccggagacctcaaactccgggcgggagcgctttcggtcggccgagccgccgcggcccgcgacaccgtgtcccccgggcccccacagcggaacggcgggctatctggcgcggagctgggttct

SEQ ID NO: 656750 - DNA, 992 bp, Homo sapiens
cacctgtgggtttctgaaggctagaagcttccacaactgagccaggaaacaagttctgattggctgggaacagacctctggctccaagattcagagctggcagtattccttctgttctggtggctcgatcttcattgctttcctctggacttgtaagttattccaacaaaccccagctgctctgcgagtgaagactgttccacataagttcaagtaatttcgtgccacggagattcacccttgctaacacacgcataatggtgcgtttctaagctagttgtggcttagttgtgccacaatgtgtattggactaccattttgtaggcgcgaaatttcctccgttcagctgggctcattgtataattttagataaaagtacaaggaaattatgattccataatcataagtgctactttcatgcaatacacgtatcttcagagaatcctcagaccgtccctgcagcatcctcctggtgcacagaaaaactgctgaattctggcaaggatactcaataggaattctggacgggtgaccatctcaggccggagatattgcccaacaattggaaaagcagagacagcacatggacagatctgctgacgctaaagtttatagacatgctgaggtgcaaccatataatcagccagatgttattaggccatgatcattctgtagtaagctaactcccgttctgtgtttcctctcaacctgacagctattgtgggcacgttcaaagccccatggtcaagtaaaacaacacaaagtcacagaagcacgctggtaaattctccccttgggggttcccgtacagcacggaatacccacacactctccgcggcacgattacccccacttgggacaggccgaaaactgtcccggaaaaagggcgcagtaagaaaagcccccatattagggccccaagattagacccgggcagaccaaaagggcccagataaaacaggggagcacaccagggggggaacaagagatcg

SEQ ID NO: 656751 - DNA, 926 bp, Homo sapiens
  misc_feature (481)..(481): n is a, c, g, or t
  misc_feature (907)..(907): n is a, c, g, or t
ttcctgcttactgttcactggatgcaaatttgaggtgtgagagtttttgattcccatcctgaataagcaacttttgctttaattcagactgtgtggggactttatgcttttcaaatgcataaaggttaccctgatttaggaggaaatgaagtaacattcctgttactttatggaaacatgcacttaaaaagtaaccccctaaagatccaatcataggtttgattctacaatccccataggaccccccagtgccccgtggtgctcctcagacaggaacatgtttgctgcaacccctcatgcctccacctctgctcacctcctcgggtcttagtcagaacacatcccactcctccaatattttccccatggttctgtgcctgctctgtctcacctgagctgcctctaattcttaccgtttcccctttcctgtggaagccctaccctagtcctcacctgcctgcctgtgtggccgcagagtcgntcccgggtctccacctccatcttcatgccctgctcaaaagggtcctttgagtcctaccatgttacatttcccaaaatctaatctcttgtactgttcatcaccgaggcacttctctgctcaagaaattttgtgatttcctgatgtccaaaaaaaaaaaaaaaaaaaatcaaacctcaactccaggcagtttccagaccctcttccatcagtccaccagccttcccaacctcatcttgcatcactatccaatttaaggcctttcttttaggtttaaacccacatccagggctttggtttatgcacatggtgacttctgccaaaccatcagcaggttgttctgaaaccccctgcatctcccaaggactaggtctgatggccagagggaccagtaagatcaggtctctgcttcaggtggaagagacaggnagtgctacaaaggtaagcg

SEQ ID NO: 656752 - DNA, 125 bp, Homo sapiens
gggatagcgtacgttgaagacaggtgctcagatgtcttcatccaagcaagacagtataacagcacagactgctcccatccttggcccttttcctttctcactaactaaggctttttgcttcatga

SEQ ID NO: 656753 - DNA, 159 bp, Homo sapiens
cactgatgttgaggtcgatctagagtatcccctgcaggtcttctcctccgctgtctatagtattacaccatggtctcttctcaggagctctatggactgccaggctgtttcattcaggaaggccaaaatcaagagtgagatgttgaagagttgtaaaga

SEQ ID NO: 656754 - DNA, 205 bp, Homo sapiens
  misc_feature (144)..(144): n is a, c, g, or t
  misc_feature (160)..(160): n is a, c, g, or t
  misc_feature (194)..(195): n is a, c, g, or t
gatctctcgagctcaggagttggagacagcctgggcaacatggcaaaaccccgctctaataaaaatacaaaaaatcagccaggtgtggtggcacatgcctacagtcccaactactcaggagactaaggcgggaggattgcccgnaacctgggaaggttgnaggccataagtgagcagtgatcacagccacgtgnncaccccagcc

SEQ ID NO: 656755 - DNA, 381 bp, Homo sapiens
gatgaactcagtaacatcggaaaccataaagaagtagttacttgtcgagataccagctgtccactttcaactaagaggaacatcagctgccaggcacatatctattaacatggtttcgggcagctctagttatctaaagcattcataaccagtataaactgtcggaaaaataccacattatagtcagggttcatgatgctgtacataggaaggcaacgatattagctttcgggtaaaactgcagtacacttaccttggcaaccttgtgcctatgatcttccaacatagtttcttttgaaacaaaaactgtctgatgaggttgcttacatcactagtatccagatcaatcaggtcgatgtgggacaaaccgtcgaattcgca

SEQ ID NO: 656756 - DNA, 293 bp, Homo sapiens
caaaaaaatttttttaaggggcccaaaaaggccctttaaaaaaggtttattttttgaaaaccatggttaaaagggaaaccggtgggtttttttaggaaccaaggccaaaacagcgccttttttcccccaccccccttaaatttccaaatggggggaaaaaaaaaaaaggggtttttaaaccctggtttaaacaaaaaggttaaaccccgggggtttaggagggtttaaacaaggggttcccaaattttttttaaccaaggggggaaaaaggaaaaaaatttttttttccccca

SEQ ID NO: 656757 - DNA, 163 bp, Homo sapiens
ataggccgtatagagatgtctaagtacatagctatttaggcaaatatagacaaaatacttaacttaaccagtgtgagtaaagaacggaatctagcctatcatgcaggaggtctaggagtagcaggtagcaaggggatgcatggcaagtggcacacaagtacta

SEQ ID NO: 656758 - DNA, 195 bp, Homo sapiens
tcggccggtaccaacatctcatcgcgcttccaacatctcatgactccttccaacatctcatccctccttccacatcattccggcatgagatgtccaacatctcatggcgggcaggatagttcagacggtttctatttcctgagcgtctgagatgttaatattagttagttttgttagagatgagatgttggaagg

SEQ ID NO: 656759 - DNA, 414 bp, Homo sapiens
gttttaaaaaaaatagtgaatttggggtaaagttgcttttttatggaaaagcctctaaccttcccttttccttccctctggagatttttctatctttataaaatattggggtttttttttaaggaaaaatagaaaagtagcttgtgaatagctccaactaagctttccaattgcctgtaaaaaagcaaaaaagttatttgggtctgtttatattgcttccctttttgtagcctttggacctggccagggggccagtaagggcccagcaggagaggggtaatccttgtattaaatagggtcccgcgccccttttggatttttttgttttttttttagtccgtcccttcaaaaaaacaaaaaaccaacaaaaaaaagctggccctttttacataaaattaattatgatgagcccta

SEQ ID NO: 656760 - DNA, 1063 bp, Homo sapiens
  misc_feature (12)..(12): n is a, c, g, or t
  misc_feature (70)..(71): n is a, c, g, or t
  misc_feature (82)..(82): n is a, c, g, or t
  misc_feature (86)..(86): n is a, c, g, or t
  misc_feature (100)..(100): n is a, c, g, or t
  misc_feature (109)..(109): n is a, c, g, or t
  misc_feature (125)..(125): n is a, c, g, or t
  misc_feature (133)..(133): n is a, c, g, or t
  misc_feature (138)..(139): n is a, c, g, or t
  misc_feature (147)..(147): n is a, c, g, or t
  misc_feature (154)..(154): n is a, c, g, or t
  misc_feature (158)..(158): n is a, c, g, or t
  misc_feature (162)..(164): n is a, c, g, or t
  misc_feature (173)..(174): n is a, c, g, or t
  misc_feature (181)..(181): n is a, c, g, or t
  misc_feature (197)..(197): n is a, c, g, or t
  misc_feature (201)..(201): n is a, c, g, or t
  misc_feature (204)..(204): n is a, c, g, or t
  misc_feature (245)..(245): n is a, c, g, or t
  misc_feature (247)..(248): n is a, c, g, or t
  misc_feature (251)..(251): n is a, c, g, or t
  misc_feature (268)..(268): n is a, c, g, or t
  misc_feature (272)..(272): n is a, c, g, or t
  misc_feature (276)..(276): n is a, c, g, or t
  misc_feature (279)..(279): n is a, c, g, or t
  misc_feature (297)..(297): n is a, c, g, or t
  misc_feature (301)..(301): n is a, c, g, or t
  misc_feature (313)..(313): n is a, c, g, or t
  misc_feature (331)..(331): n is a, c, g, or t
  misc_feature (383)..(383): n is a, c, g, or t
  misc_feature (435)..(435): n is a, c, g, or t
  misc_feature (480)..(480): n is a, c, g, or t
  misc_feature (955)..(955): n is a, c, g, or t
  misc_feature (1003)..(1003): n is a, c, g, or t
  misc_feature (1029)..(1029): n is a, c, g, or t
tgctgctccggnggctggaggcgatctgatggcagagccataggacagcgccgagttggcggatgaactnngcatggagcancaancggtggtgggcgcngtgaaaagncttcaggcgctgggcnaggtcatngaggnngaacttcngtccaanaaanactnnnagcttaatnnggagggngaagagattgcccggnaggnagnccataaggcacgtatatttcgaagcattcccccagagggcntnnaanaaaaaaaagactatatncgantgcncantggcaaagtgggcttcancaangccatgtccaanaagataggaaagaatacngataacgggccccgggtgttccgagtaggtggacagcatggaggataaagtncagcggcggctccagctggtccggagggggacaggctgaaaaactggggganaaggagaggagcgagctgaggaagaggaagctgttggctgaagtnactctgaagacctactgggtgaacaaaggcagtgcctttagtaccagcatctccaagcaagagacagagctgagcccagagatgatctccagtggctcttggcgggaccggcccttcaagccctacaacttcttggcccacggtgtcctccccgacagcggccaccttcacccgctgctcaaggtccgctcccagttccgacagatcttcctggagatggggttcaccgagatgccgactgataacttcattgagagctccttctggaactttgacgccctcttccagccccagcagcacccagcccgtgaccagcacgacaccttcttccttcgagatccagcggaggccctgcagctcccaatggactatgtcagcggggtcaagcggacccactctcagggcggctacggctcacaggggtacaagtataactggaagctggacgaggcccggaaaacctactgcgaaccanaccacatcagccagcgcccgtgcgctctaccgccttgcccagaagaanccttcactccggtcaagtacttctcnatcgaccgcgtattccggaatgagacctggacgc

SEQ ID NO: 656761 - DNA, 129 bp, Homo sapiens
tactggtaatacgtattttaatttttggtgcatatgagtttaagtgtcgtgtaggtgacatgaaaatcttaggcaaaccgacttgaccattgtcagacccactggattttcaagctgatgtggtctgct

SEQ ID NO: 656762 - DNA, 707 bp, Homo sapiens
  misc_feature (589)..(589): n is a, c, g, or t
  misc_feature (638)..(638): n is a, c, g, or t
  misc_feature (689)..(689): n is a, c, g, or t
  misc_feature (702)..(702): n is a, c, g, or t
  misc_feature (707)..(707): n is a, c, g, or t
tttcatatgcttgatttctcctgaaatgggcaacaattacaagagtttttttcctcttctgaactaagaaaataaatatttaattcacaagtttagaaaagtgaacctgaaaaatcacagggctaggtgggttatgaggcccactggtacatgatagtgttgaatgtggattagaatgaactccgtggattagaatctcagaccataggcaaacatttacttgttttagaataagcacatttgagtctgcaataagtattactgtttttaagttgaaaatgtaattggtttctaataataaccatattggctagcattatttcaatcgtgtttaatgttttccaatgtcatttcatgtcagatatctctcttgattcttagtaacaatttggacaagacagcaaatgctgatgtccaagttttctaaagaagaatctgaagtgaaatgacatcaagagacctatcaagacctgtatccaggaaaaggtaaatctgagctgaaatttgagccctttgaaattacctacgtgacataccagatagtgttcatgatccattcagtactctgttctatgagacaatatccatntattcacttgatcatttatttagtgttagatcagcccttactgcatatnccaggcactactctgactgtggcaggagtgaaccaggcatggatcttactngcatgtttacagnctttn

SEQ ID NO: 656763 - DNA, 193 bp, Homo sapiens
  misc_feature (98)..(98): n is a, c, g, or t
  misc_feature (163)..(163): n is a, c, g, or t
agtagcgctcactgtcttccatccactgctcgatgtcaccccattttgtatccagcccataatatttcttttggacctgatagatctcctttctgtgncgctccagctccttcatgcggatctcgcgagcctccgcgcgggccgcccgttttgcagcggagcncggttccgccagcttctgcgcttccgggct

SEQ ID NO: 656764 - DNA, 991 bp, Homo sapiens
  misc_feature (338)..(338): n is a, c, g, or t
  misc_feature (342)..(343): n is a, c, g, or t
  misc_feature (399)..(399): n is a, c, g, or t
  misc_feature (461)..(461): n is a, c, g, or t
  misc_feature (467)..(467): n is a, c, g, or t
  misc_feature (513)..(513): n is a, c, g, or t
  misc_feature (529)..(529): n is a, c, g, or t
  misc_feature (539)..(540): n is a, c, g, or t
  misc_feature (589)..(589): n is a, c, g, or t
gttcgtcccggggcgatgtgctctcacagacacccatggtcatacgtcccatagaatgcgctcgggattttctgtcaagaagatgtgtgacaaagactattcagtacccataagagttgatcgcaatgtacatatgaagggagcatcggcatatctactggtcaacgcactcagtaggaaaaggtcgtacgatgtaatcgagcattgacagacatgaagtgagcccttagtgcgtagtgggctataacatgacaggcacgcactatgtattcctggaaaaaacaagtgtcatgaaagaactcaacaaatatgcaaaggagtctggtgtgcatataggncatnnatgaggtttggcagttcgtatgcacgcgacatcgtagaccagttagtactcatagnagtacttggcctgggcatatatactgaaggagtagctggacaatctatggaagctagggcgnaagtgnagctagtgtaagagaaaggcacttacaccatgggccgcatgctagnagtgccaaatgtgctnacagatgatnncaattctatttaatttgatagctaatggagctgatgataactcgtgtgnagatatctgtgttgctcaaattaaaattatttctggttaatatttaaagaagacgatgttttcttagtgtactgagcagtttctttgtaaatacagagaataaagtgactactacggacagagagtagtgttacggaggacctggttagagaaatttgggtgacttagtggggtaataatgggtcatgttgaagagtcaaatttgtgtggattttactaaaggtagcgtcagaacaaaggtcggttttcaaaaggattgactattgggcgtggttgaacccagaaggaggccccaatggggaaagcatttgtgggaaaacttattgaagaggaaaaaaagtggggtaacaaggattaacgcagagtggcaagagaccgatagattcaaaaaagtaaaatgtc

SEQ ID NO: 656765 - DNA, 618 bp, Homo sapiens
  misc_feature (38)..(38): n is a, c, g, or t
  misc_feature (62)..(62): n is a, c, g, or t
  misc_feature (70)..(72): n is a, c, g, or t
  misc_feature (77)..(77): n is a, c, g, or t
  misc_feature (100)..(100): n is a, c, g, or t
  misc_feature (109)..(109): n is a, c, g, or t
  misc_feature (112)..(112): n is a, c, g, or t
  misc_feature (128)..(128): n is a, c, g, or t
  misc_feature (134)..(134): n is a, c, g, or t
  misc_feature (137)..(137): n is a, c, g, or t
  misc_feature (146)..(146): n is a, c, g, or t
  misc_feature (162)..(163): n is a, c, g, or t
  misc_feature (209)..(209): n is a, c, g, or t
  misc_feature (269)..(269): n is a, c, g, or t
  misc_feature (379)..(379): n is a, c, g, or t
  misc_feature (396)..(396): n is a, c, g, or t
  misc_feature (434)..(434): n is a, c, g, or t
  misc_feature (459)..(459): n is a, c, g, or t
  misc_feature (485)..(485): n is a, c, g, or t
  misc_feature (518)..(518): n is a, c, g, or t
  misc_feature (521)..(521): n is a, c, g, or t
  misc_feature (553)..(553): n is a, c, g, or t
  misc_feature (569)..(569): n is a, c, g, or t
gtttgcagactccaggcagagcactcctggcagctgtncagcaggagcaggaaggaaacganatgagagnnnctttntcccgagtgtcccagttcaacancgtgcacgntancaaggagaaaaggggnaagggntcnacccacgantgcagagcaggttggnnagggggatctagagctgaaaggcaatacatggataacgcgcacgcnccactcccacttttatttagcaagagtaaatgcagcctaatgatagggcgtgggaagatntcctgctcactagtgtgggcagagtgtagcgtggcttgggctcctaatacaggtaaattgtttccaaaggactagtaaaggtgactgggtcatcctcctgccccaggganactgattagagaaaatncgtctgtgctggcaataaggcagtgctggaaactcggnattcccttgaaggcaaaagcaaggnacagagcgtgattaggtactggacanctgctaagtgctgggctctctccagtttacagntgnggcaactgcggctcctcgagttggagctgggntgccagcccccatggncctggcagaacacgctcttgacagccccacagggcttctccctagggcg

SEQ ID NO: 656766 - DNA, 281 bp, Homo sapiens
ttgtcgagctcaaaccaatcgagaccaccgacttttctactgggcctctgcaagtgctcgaggggtggccttttgacatcaggagggccaaaaactccaccctcagatcataacacaaccattttcttttctttttttttcttttttttttttggaaaccagtgtctctctctctcacccagcgtggatgtgagtaggcaatctcgggtcactggaagctccgcctcccggtttcacaccattctcctgcctcagttccctgagtaactgggaatacaggc

SEQ ID NO: 656767 - DNA, 312 bp, Homo sapiens
ccatctattgggtatgagggtatgctagattttgcgtaggcttgggttggttattgcgagctgcaatcgccagttagtagatggataagattgagtagagtgaggaggaaggttatgcgttgatgtagagggagagattaggtatatgattgagatgcggggataagttgtcgttgtgtgatgaagacgcaggccgtatgtcagaggggtgcctggtgctacctctgtcgactctagaagtgaaagggggctattcctattatttagttgctatagctcttatgattattaatgatgagtattgatcggtag

SEQ ID NO: 656768 - DNA, 437 bp, Homo sapiens
  misc_feature (392)..(392): n is a, c, g, or t
  misc_feature (430)..(430): n is a, c, g, or t
acagacccccggcggcatggtgtctgtacattgtgtttggttgatttgcgtcataaatatcttttagtctactacagatgccctttctctacttttttgatgcaacttcatttttaagaaatcagatatgccaggcgtggtggctcatgcctgtaatcctagcactttgggaggccaaggcagaaggattgcttgagcccaggagtttaagaccagcctgggcaacatggtgaggtgagaccccatctctacaaaaactttttttcttttgctgcaatattttaatgtaaatccaatacatgttatcatttccctgtatatatattaggtgtcttcctaacaggtaagaggctttaaaaaacataatacattatcattaacctatgtaacanagttaatgataattccttaatatcatctaatacccagntcacgtg

SEQ ID NO: 656769 - DNA, 108 bp, Homo sapiens
gtgggcaggccagagcaggaagggttattgagggtcatctaagtgcaaaccgtttactttagagatgttgaaaccaaggcgcagagaggggaagtgacttgcccaaga

SEQ ID NO: 656770 - DNA, 368 bp, Homo sapiens
  misc_feature (45)..(45): n is a, c, g, or t
  misc_feature (73)..(73): n is a, c, g, or t
tggttatttaataatggttattaatactttgaaaaataagtggtnttaactgagtaatagttgcagtttttanaaatactacatacattgccgagtgcagtggctcacacctgtaattccaacactttgagaggctgaggcaggttaattacctgaggtcaggagttcgacacaggcctgcattggtgtaaccccatctctactaaaaataaaaaattagctgggtgtggtggcacgcgcctgtaatccagctaccttggcaggctgaggcaggagaatcgcttgttcctgggaggcagaagttgcagtgagctgagattgcaccatttcactccagcctgggtgacagaatgagattgtgtctcaaa

SEQ ID NO: 656771 - DNA, 240 bp, Homo sapiens
  misc_feature (92)..(92): n is a, c, g, or t
  misc_feature (193)..(193): n is a, c, g, or t
  misc_feature (238)..(238): n is a, c, g, or t
accacgccaccggagaagggctggcggcgagcacgcaccccgtgcatctgatcggggcctcgatcggggcatggcgcatggccaccggggcngatgcatgacgcggcgcggcagttccgccgcttggcgcacgactacatccacgagcgctacgagcccgagcccggacgacgcacgccgagcgccgcgcagngtcagccgccgattctcgcggctctgaccctctccgtgctggcanta

SEQ ID NO: 656772 - DNA, 348 bp, Homo sapiens
agaccctcagcctctgacctgcctcagtataaccctaacaaaagacagattatctttgtccccaagccaagtaagccccgggctcttctggtcccaccgtcccctcccctgccccatgccaacctgtcacctgtagagagacttttataggaagagttgggatttctgggactggacgatttctgataactgttggttacaacagtttccgatggcagcaagctcgctaggtcccctccctcatgtggaactctcccctttgggagagctagcacccgtgcaagggttctccccgcccccccccgcccaggctgctgattaggcacaggggacttccaaggagggaca

SEQ ID NO: 656773 - DNA, 187 bp, Homo sapiens
gtctgtcgctgggacaggtacatcgtctggaaatggagggagggaatggtggtgagatggctggacgcaagggtatcaggtaggcccaggctcctggtatcagtgattcaccgagctatactgacggatcccctgtcccctggacacccagcatgtggcaggggacactgtcgtttgatggcatcat

SEQ ID NO: 656774 - DNA, 159 bp, Homo sapiens
  misc_feature (8)..(8): n is a, c, g, or t
  misc_feature (98)..(98): n is a, c, g, or t
  misc_feature (146)..(146): n is a, c, g, or t
tataatgncatggtgaaatggatatgggcgatatgaaccataaatctcataccgacatgaatatgagccagatgcatcatcattcggataagcaacantcatctatgtccgtaacaaaccaacataaaccacaagctgttcaaggntgggcaaatgcat

SEQ ID NO: 656775 - DNA, 1404 bp, Homo sapiens
gttttttatattctaatgttttttgctctctgagtgttgttccctctctgttcgtctgtttttttttgtgggcgacactcttccttctcttctcgtttttatattgttttatcttggggtttttttccttcccgccgctgttatgtttgttagtctctcttctgttgtggctccgcccctacggcgttgttttgtgctctgtgttgaagagtagtagagaggtagatatatatatattatctcgtggtgtgttgggtcaacacaccctagtggtgtgtccctcttatagtaggtgagacgagagaatattgttgttggtgtgttgttgtttgtgtcggcactactacgcggcgcttgtgggtgtgtgttttgtgtttgtgtctcgcccccttttgtcgcgccttcatcatgtgttgccccccttctttgtgttgtcgtcgtctgctctgctctgttgtccccccactatggatgggtgtttgctccccttttgttttgtgggttttttgagaatagtataaattttatagagccccccactttgttaattcttcccacacattgatgaggagacgacacaacacactcttgtgctctgcgtgtggtgcgcctctctctcgcacactacaaatttttgttctgtggtgtgcgcgcaacactcttgttgataaaaaagaaggggccgcgctgtgtgtgtcgccctctgctgcggggattctctctctgagtttgtgtttgtctgtgtctctcccctctcgagagagatctctctctctctctcgccgccctcttctttctgtgaggggtggctcactcttgtttttctctcttctctctgtgtgatatgtttgtgtctcccgcggctgggtgtgcacacacttgtgtgagagagagataatatactctctcttctccacactgtgtgtttactctctcttttgttgtgaagagccacactcacactatatcgcgacaccctcctctcttttttgtgagattcttgggtgttttctcgcagaggccccaagagaggttttcactctcttctccctagagagtgtcccacagatgtgcgccagcagtgtggagctctctcacagagtgtctaacacacacacacaggcgggagaaattggtgtatctctcgcgcacccacagagagagagagccccacacacccttggtgtgtggagagagatattatttttctctgcggagagaggggcctcttcccccacatgtgtgggcacaaacctctctccaacacaccggcccaatatttttccaatggtaaattatttttccccttcccctggtcccctgtctcccttcccctttaagggaattgggggccctttatatgggaaaatgtataccacttgtgtatataaacaaataattaaa

SEQ ID NO: 656776 - DNA, 383 bp, Homo sapiens
agttacaacagctctcaaaaaaaaaaaaaaatatttttggggggtttttttttaaattagttaacatgcgttctttgctaaaaacctggcgggggcccttttcagccaaggaaaaggcataggtttttacaaggccaaagagaccctaccaacccgggccctttttctttgggccctctttttttatttccctgggccagaaatccattttggacatgcggccctctttgtggttggaatagccaaggggtattttggcagaagggtttttctccccgcagccgtggttgcttacccaagagtagccggccacagggaaatcccttcatttttttaaggtctggcctccagggccatctactcgggggagcctaccatgccag

SEQ ID NO: 656777 - DNA, 273 bp, Homo sapiens
  misc_feature (39)..(40): n is a, c, g, or t
  misc_feature (194)..(194): n is a, c, g, or t
  misc_feature (207)..(207): n is a, c, g, or t
  misc_feature (251)..(251): n is a, c, g, or t
  misc_feature (263)..(263): n is a, c, g, or t
gaggctgaggttgcagtgaaccgagaattgtgccactgnntttcagcctgggtgactgagcgggactccgtctcaaaaaacaaaaaaacaaaaaaaagagagtcagggtctccctcctgtcacccaggctggagtgcagtggtgcaatcatagttcactgcagcccttaaacctcttgggctcaagtgaacctnccacctcaccctnccaaagtagcagggaccacaaggcacttgcaaccaataccccangctaaggggtcntcaattttgg

SEQ ID NO: 656778 - DNA, 626 bp, Homo sapiens
ccctgataatagtaggtcatagatatcgagcatctaaaagatgtcaatagaagatatactagaaagagaagcaatcgagataaattctgaatctacacttccgatgattcaaaataaaggggtaataggttaccggtggtggtggaactatcggtagtgaactatgtagacaaattgcgagaaataatccaaagatgcttatcatattcgatatatatcaaacatcagtcacttatgcagcattgagcaggaattaagcaagcagggggtcctgacattaaattttgtagcattgcattggttctgttcagagcaagctatcaagattggctgcatcatcatttgcatcaatatagcacccagcaaatcagtcatcatccatgctgcagcacataagccatgtcctttcactggcacacccagtcctacatgcggctcattaaaaacaatcatttatgggcacttcataatcactgcatttgcagccattgagcatcataacagccagccacaggttcatattgcatctctcacagatcaagctgtaaacccaacatctatcaggggaactcctaaaagagcttgtgacatgcatcatccatcatgaccacaatttatcggggtac

SEQ ID NO: 656779 - DNA, 318 bp, Homo sapiens
caggcaccactcttagtctgtcagctatgtctctctgtatatcctgctcctgtctctcttgtctcctatctctctctgtctcccatctctttctctgtctcctgtctcccactttctgtctcctgcctctttcctctctctccctccttccaaacaccctccctgcactcattctctccactgctttcataacacctgcaccctctccctattcaattacataagatctcttgcaccatcctgtgctctcaaacatggcctacttcatggttttcgtcctcactcgcctttctccagccccaaagacgagcactcgct

SEQ ID NO: 656780 - DNA, 422 bp, Homo sapiens
gaggatcttgagcttgatagatcagctgtgcaataagcaagcgtatctagcagatgggtcacttgcacgtccgtaagttatggttccaaagtggtctttacagggggcatctgtagtaaggtcgttgcgacatatagtatgaaggcatccgtgccaatagaccatctcacaatggtgacctcttataattagcacttcgggacagatcgttcaataaattcccatgccaggcttatgcctctgtaaacatttccttagatcagcaagtgtgcactaatgccgagtcttacgctgcgatgcctccctatccccgcagcgcaatctctctctcgtgcgcctccaggcctgagctcaaatcggtgtgatgtgatcctctgcataggacacgagagatagagtctaagccacaccctgggacacag

SEQ ID NO: 656781 - DNA, 125 bp, Homo sapiens
  misc_feature (19)..(19): n is a, c, g, or t
  misc_feature (33)..(33): n is a, c, g, or t
tgcggtcgacttagagatnccctgagtttcttnaatcgaagtcaggtggctgtgcgcgcgtttatcagctaccattttcgcaaatgaacattaatgttcgaattccaatacgaaaagatcgcgag

SEQ ID NO: 656782 - DNA, 416 bp, Homo sapiens
  misc_feature (30)..(30): n is a, c, g, or t
ttaaagcccctgcagcgggggttaaacaanctgagtcacccagcttccttgaaaaaaaagtgaagaagaaatttgattggccttttgaccagccagtggaaactgcaattacaggcctgtctactgttctatcaattgatttcaacccttcagaaatagaagttggagtagtgccagttgaaaatcctaaattcaggatttttccaaaagcagagattgatgctccccttgttgctctagcaaaaaaagactaaacattgtggttagtttcccagatccgtgatgccccttacctgtgtgtttggtaacaccaaaccaacatcatgggggtccctggattgaaaaaggagcctttccccctcctcctccccccgaagtggttaggactctatataaataaaaacaaggcttttgga

SEQ ID NO: 656783 - DNA, 266 bp, Homo sapiens
ggataaaatactaattcaaaaatagagttaatctcagaccagatgggcatatcaatatttctattatactattacaaagaaccagcattcaccaggataaaccatatggcaggcaacaaaaaaggctaccctacatttcacaggattaaagcacagagcatattattaacatacaacagaataaaattagaaataaataaaaaaaggaaatttagaatacatacgtatggagaattcagcaatactttactaaataagcaattgga

SEQ ID NO: 656784 - DNA, 200 bp, Homo sapiens
tttggggagactactatgaatgcggaaatagtgcgcgtcaacaacgcggctttctcatggcacccggagcagagcggatgggatacggcacaagttgtatcgcaccgaaatgaaccctggtttacttcagacgactgttttgtggcgctggctcccggcgacggcagtacaacttttggcgatgccggtgccgtgtcggg

SEQ ID NO: 656785 - DNA, 186 bp, Homo sapiens
cggacgtccagctgagatctcctaggcgaaaaaaaaaaaactccaaatcgtagtcagaaattacgacagcgtgaagtaactgatcagtgtgtgaaaccagagtacaaccgtcaccgttgaatgttactcagatttccagactcgtgacctgaccggaggtcccttgtctgtaaacaaggttgaggg

SEQ ID NO: 656786 - DNA, 197 bp, Homo sapiens
aagctcggaccgctctcgtgagactggtctcttcttaaaggaagagcccatatttcacaggggtttccctgatcatttaaccccacagttaatctgaattaatgcattataagaatttctgtagaatagtgtgtactcatttacactttctttggtatttttctaaaaatgacttgaaacagtattaattataaatg

SEQ ID NO: 656787 - DNA, 699 bp, Homo sapiens
gttttaccccggttttttataagcccctagccttctccctaatttaaaaactgtttatttttatttaacttttttggtttagttataccaaaggttgttattttaactttgcccacaatttcccaactgaagggtgtttaagggtatctgtccactctggtataagccagttttcccacgctaacaaaaaacgtccttgagcctggaaaaaaaaaaaggtttacctggccttaactatttccccatggttggggcggcttcagcagcaagagaatataaggaacaagcaaaggcagtatcccttgagaaagccatcagatcccatgagacttatttactatcatgagaatagcacgggaaagactggcccccatgattcaattacctccctctgggtccctcccacagcacgtgggaattctgggagatgcaatttaagttgagatttgggtgggggcacagccaaaccgtatcagcttcctagatttcttaaatatgctgtgtatttgggtagcttagagcagtgctcagcatatgtttaacttccacttgctaccttagtttataataactgtaattttataattttgtttggaatggccggaactgttattcatatatatgttggtgtgtacacatttgtgtatatatgtccatgtgtccaacatggattttttcgcgaataagaattgggtaagt

SEQ ID NO: 656788 - DNA, 306 bp, Homo sapiens
  misc_feature (141)..(141): n is a, c, g, or t
tgccctcaacacgtcttttcttcttgaaaattaaaaacaacccctttcaccccctctactgtccttattccagtttgtgtccgtagttgctggaggaaagaaaatgcctattgctcttttttttattctctttatctgttnactcttctgcctttcttttctctccctgacttcattccatttaaaggccttaaattgcaaataacgaaaaaagtattttctaataatataccctagtgggacgaaaacaaccttctacattttaaatgatattaagttataataaatggttccatgaactttaaa

SEQ ID NO: 656789 - DNA, 320 bp, Homo sapiens
catttgatgccccatgtgtatgccctgaccatgccccacccctccatactacaaggtttgcacgtaccacaccccagcagccatgtcagggcctccagttacattcatcattgagggctccttactcctcctccttcccagcctccccggcagcccggcatacggccgctcccagtagccatccacaccgcgacctgacctttaacccctcctcagccttagagggtcaggccggagccgcatgtcgtgtccgagatgccggcagccttcgctggatctctcttcccgaaactcacaggtcctgacgaggctcctgtctg

SEQ ID NO: 656790 - DNA, 493 bp, Homo sapiens
agcctgatccggatatctcaaccaccagagcctcgcggctccatgattatgaatttggctttcacttgcgacagcgcatcagcgatgctgggggcccgggcgtgactgtgacacacctctcaccctgcgggccagggtcctgtcgccaccacttccagagccagaaagggtgccagttgggctcgcactgcccacatgggacctggccccaggctgtcaccctccaccgagccacgcagtgcctggagttgactgactgagcaggctgtggggtggagcactggactccggggccccactggctggaggaagtggggtctggcctgttgatgttttacatggcgccctgcctcctgggaggaccagattgctcttgccccacttgccagagcagggtcctgggcctgggcacctgacttggcttgggaggaccaggccctgggcagggcagggcagcctgtcacccgtgtgaagaccaagggaacacccgggt

SEQ ID NO: 656791 - DNA, 649 bp, Homo sapiens
agagcagactgctacgctcaggcggagaacgccaggaacgcgattgcctagggctcgtcgcagcaagtcttgaattcccgaggcgcgcatgccctacagaaacaaggtctggtacgctgtacaggatgtagacaattgcggtgcagtacattgcgattgtcgacatagaactgtgcactcaggagcagcagcaagccaacaggcaaaatccataggaccagtgaagtcgacaacgcgatttgacccagtagctaggctcgtttgtggtgcatacagtaaagccattccagaaatagaaagccgaccatcttaagctagtggctaagtaatgtcgccggtaggatccaaccgggccgcggcttacgccgggtgcaagtacaacagagaagctgtgctacagtcagcctcctttttcaaaacgccgcgtgatatgaccgactccagtccgagcgcaagcccttcgagcttgacaatatacttccgcctgctcagttacgttaagccctatatgggcttgttcgcgttgagtatccttggatttctgattttcgcgtcgacccaaccgatgctgggttacatcctcaagtactttgtgacggtctctccaatccgaagctgtgctatcccgaccgtgcctttttggcgactg

SEQ ID NO: 656792 - DNA, 243 bp, Homo sapiens
ggctctctacatgctctgtaagaaaatatcttctggcctggagcgttggctcaatgcctgtaatcacagcactttgggaggctgagagcaggtggatcacctaagcccaggagttcaagaccagcctggtcagcatagtgagacccagtttctacaaaaattagctggtcatggtggtacgtgcctgtagtcccagctacttaggaggctgaggtaggagaattgcctgagcttggggaggtt

SEQ ID NO: 656793 - DNA, 154 bp, Homo sapiens
agaagccatgagcagcaaagatctctcgcgacacccctgtacggaggcggtgcgggaagtacctacacggggacaccaaccgcaaacgctcgcaagattactcgagacagattgagattgcagaatcaagctttagagaacctatgattcccca

SEQ ID NO: 656794 - DNA, 403 bp, Homo sapiens
ctcagttctactagaattaggactagagtgacgtgccctctagggatatgactagcttacctacctctctgatacaacaagagctctattaccaaccctcatacacacaacagttcccttgctagatgtagactctactgctacagctggactcatctagctctggactcccactagatcacacaggggtccctgcgtgtcagtaaactctggatgaccttgggagaccaaatgatgcgactatcatgatatgatctaaacgtagtttcctgagccaacactgaccagtaaggtgcgctgcaccataagtctctatgtgccatcatgggttacacatgatatcataggactcatatcagtctgattcttatgagacgtgcatactgtgtttacctgtggggcc

SEQ ID NO: 656795 - DNA, 413 bp, Homo sapiens
gcaccagctctctctctgtctctctcgctctgtacatctctatctatgtgtcgggatcgacgagtgcttactaccctgccacgccaatgatactatgagccccatttaagtgtttgcgaaatagattgattcctcacgctcatgatttttatcctactggtacatgaggacaaattcagccaatcttcatatacttaggtcttgcctgtatgcctacgcctttatgtgtcttctatcaagaactatgtcatgtgtgacactgattatacctatgatcactgacgagctacctgtgatcgatatcaaggctcactcctttctgttgactatggataggctgatgactatatgcttgcggcaccgaccggccctgtagattttagcaggtctctgagagactcttgctgggctct

SEQ ID NO: 656796 - DNA, 171 bp, Homo sapiens
gcgtggatgttccgggcttgctctacagaaatacggatgcatcttgggttgcaatagggtatatcccataaacccatggtaaggtgaaaatattcccaaggccgaacattttatttaacctttaaatttaaaatatgtttaagtctaaagacaatgtaaagagtacataca

SEQ ID NO: 656797 - DNA, 273 bp, Homo sapiens
tatctgtagggtcgctattgtaaacaataactttgtaaggcatcaagtacaaagttggtgggaaagctctctgcaggtggcccagggaggaaggctccctgctcacatcattacagtgactcatccccagaactcatacttgatcactatgccacaagactcgatcccttctcctgccagtgtggactctagacatcaatgatcacgagcttcctgacaggtgtgaaatgaacatcagtccatactgcacaggctagtctctcgcgggacttc

SEQ ID NO: 656798 - DNA, 316 bp, Homo sapiens
acatgcaaatattatcttaatttaaaaaaacatgcaggtcagcacagtggctcatgtttgtaatcccagcactttgggaggccaaggcaggcggatcacttaaggtcaggagttcgagaccagcctggccaacatggtgaaacctgtctctacaaaggtacacaaattagccgggtgtgggggcaggcacatgtgatcccagctatttgggaggctgaggcaggagaattgcttgaacctgggaggtggaggttgcagtgagccaggatcgtgcctttgcactccagcctgggcaactaaagcaaactccatctta

SEQ ID NO: 656799 - DNA, 1910 bp, Homo sapiens
  misc_feature (115)..(115): n is a, c, g, or t
  misc_feature (296)..(296): n is a, c, g, or t
  misc_feature (448)..(448): n is a, c, g, or t
  misc_feature (544)..(544): n is a, c, g, or t
  misc_feature (1052)..(1052): n is a, c, g, or t
  misc_feature (1059)..(1059): n is a, c, g, or t
  misc_feature (1168)..(1168): n is a, c, g, or t
  misc_feature (1498)..(1498): n is a, c, g, or t
  misc_feature (1541)..(1541): n is a, c, g, or t
  misc_feature (1858)..(1858): n is a, c, g, or t
gggacagttaggtcagtttctgtctcggcctggagttcttgcagtgcctggacttacttctatcactattatcccactctaagaggctagtgcatggcctgtcaagatgatcaanacttggagacgcgagtttacagggcactgccgacattgccgcggacgaacagtctattgagccctctgccgatagaatcgcgcattattgcaatgtgtcaatccgtttgtggcgatatctgccacaaactcattgatggtgcaagtggcattgcactagggtggacaccatcattgtaggngctttaaccatgtgataagcaaagcattgggactattacagatggtcttggtatatatgagatggataaatactaaaaacaatagagcgtcaaaaggacgtactaacagacttggatgaaaattgcatactgaattttgcaaggagatattntactccaatgcgatgtgtcatatcttttacagttggccgagaccatattaataggggataaggactgcaaaaagagatatggctcgttgtggaaanttggttataacactggggtggaaaaagaaaacgatgggaatggattggaccaatggggtatgttgtgggaaacaagtgtaaagagagacctttaggcatgcgggatggcaataaccataatatcgagggaacaatgttattacaacaacgttatgtttccatgttatttggtaaaaatgttgtaggtaatgcacaatgggggatggatgagaggagtatagaacgcaggaaaagggcttaaatagctagagaattggtgctaaatgacattaagaggggtgagaggaccaatggaagaacacaagtgaaaaaaggtcattttgaggcaagaggattcaacttatttatcatattggtgtgtttaccacatttatatgtgacattatagtgaaaaacacaaggaaacatgtatataaggaaaggcaaggtgcttaaggggggcgaacaatggtaccaacaagaatgggggtaggagtagccagaggagtctgaagggcaacacagtggntgccaanggtatacatatgtataagacatatataaatggtggacaacaatttgatggacaagaacaatagaatatcaaattggacaatttagtgagtaacttatagagaaaaaacngtggtgactggacatttaagttatgtgagaattgttcacgggtgatatagaagcattgtattggttatggatatcgatagcttggtggcagagaatgtgggggtaccaagtagcagggatatcggagaaattggagagaattattcaagtgggagaggaaaaaacaaggatagacatacattatggagcttaagatagtacatatcataaccatcaaaggagggaaaagagtataaaagagtgagtaaacgcatggtatgtggatcacggaaatccacaagtgaaatgtttaggaggaggaccatataaaaggggatacgttgtgtgatnggagagacaaaaatagaatagtcagaagacaaaggtggacaangtgggtgaacataggatcatcaatccaaactcgagagtggaatcttaggtctttttacttatcagggtatgtcttttgtctctcctatggatgatgtaaagtatgagtgggcatgatgagaatatgtcaatagacaaacgatagatgaataacaaaagatggtagtcagcaagatcgaagaatatgaaataatgagtgagatgaatatcaggacaactgattgcatcacgcaaaagcaagataagaagagaaaagacagagtagaagacagcaagcatgaatgagatcaagataacaacgaaaagattgaaaatagntagatgtagtaagagagtgtgatgttagatcgataaatacaatattgctact

SEQ ID NO: 656800 - DNA, 519 bp, Homo sapiens
  misc_feature (62)..(62): n is a, c, g, or t
  misc_feature (146)..(146): n is a, c, g, or t
  misc_feature (156)..(156): n is a, c, g, or t
  misc_feature (193)..(193): n is a, c, g, or t
  misc_feature (211)..(211): n is a, c, g, or t
  misc_feature (215)..(215): n is a, c, g, or t
  misc_feature (227)..(227): n is a, c, g, or t
  misc_feature (244)..(244): n is a, c, g, or t
  misc_feature (247)..(247): n is a, c, g, or t
  misc_feature (280)..(280): n is a, c, g, or t
  misc_feature (285)..(285): n is a, c, g, or t
  misc_feature (300)..(300): n is a, c, g, or t
  misc_feature (311)..(311): n is a, c, g, or t
  misc_feature (382)..(382): n is a, c, g, or t
  misc_feature (384)..(385): n is a, c, g, or t
  misc_feature (402)..(402): n is a, c, g, or t
  misc_feature (419)..(419): n is a, c, g, or t
  misc_feature (440)..(440): n is a, c, g, or t
  misc_feature (455)..(455): n is a, c, g, or t
  misc_feature (468)..(468): n is a, c, g, or t
  misc_feature (477)..(477): n is a, c, g, or t
  misc_feature (490)..(490): n is a, c, g, or t
  misc_feature (495)..(495): n is a, c, g, or t
agatgtataaagggtcccaagccttaggggatgccgctaacatcgtgtttgtctcacccccnccatggagagtgtttgcggatacttccacaggtcccacaacgcagcgaggagtttttcattgctggaaaactgcagatggactnttgcacatcnctacctgcagtttgtggctccctggaacagccttagnttagctcagcgccggggnttcnccaaaacctacnctgttggctggaggaangcncagtgtttccctgtttatccatcccctgcaaantgcanagtggcactcattgnttgtggacggnccagctcctccaaggcttttaaaaggggttccagtcccgtccccttgcctgcctgcctcgggaaccagggntnngcccctggcagtccctncggtcccaaatagcctnaatcctgcccggagtggaaanttaagcctgcccagngtcccccctgttncccctcccnttttttttccggncaatnaaataaaaagtttcccccccgcca

SEQ ID NO: 656801 - DNA, 183 bp, Homo sapiens
  misc_feature (93)..(93): n is a, c, g, or t
ccgtgaatatctctatgatgaattccactggtggcagtagcagtggcggtggcattagggctgaccctcgaggggaaccatgggcaacaatgncctatgtcctagaatggtattgccaaggttttcttctagaggtttttataggttttaaggtctagcactttaacgtctttaataccatct

SEQ ID NO: 656802 - DNA, 356 bp, Homo sapiens
tgactctacaggatcttaaaacctactaaagatacaaagttagccaggcatggtggtgcatgcctgtagtcccagctgctcaggagcctggcaacaagagcaaaactccagctcaaaaaaaaaaaaggaaagaaaagaaagctggagctgggggcttaggccatcacccttcccttggttggaactactggacagaccctttggagatgtgcctgtggtcgctgtggagatgtgtgtaggggccttagctcttggtggagcttgtgtgtgtgtggtgtagtctaagctgtatgctgaaatggggcgtgtgtggaagggcttcttagctcttgggtgagattgcggggtagggggac

SEQ ID NO: 656803 - DNA, 238 bp, Homo sapiens
acacgatctttgctcccaatgttgtggatgcttcacagaacttgtaacagagacaatctaggaaatcgtgaaagagattgtgaatatgtgagaaaggcaggggtgaagggtttcaagatatggattttggagaaattcaagagttgctagacaccacaccaggagaattaacagaagacaaattgatgaagagagtgcttccgaaccaggaccagacgactgtcccagaaagaagatg

SEQ ID NO: 656804 - DNA, 101 bp, Homo sapiens
atgcccagtagttagagctctgtaatgtcgcggtcggagtagcgtatcgatggcgcagttgaggtggcgcatatgatcctaggcctataaatattcggagt

SEQ ID NO: 656805 - DNA, 140 bp, Homo sapiens
gaaggagtgacagtacaattttgtgacatagctatattgaatagtggtgaagtctgagcctttattgtaaccatcacccagatagtgtacgttttacccattaatttctcatcatccactcccctcccatcgtcccgccg

SEQ ID NO: 656806 - DNA, 1125 bp, Homo sapiens
ggggaagtccggacgcagattagctccctgaagcggaggcgaaggggagtttaagccccagcggacggcaatggcggagaggcccgaggacctaaacctgcattaatgacatcggcacacaaacaaagagcaagcctagatgagcagtagaataaaagaaagaaagaagcagaacgaggaaaagagaaaagagaaacggagaaacaaacagaacaaagacagaagaaaaaaaacaacacaaggagagaaaaaaaaacagaaaaaaaaaagacaaaagaaacgaagaagaaagagacaaaaacaagaacgagaacagtaacaagaaaaaacaaaaaaaacaaaacaagaaataagacaacactaataaaacaaacaaagaaacaaaaaaaaaaaaaaaaaaaaaaataaaacaataaaaaaaataaaaaaaaaaaaatcaaaaaaaaaaaaaaaaaaacaaaaacaaaataaaacaaaaaaaaaaaataacaaaataaaatacacaaaaaaaaaacaaaatatataaaaaaaaaacaaaaaaaaagaaacaaaaaaaaatcaaaaataaaaaaaaaaaaaaaaaaaaaaacacaaaaaaaaaaaaaaaaaaaaaaaaacaaaacaaaaaaaaaactacaaaaaaaaaacaaaaaataaaacaaaaacgaaagctataacagcaaaaaaaccaacaactaacaaaccacaaagcagcaaacaatacataacctaaagaacaaaaaacacaacacaaaagagaaaaaaaataaaaaacaaatacaaacaataacatacacaataaagaaaaagaagaaatcaaacataacaacaaaaacgcaaaaaacaaaaaacaaccaaaacacacaaaacataaaagtaacaagaaatataagaacaccaaataaaatataaacaagacaacagaagcagcaaaaaaactaatttaaaaaaacaaagaaacgaaacaacaaaaaacaattacaccaaacccatatatatacaaaataaaagacatacacacaacataaaaaaagcaacatagaacaaaataaagaaacacaaaacacaaatagactcaaacaagaaaacaataaaagatccataatcaaatattaaaacattaac

SEQ ID NO: 656807 - DNA, 201 bp, Homo sapiens
ctgatctctgctcactgcatcagcattactcccaggttcaagtgattactcctggcctcagtcctcctgagatagctcggattacaggcgtccgccaccatgcctggcaagtttacgtatttttagtagacacggagtttcatcattttggtcacgctggtcttgaacgtactgacctgaggattatctgcccgcctgggc

SEQ ID NO: 656808 - DNA, 310 bp, Homo sapiens
agcgcgatggcaggtccgacaggagcaaagcagcctcactcgcgcttccaggagtgctcgttaaagggaccagagtgacatactgatgcctacggaggcatctgagatgcactgtgttggaggttagcctcaagtgccagcctctggattgtctagcgtgagtgacatcacctataaaatcacattgtgtaccattctggacacaggatcacaaaggcagaggcaagcaatcttttttttttttttttttttaaaaccctcctctataaaggattctgtggcgtgctggctcatactcaggggtagcccg

SEQ ID NO: 656809 - DNA, 235 bp, Homo sapiens
  misc_feature (74)..(74): n is a, c, g, or t
ggttaagatacaacgacgacatcagaggattggggtgcggctgccggcacataagcgcattgctacagctgctnggactcaaggaccaggtgaacactgtgggactcccatctgagcctcgacagggcctggagccccatcggccaagaatacttgaagaaacagagtggcctccctgctgtgccatgctggcgcactgcgcgactttatttatttcaagtcgtgttgccggggt

SEQ ID NO: 656810 - DNA, 913 bp, Homo sapiens
ataatactgtttattgtccacggaccgagcgatttttcaagaatgatacaaagcactcagagacatgcgcagtctgctagtcaactgtgaatcattgcctggtggctgtgttcagatattacccattggtaggtatcaagacttgcactgtacatcaaagaagcaaggtttactggcatacgtggagacagcatctgcgacccaagaagtagagaacagccgtagcgccctcacttgcaggcgtgagattacctatcagtgtactcttacactatatcggttcctattcgaaccactcttttgacatcttacacctctcgatcgtcccacgcattcatcacatgaggtatcgtaccaaggtcttaccaacaatttactctgccacgaggactacacacgcgaattccttacagcacgcctagccgactatcaggctacatgcacaacagcgtgctagcgtacatagcacaagttaactacacacaggaaactaccaaaacaacgcagccagaatcagagccatcacccattacataaaacgcagggatagcccactgaaaagccaaagccaagaagaaagccaaagaaaaccaaggcgcgcatcaaacgaacacagcaacgccccgacgcgcatggagccaacgcacaagcaccaacgacaaccagcacaagaccccgcgccgaacacaaagacaataaccgcacgtaatccagaccaaagctgaaaacgcctaacgcatggcgccaaacattagctacagtctacttagcctaacgcacaccgcacaacagaaaaaggggactagcacccccaaagagctgcggcggagaaactacggcacacacacaaaacatcatcactgccacctcgcatacacaaccggtataaactaagaccgggcagcacccggcc

SEQ ID NO: 656811 - DNA, 1709 bp, Homo sapiens
  misc_feature (529)..(529): n is a, c, g, or t
  misc_feature (531)..(532): n is a, c, g, or t
  misc_feature (534)..(535): n is a, c, g, or t
  misc_feature (537)..(537): n is a, c, g, or t
  misc_feature (539)..(540): n is a, c, g, or t
  misc_feature (545)..(546): n is a, c, g, or t
  misc_feature (552)..(552): n is a, c, g, or t
  misc_feature (554)..(554): n is a, c, g, or t
  misc_feature (1442)..(1442): n is a, c, g, or t
  misc_feature (1491)..(1491): n is a, c, g, or t
  misc_feature (1499)..(1500): n is a, c, g, or t
  misc_feature (1534)..(1535): n is a, c, g, or t
  misc_feature (1575)..(1576): n is a, c, g, or t
  misc_feature (1580)..(1580): n is a, c, g, or t
  misc_feature (1593)..(1593): n is a, c, g, or t
  misc_feature (1601)..(1601): n is a, c, g, or t
  misc_feature (1603)..(1603): n is a, c, g, or t
  misc_feature (1608)..(1608): n is a, c, g, or t
gcagtaacacgccaggatcttacacagatgtcagtgcctcgtctggctaccatctgttccagtgaccgagaaccactgcgaggacattgatcagtgtgacttccctgcagactgcgtagggggtgacggcatcaatatcaatggctcctacagatgtctgtgcccccaggggcgatcggctggtgggtggcatgaaatgcctacacatagatcagtgcagcctaggtatcctgagaccatgttgaccgttcccctatgggggggcttgtcaagaaccattcgatggtcatccatatgatgtgtgtctagctcatgagggcttcgatcgtaccctacccgaggtaccagcacgtgttgtgagagaggtggaagcagtcccgaccacatagacggagtgctacctgaacttcgatagactacagtggttctttgcgagctaggcagtaattacggccacccgaagcgtgacacccaaacgaggagtgctgcgtgctctctgggggccggctggggcgaccactgcgaaatntnncnntncnnagtcnncactcngncgagttcacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaaggccggcttcgcggcgcagccggcccgcacgggggcctgcgttccccagcgccgccgctgacggcgcgncgacgccgccctcggcccagacctcggtgatcactggagggatttccgngagctcgnnctcacttctgcccgacttgtggtcggacccaggnnccttcagggcccgagaccctcccgggccttgagaccgagnngccnctacgggcccccntccccggntnagcgngcggttgtaaggtctccggagggacgctgctggctttcctcccagagggtggtttcctagaaactgataatcagatcgtgctctttaaaacaaaaacaagg

SEQ ID NO: 656812 - DNA, 631 bp, Homo sapiens
cgcgcgcgacgtgtgtcttctgtggcacagattcctctcatggagagtagccctgtcacatcatttattatagctcccatggaggagcaaagcatcgggtccctgtgttgatgtcgaataaggtaactgtccagtcatcaatacatacagaacaattccaaatgcatatacatctgacggaaagctgtatggctttttagtactgagcattcgggatgacttctggtgccgtccacaaaatgggtccagacaactgttcaaacggatgggacccactccatggagatttcacggtagccagaccaaaatcagctatgtctacagggaggtcttcatgaagaaatatatgagttactctggaggtctcgagtggatgattgacttggggtgtaagtgatccatgcgctgtgcaggcggtcgggcaatatctataagttagatgatctcaaatttggtctcaatgatatggagatggtgatacaagctggagccctcagaccactggggtaacaagagccaggtgtggcttcgtggaatagcccatgaagagtaggcgattcacctgtcggggttgcctgaaaaatccgaagtcagtggtgacgtaggaatacgcgggataacacgttcgcga

SEQ ID NO: 656813 - DNA, 280 bp, Homo sapiens
tatctagtcttacattttagcgtacaccctttgatgaaggttattgtagaagacgctcctgtattgggtaggagattgggaacaatgtcagctacgatcacttcccgctctacttttccaaatagcttgcattgtatgagggcagataaggataagactgggactcatgtgctctctctgaatacccacacactctcacactctgtctctctacctctgtctctgtttctctgacacacacacacacacacacacacacacacacacacacacacacaca

SEQ ID NO: 656814 - DNA, 1142 bp, Homo sapiens
  misc_feature (875)..(875): n is a, c, g, or t
  misc_feature (924)..(924): n is a, c, g, or t
  misc_feature (932)..(933): n is a, c, g, or t
  misc_feature (967)..(968): n is a, c, g, or t
  misc_feature (1008)..(1009): n is a, c, g, or t
  misc_feature (1013)..(1013): n is a, c, g, or t
  misc_feature (1026)..(1026): n is a, c, g, or t
  misc_feature (1034)..(1034): n is a, c, g, or t
  misc_feature (1036)..(1036): n is a, c, g, or t
  misc_feature (1041)..(1041): n is a, c, g, or t
ggtgcgcccagcccacgcctccgggctgcagctgcgggaccggagcggccagtgtttgtcaccccgcagacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaaggccggcttcgcggcgcagccggcccgcacgggggcctgcgttccccagcgccgccgctgacggcgcgncgacgccgccctcggcccagacctcggtgatcactggagggatttccgngagctcgnnctcacttctgcccgacttgtggtcggacccaggnnccttcagggcccgagaccctcccgggccttgagaccgagnngccnctacgggcccccntccccggntnagcgngcggttgtaaggtctccggagggacgctgctggctttcctcccagagggtggtttcctagaaactgataatcagatcgtgctctttaaaacaaaaacaagg

SEQ ID NO: 656815 - DNA, 1850 bp, Homo sapiens
  misc_feature (529)..(529): n is a, c, g, or t
  misc_feature (531)..(532): n is a, c, g, or t
  misc_feature (534)..(535): n is a, c, g, or t
  misc_feature (537)..(537): n is a, c, g, or t
  misc_feature (539)..(540): n is a, c, g, or t
  misc_feature (545)..(546): n is a, c, g, or t
  misc_feature (552)..(552): n is a, c, g, or t
  misc_feature (554)..(554): n is a, c, g, or t
  misc_feature (1583)..(1583): n is a, c, g, or t
  misc_feature (1632)..(1632): n is a, c, g, or t
  misc_feature (1640)..(1641): n is a, c, g, or t
  misc_feature (1675)..(1676): n is a, c, g, or t
  misc_feature (1716)..(1717): n is a, c, g, or t
  misc_feature (1721)..(1721): n is a, c, g, or t
  misc_feature (1734)..(1734): n is a, c, g, or t
  misc_feature (1742)..(1742): n is a, c, g, or t
  misc_feature (1744)..(1744): n is a, c, g, or t
  misc_feature (1749)..(1749): n is a, c, g, or t
gcagtaacacgccaggatcttacacagatgtcagtgcctcgtctggctaccatctgttccagtgaccgagaaccactgcgaggacattgatcagtgtgacttccctgcagactgcgtagggggtgacggcatcaatatcaatggctcctacagatgtctgtgcccccaggggcgatcggctggtgggtggcatgaaatgcctacacatagatcagtgcagcctaggtatcctgagaccatgttgaccgttcccctatgggggggcttgtcaagaaccattcgatggtcatccatatgatgtgtgtctagctcatgagggcttcgatcgtaccctacccgaggtaccagcacgtgttgtgagagaggtggaagcagtcccgaccacatagacggagtgctacctgaacttcgatagactacagtggttctttgcgagctaggcagtaattacggccacccgaagcgtgacacccaaacgaggagtgctgcgtgctctctgggggccggctggggcgaccactgcgaaatntnncnntncnnagtcnncactcngncgagttcacagcctctgcccagacggaaagggctacacccaggacaacaacatcgtcaactacggcatcccagcccaccgtgacatcgacgagtgcatgttgttcgggtcggagatttgcaaggagggcaagtgcgtgaacacgcagcctggctacgagtgctactgcaagcagggcttctactacgacgggaacctgctggaatgcgtggacgtggacgagtgcctggacgagtccaactgccggaacggagtgtgtgagaacacgcgcggcggctaccgctgtgcctgcacgccccctgccgagtacagtcccgcgcagcgccagtgcctgagcccggaagagatggacgtggacgagtgccaggacccggcagcctgccgccctggccgctgcgtcaacctgccgggctcctaccgctgcgagtgtcgcccgccctgggtgcccgggccctccggccgcgattgccagctccccgagagcccggccgagcgtgccccggagcggcgcgacgtgtgctggagccagcgcggagaggacggcatgtgcgctggccccctggccgggcctgccctcaccttcgacgactgctgctgccgccagggccgcggctggggcgcccaatgccgaccgtgcccgccgcgcggcgcggggtcccattgcccgacatcgcagagcgagagcaattccttctgggacacaagccccctgctgttggggaagcccccaagagatgaggacagttcagaggaggattcagacgagtgtcgctgcgtgagtggccgctgcgtgccgcggccgggcggcgccgtgtgcgagtgtcccggcggcttccagctcgacgcctcccgcgcccgctgcgtggatatcgacgagtgccgagagctgaaccagcgcgggctgctgtgcaagagcgagcgctgcgtgaacaccagcggctccttccgctgcgtctgcaaaggccggcttcgcggcgcagccggcccgcacgggggcctgcgttccccagcgccgccgctgacggcgcgncgacgccgccctcggcccagacctcggtgatcactggagggatttccgngagctcgnnctcacttctgcccgacttgtggtcggacccaggnnccttcagggcccgagaccctcccgggccttgagaccgagnngccnctacgggcccccntccccggntnagcgngcggttgtaaggtctccggagggacgctgctggctttcctcccagagggtggtttcctagaaactgataatcagatcgtgctctttaaaacaaaaacaagg

SEQ ID NO: 656816 - DNA, 340 bp, Homo sapiens
  misc_feature (4)..(4): n is a, c, g, or t
ctcngcagatcatcacttcgacgatgtcggcctgctggtagaccatcgcgcaccaggcccctcccaccaccatcaggccgttgccgagcaggaaggcaacgatgctggccaccaccgccacccgtccgctgcgcgacaaccgggtccagttggtggcctgggtggcaccactggcaaaggtgccaaagaccatggtcactgctgccgaaaaggtcatggtttcatgcggcaccaccgccgccaggccggcaaagccaccggcatcgcgggtgtcggtgccgctgatgttcgcgttgcttggtggtggcgatggtcatcgacacccgcgatgcgggtaccg

SEQ ID NO: 656817 - DNA, 961 bp, Homo sapiens
  misc_feature (22)..(22): n is a, c, g, or t
  misc_feature (389)..(389): n is a, c, g, or t
  misc_feature (455)..(456): n is a, c, g, or t
  misc_feature (462)..(462): n is a, c, g, or t
  misc_feature (703)..(703): n is a, c, g, or t
  misc_feature (712)..(712): n is a, c, g, or t
ggactttgcgcggaggtagganggggaagtggaggcgggagtgaagtctcgcgagaagagtcggttgccgtagcagagccctctagctgtgtgtgtctgaggctcggcgctgagccgggacggtttgctgagcccgttagtgcgcccggccgagacacgccgccgccatgtccgctacctgcgtcccccaacacgtctctgttcgtcaggaactggccgacgacaccagtctgaagattgcggctgaatttggtcttatgtctatattgatgtgtatgttccattgattctacatcgcgtccaagagattgctatgttcaattgaggatgttcgtgatgctgaagacgcttacataattggacagaaatggattgtggacggcagatgnaatacatttgccaggggatcaagacacaaatcagtgaaagccaggaaggagaagtgtttctcacgnnatatgnttatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgacaagcggaaaaacgaaccacaagnaagggcagnttcaacgcgaacaaaggtggggtgtggaagtgctgcagtatgaatatgttcgaatcttttggctctggtctggacaagatttcgaatgttttctgacttcttgggatattgaggccttcattttgaacgtagcttttggcattaagggattccttttgctggggactcatcccaatgaatgggttttgtgagggccggccacaatttggcacggtgctttggaagcttttgccttggtcacactgtggg

SEQ ID NO: 656818 - DNA, 644 bp, Homo sapiens
  misc_feature (22)..(22): n is a, c, g, or t
  misc_feature (389)..(389): n is a, c, g, or t
  misc_feature (455)..(456): n is a, c, g, or t
  misc_feature (462)..(462): n is a, c, g, or t
ggactttgcgcggaggtagganggggaagtggaggcgggagtgaagtctcgcgagaagagtcggttgccgtagcagagccctctagctgtgtgtgtctgaggctcggcgctgagccgggacggtttgctgagcccgttagtgcgcccggccgagacacgccgccgccatgtccgctacctgcgtcccccaacacgtctctgttcgtcaggaactggccgacgacaccagtctgaagattgcggctgaatttggtcttatgtctatattgatgtgtatgttccattgattctacatcgcgtccaagagattgctatgttcaattgaggatgttcgtgatgctgaagacgcttacataattggacagaaatggattgtggacggcagatgnaatacatttgccaggggatcaagacacaaatcagtgaaagccaggaaggagaagtgtttctcacgnnatatgnttatgacagatacagacgttctagaagccgaagttatgaaaggaggagatcaagaagtcggtcttttgattacaactatagaagatcgtatagtcctagaaacagtagaccgacttcttgatctcctcctttcataacttcgcttctagaacgtctgtatctgtcataatcataatgtgggc

SEQ ID NO: 656819 - DNA, 350 bp, Homo sapiens
tggtaaaatcctgtctctattaaaaatagaaaaattggcaggcatggtggtacatgactgtggttccagctgctcaaaaggctaagccaggagagtcatttgagcctggtaggcagaagttgcagtgagccaagatcgcaccattgcactccagcctgtacgacagagggagattctgtctcaaagaaagaaaaaaaaaagacaaatgggactatattcaaactcaaaaatcattctgcccagccaaagggaaccaatcacacagcagtaaagagcaaacctcatgaatgggagaaagccatcctgcaagctattcatctgatggaaggttgatatccagcatatacaag

SEQ ID NO: 656820 - DNA, 375 bp, Homo sapiens
cctctccgcctgtctgcagcttgccttctgccctctggatatcatccttctcccgcaggcctgacatgtccataacccctgcaggacacaccttcttcatctccttttggagccacctgctcaagcaggtggtaataagctttagagtccttgatgtcagtactgaagttgccaattttgttgcagcctgcatatgccaggtggtacttagcccacctcaggaagagctcttcaggggagagtttcatcaaatcctccaggcactcaccttctctcaaaagagcaatcagagctacatatctgctgagttcaatgtcagcaaacaacccaatcttgatgacttgccacagaagtcccaggaccagataaggcttc

SEQ ID NO: 656821 - DNA, 137 bp, Homo sapiens
ctggggggaaactgactggagggggaactgactgactgggggataactatctggagggggcactgactgactcggggagaagtgacttggggggcactggcagactgggggccgggtctgagcggcgggcggccgct

SEQ ID NO: 656822 - DNA, 452 bp, Homo sapiens
  misc_feature (2)..(2): n is a, c, g, or t
  misc_feature (14)..(14): n is a, c, g, or t
  misc_feature (84)..(84): n is a, c, g, or t
  misc_feature (93)..(93): n is a, c, g, or t
  misc_feature (117)..(117): n is a, c, g, or t
  misc_feature (325)..(325): n is a, c, g, or t
  misc_feature (354)..(354): n is a, c, g, or t
  misc_feature (360)..(360): n is a, c, g, or t
  misc_feature (399)..(399): n is a, c, g, or t
tngcggggtggccngctccgggtgtggacgggcggtccccctttcacctgccgcctcgggacaagcgttggggaaccgcatcgncgctgtcgncgcttgtggaggagtccgcgcagncgttctaacaggtgatccgcgtcactcccaggccataccgaagcggctgaacgctgtgccagggctccttatgctcttctgttctgggacgtgaaaacgtctttccgccttattggtcgtccaaaaaggtgcaccggttcacagtataagagtcaaaaaccagtattaccaaaaaggacactacgaggcgtcaggggttgcaggagtnggctttctttcggatttaacggaaccggncagganccattcgttaggtcttcttaaaaattcggggtttcttgncagtgggtgggccgaaaacgttaggttaaagttttccaagtttgttaaagttg

SEQ ID NO: 656823 - DNA, 122 bp, Homo sapiens
ggggagattcgtggggacacggggggagaggacatgtgtaaattaatataaaaagtaatagaatagataagatgaagagaataaatgaagaaaatgatataattgagagaaataagttattt

SEQ ID NO: 656824 - DNA, 1075 bp, Homo sapiens
atccgcgccgctcctgcgtgacagggcgacaacctgcagcacagcggtgactgtggcccggggctgtggcatggtggccccccaggcagcactctgatcatctgtccacgcacacccaccctgcagcggggctcacgccatgccctctctcgcacgttccctgccgcatggcagtcccctcacagcccgctgcaactggccgctctacggctccctggctccacgggccacctgctctcttgccccgcactggtccccctgcagccacgcaagcacacgcacgctgcgctgcttgcgacgcctaccaggaacgccttcacgctacctagcgctgcgcgccactgctcgcgcgacgaccgcgctgtccaacttgacctgctgcgcgcgcccgtgcacgcgccgcgcctgcactgcatcggcactcctcgccctgctcaccacgcgccaagcaacgccctccagtaggctcctcacccgctatccaccgtcgcacgccacttggcccacgctacttgcagctgcagtgcgccactggctcactcacgcggcacgggcgctgcgtgcttccctcttgcaacaccttcgctctccagcgctccttcacagctaccacttggccctctgctaaccacgccctgcaccccaagctctcaatcctcccgtccctgcactccctctaccaccggatccaacaccacacctggcgttgaccctgacacgtctccctggccccctcgcaacctgaggtcatcacccaccccaccgccgcgcacctcctccctgagcccgcacccggggccacacgccctggctcctggcgcacccggtaccccgccacctagcggagcccgcctcctccagcgttgtcccgcgggctccgcggccctgactgtcctgccccattgcgtccctgttgaaacgccgttaaactaatagggcacaccttcctcactcctctaccccaccaacaatacctcacccctatacaaactacacacccaccacacaacaacactaccaccacaaacaacacacaccaacccactacacccaccccccaccccacccctccccg

SEQ ID NO: 656825 - DNA, 171 bp, Homo sapiens
  misc_feature (20)..(20): n is a, c, g, or t
  misc_feature (72)..(72): n is a, c, g, or t
  misc_feature (107)..(107): n is a, c, g, or t
tgatggccaaactgaaacancagagttatgagatcaacgtgactgtacaaccgcatcagccacgcccacaanttccggaagggggcaaggtaacggcctcgttggangccgctggaagtgaggatgccgccccggacagtggcaccagggaaagcctgggattgtatgtcc

SEQ ID NO: 656826 - DNA, 710 bp, Homo sapiens
tggggcaaacctaccggaggtttattttgggcccaaaaaaaaaaccaatggattggtttggaccggggggtggggcaggggggtctccccaaggttaaaacccccccgaggggggttgggggtaagggttgaccccgggggggctcctcgggtgtcccgagtgcacacccgggcaataggggccctccttctcccgacgctcgggggcagcgcaggagaggggttacgcgggagaaaggcgcgtgccgcagagctgtgccatgtgggccgaggaacgctcagggagggcactcgaaacaccagctcccaatacaggtgtctcgacctctccacaaccaacggcccgggaaggaagctgggtgcggaatgaaaggcagtggacagcccgcgccaagagccaaggtgggggagccccaagggctggtaacttgcagcggcgccggggttggaggggaggcccccaaaggggcgcgagtctcacaaaccatccctgatataacccgcgggggggggttctcccggatgacataactccatggtctcggttataccacgaaatctacagagcgcgggttctctcccctgcccaccacacagcaagtcttccggtagaggggggcacacccccaggtccggggccagtttggacgtcaccccacgtgcggggtcaccacgcgctgccggccaagttctgttggcccgatgaggag

SEQ ID NO: 656827 - DNA, 425 bp, Homo sapiens
cccttcgggcatgatttgcaatcacaagccccctgaaacaagtgagttccaagcccacaggagcctatcaattcaagtcttaagtggtcccggaaatgcgtgcaaagcccccatatatagcccttttcacggcttttataagccttcaagctcttactatactcaatccttctcagtcgcgatatcaacacacctaagattctctaaggcacagcaatagcatgcgtgatctagtgggtagcgcagtgtccacactgccacatctatctacagatgtgatatatagctcgtcttatatacacacccacacacgctacaacacataacacactccgctgatgtaacacgagcgcgtgctctgtgagcccacgatagagacacgcttgtaaacacatctcctcgcgtgccgaattcgtacagcccgg

SEQ ID NO: 656828 - DNA, 641 bp, Homo sapiens
attggtggagagtagacagcagaactcatacggctgtgctggctaagcagagactgtagtatgctggctgacagcgacgatcagtgcagcgatggctgtggtgctggggccagccccgggactcccgtggtgcagtgaggacccgtgtgtcccggtgtcctggctgctggcatccctggtgcaaaatgcgggcgatggaactgcttgaatgtgaaatggagtgcggagatgtgccctgtttgatgcaggaagttctggggtgctccatgtacctgtgaatcccaacttgctgtgcctgcggtgtgcccactgtcacccacggtccccacagtagaatgcgatgcatggtcccagcggctcctgtgatcctgcccaattatctgcgacacaacacataccatgcaggtccagcatgactcttggaggcccgatgcatgactgcatgcaagccacaggtagttcctcccatggtgggatggccctcacttttgtagggcccatgattggcatttggcccgtggtgatcggagtcacctggacagcgccagagggctcgacgaagccatgttcctgcggcggagcaagcatgtgagcccaccaagagggcccctatccttgcgtccaagcactactgtcccacc

SEQ ID NO: 656829 - DNA, 293 bp, Homo sapiens
tatatcattacctttgggaagacaactcatatcagctgagcttcttttgatatgcctattttccatatgtatatcttcttgggtgaggtgtccttttcagatgttggtacatttaaaaatcagttattacccactcccaccacttctattcaacatagtactggaagtactatcaagagagagcaattagacaagaaaaagaaattaaagatatctaaatgggaaaggaagaagtaaaatgatctctcttggcacatcatatgatcctatgtgtagaaaactccaaagactcc

SEQ ID NO: 656830 - DNA, 106 bp, Homo sapiens
tcgatacgactttttttttttttgaactaagtggcttttttattagagaaagccagaattacaaaagacttaagagttggcattggggcccttctgtcgtcttctc

SEQ ID NO: 656831 - DNA, 1021 bp, Homo sapiens
aaggtctctctatgcaagcagtaccgttggggccgcgcgtaggaatcatgtaggataagagtgaaccaatggatcatgggtctgttatcctagtgagaatcctgggtcatgacgtaggtgctctggagtccatcagacaagtaaaatgaacgcaccggacggctcaccgatgctgtactgacacaacttcccagatggatgttctgtgacggtctattgacattggcatgctgatcgaaaacgaagagatgatctccaatgactgacgcatcggtatgatcctaacagtgtacggcaccactgtcactggaccaagcgattggacagtgagtcggatcttcgacaacgaatgtgcgggccagaggtagccgcaagaagaatggactcgggaagctgacaggggcatgcttgttacctgtatcgcataaagtttccataaccagcgacacgtaaaacctagccggcgtaccgcgattgcctggcgtaaaagatcacggtcggcacgcttaaggtctgacacatcggccgtcaattgcacacccttagttgacgccagacttacaacacattttcgtagattaacttgactagtcttcaacgtgggccctgaagagagtactaactcacaccgggaacttggagcccgagcgacaaatactaagaacgtccgcgacgcaaaggaatcaagggagacatacctacagaagcgacgagtacggctaaaaagaacgtaacacctccacccacacgcagaactacaccccccttaagtggaccgtacccggaaaggcgcggcaataggcagagagacggactacacaacagggcccgcctggccattactgcgccaaggcggacggaaaaggccctcctgtgccaacacttacacgcccagaggaatgggctgactaacgtaacggccgacaacaacctgctgttcctcggacgccccatagaacgaagacatcaccaagaaggccgtatggacgcgttacgcatggcagaaaccgcgccgcaacga

SEQ ID NO: 656832 - DNA, 303 bp, Homo sapiens
aaatgggcgacatgccagcagcctcacaatgaaggcttgactattgacctgaagaattttagaacaccatggagagaagaccttcaccctatcgtaagccgtctttttgtgggacatcttcctcccgacatcactgaggaagaaatgaggaaactattttgagaaacatggaaaggccggcgaagtcttcattcataaggattaaggatttggctttatccgcttggaaacccgaacccttgcggagattgcccttgtggtgctggactatctgcctctccgtgtacagcatgataggtggtg

SEQ ID NO: 656833 - DNA, 240 bp, Homo sapiens
  misc_feature (1)..(2): n is a, c, g, or t
  misc_feature (9)..(9): n is a, c, g, or t
nnatagggncagggggccgagagaggagaactatttgaacctgagaggtggaggctgcatagagccaagatcgcgccattgcactcaagactgggcacatatttagactccgtctaaaaaaaaaaaaaatattagacaaaataactttatgacaaaaactggaattataatctaagaatattttataatgatcaatgtgtccgtcctttaggaggcatttaccatttttaaacacgcatg

SEQ ID NO: 656834 - DNA, 1288 bp, Homo sapiens
ggtcgctgctactcctttggattatgtctacaggattccaaagtagtctcttattccggagagaaggacgatctgcatcttgcagacagttattggcattgacccatttgaaattgtgtcaccggtccgttataatcataacgaagggagcatgtcagagtcaacactcgattgttagaacttctaaccatggcgtagggtattgaacaatctatgaggctccacttgtggacaaatagatggagtgtgcagtatcgatgcctcgcttatccggagagtctctgacttctgttccgcccatgtgcatgatagcaagtcgagtcggcggcaaagtcatcaggctgtgcgacatccctcgagtcacatccgcatagataggtctggggattttagcatacaacattttaaaccggccaaaaatcccacaaaaaccgggccctccccgaaattgtcaacctccccccttacacgagacgtttaaaagcaccaatttaccttggtgtggttgcgtcttttaccatttaaccaaatgtctggtttcgctggatgaagagccaaccctgtgtggtttttctccctcgtgggtgagggagccaaatgtgccaataacgatatggtgggttcccgttgggtcagcggtgagaaggtacactaaataacttgtcggctctataattcccctctccgagaaccaaaggggggggccctttattagcgcggcgggggcaacacagctgtttctacgtcgggaggagcaccccaaattttcggtcgttgcaagggattcccgtttacaccggtggtctgaaaaacattcttggcgccccacgagactctaataatatttcccctctttcacttaatatagccaaaacccccccctttagcctggaaaatatttacatccccggaaaaagttttatggccccccatacttttttcttcaaaccacacgctgtaaacacacaaccttccgtgggaaaccaaaacagggcggtaacgacaaacgcgctctctttgggtgtataggcgcaacctctcccccatacttgttgcgcgccgggaaatattggtgggggcagggtcacctccggaattggaactcaccggggggcacgatccaacccagtgggggggggcttatagggggggagggggtccatttacctttaaagcacaacggtccccctttgtggagcagataaatatcagagcgagaatataccctaccagtggagatccatttgtggccctctcaagccgattgtggaagaaacattttcctacg

SEQ ID NO: 656835 - DNA, 357 bp, Homo sapiens
acacctctagggatacacttctgcttacacccattagatttggtgtgtgcattctgggggatacacttctgcttacaggcagtggattttggtgtgtgcattctgggggatacacttctgcttacacccattagattttggtgtatgcattctgggggatacacttctgctcacacgcattagattttgctgtgtgcattctgggggatacacttttgctcacacgcattagattttgctgtgggcattctgggggatacacttttgcttacagacattggattttggtgtgtgcattctgggggatacacttctgcttacacccattagattttggtgtgtgtatggtgtgtggtg

SEQ ID NO: 656836 - DNA, 533 bp, Homo sapiens
gaggattaactgcgttgactgtaattctgaacatccctctgcttttcactgaagccccaattgttcagatttatttctaatcacttttaagatttcagttggtcttgacaatatgacaccgtacaggtacacggccctttgtgtccatattttcacgaggtggcatctattgcctgtcatatatttcctctttgtattcacctgaagtaaggctggatgagtttttcttaagtcaaagggggtatcatgagaatttaaatagttgctttgttgccacagcagttgtcatgagaatgaacttgtagttttatctatgagaaatgcaagaggaggccaggcacagaccactgcacgatttttttgtgtccaccgcactctgcacaaaactgacacacagcaggtggacaataaacaactgtgaacatctttgagctttaccaaatttattcttatgttctatgagtttcctacaaccaaaacaaatttcatacatttttaggaaactacaactttagacctttttcttcctgagt

SEQ ID NO: 656837 - DNA, 878 bp, Homo sapiens
ccaaactaaggctaggtggaggccggtgtttaatcggcgaggccgagaggccggttctttaggccgctgcccgcctccagctctcggggtcggctctaggaggcgccctcaggagaggggtgggcgctctattccagagaccgagtggcaggcggcactgtggcggggctctttccccgtttcgcctcagctacccctcagctccggtagtcgccagtccggggtcgtcgccgtttgggcgggagctgtcggcccgcgcgtcccgtcgccgcttccgggtccaggccctcgggccgctgccgtcgtcatgaggctgcgggtgcggttctgaagcggacctggccgtggaggtgcccgagacggaggccgactgctggggcatttgcgctcgcacctgaggcagtccctgttgtgcaccttggggggtacagttctaatacccgatttacaaattacatgtgaactacaaggatcccctcactggagatgaaagagacctgtggttcatatgggatggtttcctggggacttgatatgtggattcttcaagatgacattccagcggcctaatataccttcatccaccagattcagagcattcttcactccagaaataatgagcaaacctcttgtgggccaccagctccaatcaagaactagcattaccaggatggaacaacacaaggtgattccattccaaggacaaggcagccccagatctgtttgtgttggaactgacgaccagtatgttaagggcctagtcaacaattttgaagctgagtcaactgcaagatacatgcggcatattggcagcagtgcacacggtttactatacctaagaaccatgttctgtacgggaatcgcggcgaagggcccag

SEQ ID NO: 656838 - DNA, 724 bp, Homo sapiens
  misc_feature (665)..(665): n is a, c, g, or t
  misc_feature (691)..(691): n is a, c, g, or t
cggcgccaacaatgcaccatccagtggtttattcttcctgggggttcggcccccatgggaacagcccacagagcaaggcagcaaacctgagaccagagaccacagggccagggcagctgagaagtccacctggcggcacagcaggtttggggtgttggggccacaggcatggaggcagatgaggtgggaggaggctgttgtctgttcacatctgggcctaggaaagctgatggggccagcaagggtttgcaagggctcaagaaggcagccgagagccacttcctaccacctttggcacctgtttccctcgctgtccagccattgccgccagggagtcctcctgggcgcggaccgccccgagtaaggacaggcctggcttgctgcgggccggtgtggctgaccgggccctgctcgtcggtgcagcagctgatccattcgagaggcacgtccttccatcctggcccggctctcggagctgaatcgcacccgcccagcagctttccatgccaattacacagagtgtgggtgggaggctcattaacccccagaagtggaactggtccagggagtggtgaggatggacaggggcccttcagccgacgatggggggttaagcgtgccaggtcaggggttggggagcttgctcagcaccatccctgtggtcntcactgcagctctaattgcataattntgaaagtgattggcctggcaacttggtttcacg

SEQ ID NO: 656839 - DNA, 211 bp, Homo sapiens
ggctcttccaccaggcgggggcgggtctccacacctcccgagggtgttttgctgcgccctagggccgggcgggcgcctcctccgcgggtgtacaccgatcgccttcgaacggctgagatttcatcaccctgttcgaggatcttcgctctggtgccagcgcgggctcgaggctctgtacaccagcgccagtaggaggcagcccctcgggcag

SEQ ID NO: 656840 - DNA, 1484 bp, Homo sapiens
  misc_feature (185)..(185): n is a, c, g, or t
gcaacatgccatcctatgactgagtgaagactccggaaacttaggggccacgttgatgccatcggctcacggccgctagtaggcaacgcaccggagagtcgacccccgagcggtcgcggctaagttgctggtgtgtctgcactcacgcagcgcgtgattcgaactttctgaccgaacattaccanctccatgtgcttaacttttgcggtgaacgtttggtactgtaaggcatttacccatctctaaaggaaggaatccacgagtctatcgtgctcacatacattgtacaaaacgcttgcacacatagtcgtaggaactatatggatgcagctgaaacatgagccacggtgtgcaattggctcgctcaaaaatacacaacgaacattgggggccttgcgtccctatacaatcgcaatgctcgtgctgtcgcaaatcggcgccctaatgtaattacatatgcttccctgggggaccaagcgcgatacacgtccatctcaccaacaggccacgaccttgatctattccgcttgacatggatccaacattttcttttcagcctagcacagaagcctcgacggcacgaaccgcattgaccggatgctgtaaggccgggcggtgcccttgttgctcctcctgcgtcgagcgtgtgcctatgctcagacttcgtgacgtggcgccgatctcacattccgactcttggcttgactcgtacacttccctacgccgaacgcccctccgcctaaaccccctcgacgcctagaaaccccacactcaacttaacctaaggcgcataacaggcgcaccagatcttcctccttggcatgaccaagtacaagcccaaccgcattcgctcccttggactccacacgctactccaacatcctccgcctaacctctcaacccgacgaccctccgattccacatacctaccctccatgaggcccccgtagttatcattccccatcctaagacactattttatacaacacaaaacccccaaaacggggagctctcaaacctagaaacacaagcccaaatttataacgactctgcttaacaacccgcttcaatcttacaacggcagtaaagaacgacccctcacatgggcgtcactacaacccatcgcaccaaatatcccacttatatcgacaaaaccccgaccccgacacacgggcgccacccctagtcacagaagcaaaacaaagcacacacacggcgccatcaccgcagcgcccacagacgacaaagaccgcacagagcaacaacgacaagaacacacaacacaacccaacaagcgaaatgaggcccgcacaacaaagcacgcagcccagcgcgccaccccacacaaccccgacacacacccagtcctacacacacaacatccgaccaaacagcccccgacactcgccacaagagagcacaccagacacagcaaaccagcacgcaaagagcgagcatagaggacagaacagggcccccagacc

SEQ ID NO: 656841 - DNA, 600 bp, Homo sapiens
  misc_feature (45)..(45): n is a, c, g, or t
  misc_feature (58)..(58): n is a, c, g, or t
  misc_feature (81)..(81): n is a, c, g, or t
  misc_feature (85)..(85): n is a, c, g, or t
  misc_feature (137)..(137): n is a, c, g, or t
  misc_feature (149)..(149): n is a, c, g, or t
  misc_feature (151)..(151): n is a, c, g, or t
  misc_feature (167)..(167): n is a, c, g, or t
  misc_feature (190)..(190): n is a, c, g, or t
  misc_feature (194)..(194): n is a, c, g, or t
  misc_feature (201)..(201): n is a, c, g, or t
  misc_feature (208)..(208): n is a, c, g, or t
  misc_feature (211)..(211): n is a, c, g, or t
  misc_feature (224)..(226): n is a, c, g, or t
  misc_feature (232)..(232): n is a, c, g, or t
  misc_feature (235)..(235): n is a, c, g, or t
  misc_feature (249)..(249): n is a, c, g, or t
  misc_feature (257)..(258): n is a, c, g, or t
  misc_feature (261)..(261): n is a, c, g, or t
  misc_feature (264)..(265): n is a, c, g, or t
  misc_feature (326)..(326): n is a, c, g, or t
  misc_feature (344)..(344): n is a, c, g, or t
  misc_feature (347)..(347): n is a, c, g, or t
  misc_feature (352)..(353): n is a, c, g, or t
  misc_feature (355)..(355): n is a, c, g, or t
  misc_feature (357)..(357): n is a, c, g, or t
  misc_feature (365)..(366): n is a, c, g, or t
  misc_feature (375)..(375): n is a, c, g, or t
  misc_feature (377)..(377): n is a, c, g, or t
  misc_feature (382)..(382): n is a, c, g, or t
  misc_feature (388)..(388): n is a, c, g, or t
  misc_feature (391)..(392): n is a, c, g, or t
  misc_feature (398)..(398): n is a, c, g, or t
  misc_feature (411)..(411): n is a, c, g, or t
  misc_feature (418)..(418): n is a, c, g, or t
  misc_feature (421)..(422): n is a, c, g, or t
  misc_feature (594)..(594): n is a, c, g, or t
cggcactgtccccgaggcgggaggagcccgagggggcgcgagcgncactgaatcattntagtcaatcattttccatttctnagcngctcagttgtgatcaagggacacgtggtttccgaactgccagctcagaatangaaaataacttnanatgggatctcgttctntctcccattctttatttcatttntatnatcatanctcactncancctcaaactcctnnnctcaancantcctcccacctcancttcccanntanctnngactacagggattttatattggaagacatggatcttgctgccaacgagatcagcatttatnacaaactttcagagactnttnatttnntnanacagaccnnccatcagtntngcatntcaganaanncaattnaaaaatttatcanacagctnctnnaaaagaatgaacctcagagaccccccccgcagtatcctctccttatagttgtgtataaggttctcgcaaccttgggattaatcttgctcactgcctactttgtgattcaacctttcagcccattagcacctgagccagtgctttctggagctcacacctggcgctcactcanccatca

SEQ ID NO: 656842 - DNA, 224 bp, Homo sapiens
ggtgactctagcaggatcctttattgagacggggtctcaccatgttggtcagtgcgggctggaactcgtaatgtcagatgatccacctgcctcggctcctaaagtgctgggattacaggcatgagcgaccacgccatctttttttttttttttttaaacaaaacccagttttagaattagagcctcaaggggggggtgcagtggggctcacacctttaattccc

SEQ ID NO: 656843 - DNA, 901 bp, Homo sapiens
gggggggtcgcccaaagagaggcgcgccaaactgtgggccccggcaccgaacgggcgaaattttgggggacaaagaaccaggtaatggaccagtagtggggcggcgagcctatacccgggaaaaggcggtgttcccccccggcgaggaaaccataaggcgcccgcgcaagtagggtataacccatgggaccgccatctccaagctcccccgcaccacaaaggtggggtgcggccgcccccgaagttcatagacgcatgccagcggtcctccaaagccgctcgtagtgtgtgcagaacaacgcatggggtgcccagagtcaagacagcatgggcacgaaaggggggcctaccacactcgaaaaaaataatttcaaacgccccttgtcgcacacatcctgacagcaccaggaaggggcgttctgcgcacacacatacaggggggacaacctctgcgggtgatacccccctttttataagaaacacgatttttttttatcaaggaaacgtcacgacacacacgtcgttgttgtagacaatgagcgcgatcaagacaatacttagggccgggaaatcagggccctcgtcacccaaagcttgtcttgtggaagattcccgccgcatacgccgaaagcccgggtggctattatcccccaggtggctctgtgtcaccccagatggttcccgtcaaccaatgcggtcgcgtcggacaccacgaggaaacatatgttttctttcagtgttaacccgcatttttgctaataacgagtgctagtaacgccccactacaaatctttgctttcctgcgcgcacccgatttggcccgccagcacccgacctgccccagacctgccgaaactttgctccccaccaaacaaaataccacttccgtcccacaaacaaa

SEQ ID NO: 656844 - DNA, 197 bp, Homo sapiens
cgctgatgctctcacccacccctgaaccttcccatacttttccagcaacacaaagatatcaaccccaatgccaccttctggacaaagtgatgtggcagccactgttgtggggccaggccaggtaggccacgactgctcaccacgctgaactgggtcagggagaagagcagcagcaggaaggggtgggtggagagcgg

SEQ ID NO: 656845 - DNA, 245 bp, Homo sapiens
gttctgcctctgcctggggttttggcccccttggagaaaaacaggctcaaagtggggctggggcctggtgggtgaacctgagctctcccaggaggcaacttagctgccagtccccccctatgaggctcttttaccccgtgcctgcccctcggccagcatttcctatgctccctgggtcccccagacctctttgtgttgtgtgggtggcagcctccaggaattaaccttcttgttgtcctttgtta

SEQ ID NO: 656846 - DNA, 237 bp, Homo sapiens
gaaaggccaagggccatttaatttccctagcccccttaaaaagggagcccccaactactctttcaaaaaaaatcagccttaaaataaccagacataatatttgatatcctaacttgggccatgttttccaagaccagggcatatttttagacatcttttattcgcccagccatcggcatgacaggggtttttattagtattcccagtgggggctcaaagccaaacaaaaatatttta

SEQ ID NO: 656847 - DNA, 227 bp, Homo sapiens
gtgccaggtaatgtacacatgctgtaccccaaggaaggcaggagaaccgcattctgctctacgcgtgcgggaactgtgattaccagcagggggccgacaacagctgcatctatatcaacaagatcacgcacgatgtgaacgaactgacccagattatcgccgacgtgtcccaggcacccacgttgccgcggaccgaatacctaccaaatcaaggggtaccgagctcg

SEQ ID NO: 656848 - DNA, 167 bp, Homo sapiens
gtgaatggtgttgcatccctacccacatcagaaacacaacttaattcacaatggatgaacttccaaaatgtaagatctcacactatataactcttcagaagtacacataggcataaatctacctgcaccagggattagactgtgttttcttagattaataacaaaag

SEQ ID NO: 656849 - DNA, 303 bp, Homo sapiens
ggtcgaacggggatttgctgaagattttcattcccatgtggcagtagatatttcagaaccctgcatcatggtgtccacagaagtccccagagttgtatgagagttcatctgggcacctttcccaaaggcaggcccccagtgcagcttcaactattcactctatttataatgttgttcctggatatagggcttgcttccacttgtggccaggagaggatatttcttactccagatcaaagagttgagacattgccttcccacaattcccagtgagcccaactccttaccacaatccccggtcga

SEQ ID NO: 656850 - DNA, 172 bp, Homo sapiens
  misc_feature (87)..(87): n is a, c, g, or t
  misc_feature (108)..(108): n is a, c, g, or t
tagccggtccgaggttggcaaggggagtggtcatgagcttgccctcaggcctggcagaggaagtcgcttcacaataagatattccantgtcccagtactcaaccatgntccaggagaggccgctcagtgtcacttgcaggaacacaagccctggtgacctgccacaacctct

SEQ ID NO: 656851 - DNA, 697 bp, Homo sapiens
  misc_feature (99)..(99): n is a, c, g, or t
ggtttccttcacatctttggagtagttatgacttctcagtttttccccccttaaactgcattgcctgttctcttttcctgacatgttatcaggtatcangtgtgttgaatacatactgcttgtgtgtcaaaaaaacaaaaaaaggatttaaaattttggattagctgggcgcttgggggcttgtgcccattatgtcccagcttactcaggaggctgaaacaagggcggggtggctggagctcggggaggctcaagggctgcagtggagccataatcatcactggcactccagcccaggcaacagagcaagacccggtctcaagaaaaaacaaaatcttaaatctttggatttggggacgaaaccttaacccttttaaaagatagacattttgtggacattttttgcatggcccgtggttcggaaacacgggtttttttatcttaaacgatttttttcaccaacctcagttatttacaacttaactccggcggtggtaacaaattcgcgcagggaccttgaccggcaagaaacatttttttttttctaactacaggtgaccccggtttcaacctttcttaaccttaaaggtttccctttaacccacgaggcttttttccatagcctttaggagaacttttcaaaggccctagttgcaagctttggcagggcctctcttagcggtgcacccatatggtg

SEQ ID NO: 656852 - DNA, 758 bp, Homo sapiens
  misc_feature (7)..(7): n is a, c, g, or t
  misc_feature (61)..(61): n is a, c, g, or t
  misc_feature (63)..(63): n is a, c, g, or t
  misc_feature (70)..(70): n is a, c, g, or t
  misc_feature (84)..(84): n is a, c, g, or t
  misc_feature (94)..(94): n is a, c, g, or t
  misc_feature (100)..(100): n is a, c, g, or t
  misc_feature (112)..(114): n is a, c, g, or t
  misc_feature (118)..(119): n is a, c, g, or t
  misc_feature (121)..(122): n is a, c, g, or t
  misc_feature (129)..(129): n is a, c, g, or t
  misc_feature (131)..(131): n is a, c, g, or t
  misc_feature (135)..(136): n is a, c, g, or t
  misc_feature (183)..(183): n is a, c, g, or t
  misc_feature (200)..(200): n is a, c, g, or t
  misc_feature (230)..(230): n is a, c, g, or t
  misc_feature (281)..(281): n is a, c, g, or t
  misc_feature (365)..(365): n is a, c, g, or t
  misc_feature (426)..(426): n is a, c, g, or t
  misc_feature (444)..(444): n is a, c, g, or t
  misc_feature (475)..(475): n is a, c, g, or t
  misc_feature (513)..(514): n is a, c, g, or t
  misc_feature (528)..(528): n is a, c, g, or t
  misc_feature (542)..(542): n is a, c, g, or t
  misc_feature (563)..(563): n is a, c, g, or t
  misc_feature (608)..(608): n is a, c, g, or t
  misc_feature (615)..(615): n is a, c, g, or t
  misc_feature (657)..(657): n is a, c, g, or t
  misc_feature (664)..(664): n is a, c, g, or t
  misc_feature (674)..(674): n is a, c, g, or t
  misc_feature (681)..(681): n is a, c, g, or t
  misc_feature (697)..(697): n is a, c, g, or t
  misc_feature (752)..(752): n is a, c, g, or t
attaggntatcttatggaactgtattttatatccaactgtgaataacaggtaagttgaaancnaattgcnaagtttcatttatngtcatttttnaattcnattacccatttnnntccnncnnccaagcngnttcnncagactttctacttggggggaaaataataacactacaaacatatggnagggcttcgtacaagcntttcactcacagaggggtttatgttttcgnggatgtaggaaaagattttccaagtgtgaaaactaaatatatacaaaagcnatacattttgttattagttaaataaaatgtgtctttaaatatggaattctttgaaaaactcacttcatcgtccaaaattatggngactatttcacttttttaatcaaagatggaatattcatcacagttccccaagggattttcnaactggcctgggcaaggngttcacttgtagagtgtagttagtgaaaacntccagtggccaagcctcatcaataactgtatccaaaanntgacgctgcttggngtgtacccagaganaacaccaagctttcctggctncccggccctccctctccccattagtcttttgtgtgcatacataanttttgtntgaagtctcttggggtttagaagatcttgcactcattgttgnagaagancctccttctntttcttntcctggcctggttganggcagttcggacggtgcactcaaacacctgctgtactccccgattgctaatgtcngagcac

SEQ ID NO: 656853 - DNA, 195 bp, Homo sapiens
atgcctggtcgatgagcacactgatactgacaaattaccagacgcaatatctacagtcaaccagcaagtcattattaccgctcagtgtcaacccaactacaggcatgctcatcaaggaaaggttaaaaaaagtaagatggaactcggcaaatcttactccgcctgtgtaccagaaacatcatctctagcatcacc

SEQ ID NO: 656854 - DNA, 190 bp, Homo sapiens
tctctccacactggttttttcctagtgtccaagagctgtacctctttggactaacagttacatttacaaggggatttagagggttctgtagggcaccatttaaagtttgcactaacgattctatcttggaccaccagctatcaccaggctcggtagataaagtcgcctctacctataaatcttcccacta

SEQ ID NO: 656855 - DNA, 725 bp, Homo sapiens
  misc_feature (8)..(9): n is a, c, g, or t
  misc_feature (44)..(44): n is a, c, g, or t
gaaaaagnnaaaaaaaaaaaaaaaaaaagagaaaaaaagaaaanaaaaaaaaaactcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 656856 - DNA, 184 bp, Homo sapiens
tgggacttggggtctggttgagtaaactgaggtgatctcatagcccaagctggattgagaggccgctcttctagcgctcacttgtcctctggaaggtggtcagccagagcagcagcaagcacatcctcagtcaaagacatggcctgggccacctggactatgcggcggacaatgatgttaaagg

SEQ ID NO: 656857 - DNA, 1846 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcagaaaaaaaaaaaaaacaaatggccctctttggcctcagcggtggaagctctgccggccgctttccttacacgaggggtaaatacatgacacctcact

SEQ ID NO: 656858 - DNA, 256 bp, Homo sapiens
actaaccagaatatccaaggagctttaacaacaggtataggaaaaaaaaaatctaacaatctgcatcaaacaaggggtgaaagctttgaatatgcatttctcaaaagaaagatatcacaaatgtcaacacacacactatgcaaagggtgaaacaggtgctcaaccatcattgacccatcagcagaactgcaaaccacaacctcaaaatgagcatagatatcatctacaacccccggcaagtatgtagtcagtatca

SEQ ID NO: 656859 - DNA, 1847 bp, Homo sapiens
  misc_feature (17)..(17): n is a, c, g, or t
  misc_feature (30)..(30): n is a, c, g, or t
  misc_feature (37)..(37): n is a, c, g, or t
  misc_feature (1755)..(1755): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcagaaaanacaaaaaaaaaatggccccgcttggccctagcagtggaactacgcgcccgttccctgtgcagggggcgaatacccgcacttctctccctgct

SEQ ID NO: 656860 - DNA, 308 bp, Homo sapiens
gggcgaaatctgcaagtgtgtctgtaagacttcaactgcctgggctgggcgtggtggctcacgcagtgagtcccagcactttgggaggccgaggcaggcggatcacctgaggtcaggagtttgagaccagcctgaccaacatggaggaaccctgtctctgctagaaatactgaaaattagccaggcgtggtggcggcaacctgtaatctcagctactcaggaggccgaggcaggagaatcgcttgaacccgggatgcggaggttgcagtgagccgagatcatgccattgtattccagcctgggtgaca

SEQ ID NO: 656861 - DNA, 1821 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcagacaaaaaaaaaaaatggtctcttgtggcccacccgtggaaatatacggaccgtatccctttaaaggaggcg

SEQ ID NO: 656862 - DNA, 1855 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggctgacttctgggcctcatctccttaggggctggaaagccttcaagatcagtgccagcatccaaggaaatgctcttcctcatgtcagctcccctccagagccaaaagaagactactgtctcttcctgtttcaaaacgcttcatacccctaatgggcctcttatccacttatagtactctggatactggacactccattttttattttccaaccttcccctctacccccaacacataatatcctaatctttgtgaccatgcagttccctccacctggcatattcacattaaatgcacgtcttttctatgaaaacacaactactggcctccctggtcctaacccccgacctttccccccacttacctctactgagggccaatcgactgatccctggtcactgacctcgttcacctctgtcattacgacgcagcgcatcccattccccaaccccgttgttggttcccgctttcccccacaaccttacgataaccctatatcccccccaccaccagtacgttaacacaccccccccccctactctaggtacggctcagccgctttgatatataccgcgccgcccctcgcaggagcccaatatatcctctcacttcgtccaccccccca

SEQ ID NO: 656863 - DNA, 1539 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggctgacttctgggcctcatctccttaggggctggaaagccttcaagatcagtgccagcatccaaggaaatgctcttcctcatgtcagctcccctccagagccaaaagaagactactgtctcttcctgtttcaaaacgcttcatacccctaatgggcctcttatccacttatagtactctggatactggacactccattttttattttccaaccttcccctctacccccaacacataatatcctaatctttgtgaccatgcagttccctccacctggcatattcacattaaatgcacgtcttttctatg

SEQ ID NO: 656864 - DNA, 244 bp, Homo sapiens
aaatagctggagataaaccctgtaccattccatatatatgagaccttaaggcaaaaggcagaggctgatcagaacgacaagtctgtgaagggatcttggtcatcttgctttattgaaacttgcgctccatgtacttcttggcttcagtacttgaagatccccatgacacatagctaacagtgatctaccaggatgatcaatacttggtcttgggtatttgatgacagatatgaccctacttgct

SEQ ID NO: 656865 - DNA, 570 bp, Homo sapiens
atgtatcggttaatattatttcacatgtcacttccccagggccgcggtgcgttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 656866 - DNA, 394 bp, Homo sapiens
gacctcaaagactttagggaggggggtcctttttataaaaatggttttttgggaaaagcagattcaaaaataaaactttttccccggtttcctcccaaatttttccttttcccaaggaaaggttcaaagttttttcccgaaacccccccttgaggggcaaaaggtggggttttttttttgaattttttttgcccccaagtaggggccctttaaaaaaaaatgcgggggtttaaattaaaaagcggtaagtcggcatcccgtttttgttggcccccaaaaaattttggcccaaactgggggccttttggatttcgggggttccaaactttttttgggggtcccctaacagttggaaatatgggccctttggtttttttttgttccccccccccca

SEQ ID NO: 656867 - DNA, 322 bp, Homo sapiens
catgaaagtggatagaggcctacggtttataagttagagtagatagacagctccatgattaccttccagatggccctgcagcccctctatcccccagctattagaccgctactcccagtggggcaggaggagcttccattgccatctggagaccctggcagggacttgcccatccgatccacacaccagcagggacctcggagctgcccctgggaggagcggcactgccgcttccggtagcagcctcgatggtcacaattgggcacgtagagtgtttgagcccctcggtagacctctggactcagtgctgcagcaactccag

SEQ ID NO: 656868 - DNA, 1265 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaaagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggctgacttctgggcctcatctccttaggggctggaaagccttcaagatcagtgccagcatccaaggaaatgctcttcctcatgtcagctcccctccagagccaaaagaagactactgtctcttcctgtttcaaaacgcttcatacccctaatgggcctcttatccacttatagtactctggatactggacactccattttttattttccaaccttcccctctacccccaacacataatatcctaatctttgtgaccatgcagttccctccacctggcatattcacattaaatgcacgtcttttctatgaaaacacaactactggcctccctggtcctaacccccgacctttccccccacttacctctactgagggccaatcgactgatccctggtcactgacctcgttcacctctgtcattacgacgcagcgcatcccattccccaaccccgttgttggttcccgctttcccccacaaccttacgataaccctatatcccccccaccaccagtacgttaacacaccccccccccctactctaggtacggctcagccgctttgatatataccgcgccgcccctcgcaggagcccaatatatcctctcacttcgtccaccccccca

SEQ ID NO: 656869 - DNA, 949 bp, Homo sapiens
  misc_feature (17)..(17): n is a, c, g, or t
  misc_feature (30)..(30): n is a, c, g, or t
  misc_feature (37)..(37): n is a, c, g, or t
gcggccgccgagccagngccccgcgggggnaacagangaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaaagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggctgacttctgggcctcatctccttaggggctggaaagccttcaagatcagtgccagcatccaaggaaatgctcttcctcatgtcagctcccctccagagccaaaagaagactactgtctcttcctgtttcaaaacgcttcatacccctaatgggcctcttatccacttatagtactctggatactggacactccattttttattttccaaccttcccctctacccccaacacataatatcctaatctttgtgaccatgcagttccctccacctggcatattcacattaaatgcacgtcttttctatg

SEQ ID NO: 656870 - DNA, 1532 bp, Homo sapiens
caacccaccaaaaatagatagcctctaccccctaccagccctagccgagctggtacctaggccccgcctagtgccgcgagacactatagaaagcaggtggacccaaaaacagcacggatgggtaacgaggacggcacagatgccgaggcataactaggcagcgacaacactacacgggaccaagcaagaaaaaagaaaggctgagaaacagcagcaaagacaagagaacaccaccggagcggaaagcacataaagacaggcgcgcacatacacaagaaaaatacaaaaaagaataaaaacaaaagacaacaaacaacaaaaacaacaagcaacaaaagaaaagacaaaacaaaaaaaaaacaaaaccacagacagaaaaagacacagacaaccaaacaacacaaaccagacacgcacaaccacaacccaaacacccaaaagaaccacacacgcaccaccaaccaaaagaacgaacacaacaacaacacacagaacaccacaacacacaaacgcaaacaacaaaaccagaacacgcacacagcagaagaaacacaacaaaaaaaacaaacacaaaaagaagacacagaagaacaaacagagaaaaaaaaaacaagaagcggaacaaacaaaaaacacacaaaacaaaaaacagaaacaaaagaaaaacagaagaaaaaacaaaaaacaaatgaacaaaagaacaacaaacaaagaaaaaacaaacaaagaaagagacaggagagcaaggccgagaaccaagagagaacaacaagaaagagcaaaccaagaaacagaggaggccaccgaggcgacagcaccgaaacacgagacagacacgaaaaagaaagaacaaaccaacagccacacacacaaacagaaacaccaagacaagacacacaaagaaacaacacacacaaaagaaaaccaaaaacagaacaaacagaagaaagcacaacgcacggacaagacaaagagcataacaacaacggaacaaaacacaccaaacaaaaaaccaaaacccaaaaacaacagaccaaacaacacaaaaaaaacaagaagaaacaaagaaagcaacaacgagagcgaaaacccacagaaaaaacaaacaaccacacacaaacgagcaaaagcggaaaacaaaacaaagacggcagagagacacaacacaacagaaaaacaaaaaacacaacaacaaaaaaagaaaaacaaacaaaaaaagacgaaaacaaaagaagagcaggacaaccacagagaacacagccgaagaagcgagagaaaaagagaagaaaagaaaagcagagaaacgaaacacacaaaaaagaaaaagaagacacacaccacagaagcacacaagcaccaacaccaccaaaacacacgccaacacacacacacacgacctacacacgcaacaaccagaacacaacaaactcgagagaccaacaacaaacacagagacacaccacgcacgaacaacgacacagaacaaagagtagcaggcaaacgaagcgagagcaacaaacacgagagcaacc

SEQ ID NO: 656871 - DNA, 361 bp, Homo sapiens
agacactggccaacatggtgaaaccctgtctctactaaaaatacaaataaaaattagctgggaatcatggtgcacgcctgtagtcccacctactcgggaagctgaggcaggagaatctcttgaacacaggagttttaggttatggtgagctatgatcgtgccactggactccagcctggatgacagagtgagacccgactccttaaaaaaaaaaaaaaaaaaagcacatctcagttcaaactactaattattccaggtgccaaaggccacaatgtggtaagtggctgctgtatggcataggacagatctaaaccaatgatcattgtgaattaagattcctgtaatggtctctatgacgtat

SEQ ID NO: 656872 - DNA, 82 bp, Homo sapiens
gtgaaccctcttgcacacttgcttttgcacacgcgccccccccccccagcattttcagtgctctccggaagccttgtttctc

SEQ ID NO: 656873 - DNA, 895 bp, Homo sapiens
  misc_feature (83)..(83): n is a, c, g, or t
  misc_feature (165)..(165): n is a, c, g, or t
  misc_feature (282)..(282): n is a, c, g, or t
  misc_feature (375)..(375): n is a, c, g, or t
  misc_feature (381)..(381): n is a, c, g, or t
  misc_feature (415)..(415): n is a, c, g, or t
  misc_feature (432)..(432): n is a, c, g, or t
  misc_feature (453)..(453): n is a, c, g, or t
  misc_feature (511)..(511): n is a, c, g, or t
  misc_feature (516)..(516): n is a, c, g, or t
  misc_feature (532)..(532): n is a, c, g, or t
  misc_feature (543)..(543): n is a, c, g, or t
  misc_feature (570)..(570): n is a, c, g, or t
  misc_feature (794)..(794): n is a, c, g, or t
  misc_feature (812)..(812): n is a, c, g, or t
  misc_feature (872)..(872): n is a, c, g, or t
tcggccggaaccccccctcccccggcgcctcaagcggaagaccattcctcaagaattttgtatccaaggcccaaaagtttgtnacccaagatgatgaatgccgacatggatgcagttgatgctgaaaatcaagtggaactggaggaaaaaacaagacttattaancaagtgttggaactccaacacacacttgaagaactctctgcaagagtagatgcagtaaaggaagaaaaactgaagcaaaaaacagaaaaccaagttcttggacaaaaaaaagaaaancccatgtcagcttcaagggtataacaaacaacagacacaaaaagcaaaagaaagtaagggaatgacacccttctgttttaaggaaatgctgcngaacantttttctttaaaacttggaaagaatccaaaaganacagaacctttggggcnacaaagaaaatttaggaaganaaagtcagaagtagacaaaaaaaacacaaaaacaggagacatccaaaagtgtgggganaaagnaaggcaaagaaaacgngcaaaagaaangaagagacattaagaatagaattgcanaaatttaagaaactaaaagaagaaagtattaatgaaatagaaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattngtgtcacatttgtaaaantaattttaatagttaatcatctctgagagtaacctgtatttttaattgttgaaacttaancaaaataagatactgtctcagct

SEQ ID NO: 656874 - DNA, 169 bp, Homo sapiens
  misc_feature (79)..(81): n is a, c, g, or t
  misc_feature (132)..(132): n is a, c, g, or t
agtcggtccctgtttctgcgcttctgcttcctgcttctgccgcttcgcttcctgcttctgccgcttcctgcttcctgcnnntgccgcttcctgcttctgccgcttcctgcttctgcttcctgcttctgccanccacgtaagatgtgacttgctcctccttaccttccac

SEQ ID NO: 656875 - DNA, 1792 bp, Homo sapiens
  misc_feature (1365)..(1365): n is a, c, g, or t
gagggttcaccggcatactggagtctctagagcggccatcgcactccctcactactcaacgacacacctcctgcaccgagtggttccgaacggaacagagctatccagaaatggctatgccaggacatctatcacatttccagctgtgagcaattaaggggagtgggtaggacgtagatccgtggactgacctagctgacacatacatgtgacaggaaagctaatagtacacgtagcacgtctgccggaaggacaacgaacgtatcatggagcgcaccatgcatatgacgaaagagaccatatagccaaggctacagataggacaagactaacagagagaccccaagatacagagggaagagccagacaacacaatccaagaaacggcgacaatatatagcacagagaacatatccaacaaggggacaggagagggaatatacgaagagagaatgagatataccagcaaggcataggcagagcaaaagggcgatcaccacaaagagtgaacaccgtacaataacaccgatgaatgttcaagtctcatacaacaggggccagccctaggagaaagaagacgaagacaggacatatcccaccaatagagtagggagaggcatggacatcccccctaaataaaggaaaccaagatacaaacacacaaggaaggcattatccatcaaggacaccaatgtagggaacggggaccacacaatcgacacaattataatccacaatcagaaaaaaggataatgcgactagaaaaatgagtgcaaccaatatgcaccaatataagctacattgtaatagcacaccagaaggtcagtacacccaaaagacacaaggagtgattgacagagatatgaaccaccagaaagcggacacgcacgagaaatagggaaatgcaggaccccatatgatagaactcccacgtgaacaactaggcacgatgatacacaacacacccaacaataagagtgtgaacccgaaaagaagagagcagaacaagaatggtgacaaccagtgcgaaacacagcaccacccattaggaagcataggaccgcaaaaacacagagcggaaatatgcaccacatcccaaaggaataagacatgtgagatgaaactaccaacgcagaataggaaccaacgcagccacaattaagtgtaacacgacctgagcgagaaaaaccaaacggaacacatacacaggagacgatataaacataacaactagaagaaatcagagaaagccgatgtagaacaaactagtatacacttgtgaggtagtaatagcttacagatgtaatccagcagacgtagaaacacaaataacacatattagcgtacgagaagaggatataatcnagccgcacacaggtagacaattgaagagagacaaataccgttgcactaagaccttcgacaagacaaccctggaaggtagaccagacatcaacaaaagaacgagccagggcaacccaaacaatacaccgacaacaaagattgggataacaaaaccacagaacagcacatcactaaacacaacaaagggcaacacccatggagagagaagacgggagatgaacaccacacagacaagcataggagagagcaaatgcaacagctaagaaacaatacccgacagaaagaccaagacaaacatatcagtagggagtatgtagacacagccaacgaacaatcaagcacaagaaaacacgtggagatggtgaaatggagagaaaaggaagaaatgaagacacgcgaactaaaacgtaacaagagtgagcaacgc

SEQ ID NO: 656876 - DNA, 153 bp, Homo sapiens
  misc_feature (116)..(116): n is a, c, g, or t
ccttctaccagcctgatagatgggcagaagcaggaagcagcagaagcaggaagggcagaagcaggaagcgcttcctgcttctgccgcttcctgcttctgcttcctgcttctgccanccacgtaagatgtgacttgctcctccttaccttccac

SEQ ID NO: 656877 - DNA, 1251 bp, Homo sapiens
  misc_feature (322)..(322): n is a, c, g, or t
  misc_feature (631)..(631): n is a, c, g, or t
  misc_feature (654)..(654): n is a, c, g, or t
agcggggcagaacggtcggccaggacgctagacttgcgggacttgcaggggatcaggcgaggaatcgtccgtggccgctatcgcgttgttctccagggctggattcgcgacgtgtgaacgagagtggtagtttcgcgaaggagttggcctggttgactcgagacgcagagatacctacttctccgtacatgtcgtctgcgcactgtactgcaaccatggtttgactcctgtgcggtcggactggctcaccctggactctcattattgagttgaccgacgactctcggtcaagacattatcagacgtgataaggagtccacanttgctctagtgggactttgccatcaacgagtcgcggaatcgcgcggcatggaacttgtcggggaatacgtcaagcctccgcgagatcggaagaggtgctaaagatgctgcacttgactacctatgattcgcgtgtcggtccgtacgaatcgggtacacatatcaagtatcatgtctttgtcgtgccatgaaatagccaccacggaattgcactgtgggcattcgggcgcctggggatagacttttgaccgaacctcccaaagtagtttcgttaaggagggaagacacgatgcggtacttgttgtggcgntctagcgatgatccatcgacgcngaagtcgaagacctggtcactcgtggggcttctcacgatccagaccatcgcgactcggattacccatctggggcccttactgccatgctagctctgggccacccatgaaggccaggggcattctaacttgggacttaacttgggaggcgccacttcacggagcgttgagctttggctgtttacgcctgtcccgatgggaagagataccaaaagagctcgcggtaccgttacctgtgccataggcaggactacttgtgcggccaacgggggcggctaagtggtcgctgttgacctcccggtaaacacacagtcgttcatgcccaccaagtgtgatgatgcgcgacggcaaagcaaacggccgagattaccgcgttcacgatttcggtaaacctatgcggcgtcactactctttacggcagaaaccatctggcaccacaggtgcatttccgccgaagcaggtcagcacaccttttgtctacctggaggggacacatgacccaaagcgcccctgtgtgctttaggacaccgcacaatgattgccacttcccacatttaccgtgacggcaaagaccgggcgttaattgccagaagggacct

SEQ ID NO: 656878 - DNA, 840 bp, Homo sapiens
tcaatctgtggcttccaccaggaggtcttcctagtgcaatggacctgggtggcttatgatgagtgacgcggagccgcgtgcggagcctggagtgaagctgatgtgtcatcttttcctaatggtgtgatgtgaacactgacctgtcaagatcatgtgccaatggatgatgcagctgcatgtgatctatggagaatgacgtgcctgagcacttccagtgaggccatggagtggcgagccatgaaacaacattctccgcgcccgctgtgaccacctcatcaagcggacgagctcgtcatcgtctgttcttgacgaactatctatcagcacgtggaacctggctgggcagaagttaacagtgccactagcgaccacattgaccgttgcccgaacgaccaatcagggcctccgacccgacgagaatctcaaccggatgacaccgatggaaccccccatgggaaaagtcctgggtattgtagaccctcgataactggacccctgcatgtggtaaccacgcggccggcaacaagagccacccctcatgccaagaaaccttgtcttggcttgaacctggggaggccgaaggacgttacccttggtccggttcacttcacaagcgcccctggatgacaaccatgaacctgaggtggaactcgctacacgtcggtaccactgggtgaaatccggacgatcctgtcccaggtgaccctttgcgaacaaggtgaacaggctgaaccaacgccagggcgttactcctagttagccccacgaagtttcattcttcccacattagacccccggtaggagacacccagcttggcaacgaacaccgatggcatgggc

SEQ ID NO: 656879 - DNA, 193 bp, Homo sapiens
gcacccggctgtttgcgggcacttagggttcaaggttttgagttccgccccttaggggcgggatccgcctagtcatgtctgaaatttcacattacctatcagcgatggtcgctgatggatcgctcatggtctcgccctcgttgaattccgcgcgcacgctggtgctggacgtcgccaattcctcggggctgga

SEQ ID NO: 656880 - DNA, 160 bp, Homo sapiens
cacagtggctcacatttgtaatcccagcaattttttggggaatgccatgtggccggattgcctgagctcacgagttcaagaccagcctgggcatcatggcaaaaacccatctctactaaaaatacaaaagacagccaggtgtgttgctgcacacctatgg

SEQ ID NO: 656881 - DNA, 436 bp, Homo sapiens
atctagatagctatgttaaggacacttaaataaactcaagctaacacagagaaggaattcagaattctatcgagcataatttaacaaagagattgaaataataaaaaagaacctagcagaaattctggagttgaaaatgcagttgaaagactgaagaatgtgtgttttttaatagctgaattgatcaagaagaagaaagaattggtgagcttcaagacaagctatttataagagacaaaataatatagaatgaagcatgcctagaagactctagaaaaatgcctcaaaagggcaaatctaagagttattgaccataaagaagtggtagagagaagtagaggtagaaagttttttcaaaaggaaagtaacagagaacttctgagacctagagagagatatcaatatctataactttctaagaaagttatggaactcc

SEQ ID NO: 656882 - DNA, 115 bp, Homo sapiens
tgctcgtcgttagaggacccccacacagtcacatgtctataacatatcaaaacaatagctggacatggcgattaatctgtacaaaaaggctttataaaaatactcccggccgggc

SEQ ID NO: 656883 - DNA, 632 bp, Homo sapiens
  misc_feature (36)..(36): n is a, c, g, or t
  misc_feature (74)..(75): n is a, c, g, or t
  misc_feature (156)..(156): n is a, c, g, or t
  misc_feature (626)..(626): n is a, c, g, or t
ggaggcagagtgagaatggatgggtgtgtgggaggnaggcagggggtgacgtgggagagctgggaggagggggnnaagagagtggaggaggttggtggtcagagtggatgtgagggatgggggtgggtgggagggggttgggcatgggccctgagnaagccctgtggaggaaagagcagagtgaggtcagaatggggggagagagggaaggagtggtagagtgagggggaagggagagggaggggggggtggagagtggaggggaggagggagcattaggtgtggggaggagggaggtgagggggagaggatgtggaaagaggagtgagggggagaggagggagggaggagatgggtgtgcgaggggaggtgaggggagaagggggcttgggagggggtttagagggtaggttggggggagtaggtgaggagggggaggaggagggcatggtggagggaaaggtatgggaaaaagtgggggtgggtgttggtgaggtgaggttgagtggtaaaagtgagggggtggggtgaagcttgagagccggaagctgttccaggaggagggaggggcctcggtttctcccggggcatgtgggcaggaaggccctcgggatcccgcatcagtnccacgg

SEQ ID NO: 656884 - DNA, 350 bp, Homo sapiens
  misc_feature (20)..(20): n is a, c, g, or t
  misc_feature (75)..(75): n is a, c, g, or t
  misc_feature (78)..(78): n is a, c, g, or t
ccccaaaaaaaccttttttntcccttttttcccccccccccaaccccaggggggggggggggggccccggggacncanggggtttttccccggggggtttttccccgcggtttggttgatttttttgccccggcaattttaaacccgggggggttttttttgggtttccccttttaagggggccccttgggggttccccaaaggggggcacccttttttttggggggggtttttttggggggggggcccccattttttaagggggggggtttgggggccgggggggaggccccccctttttttttttgggggggctttttttttttttaggggggcccccgggggcccca

SEQ ID NO: 656885 - DNA, 280 bp, Homo sapiens
tgtatatatagtatacatgaagcagattaaataatttgtgttaaaaagttttattattaccttgtagggctttgatgggggaattgggcttattggaagatatattacagtggaaggggctggtaagggactcttttctcctgggggatgctgaataaactgaattgtgcatctagccttttgactgtgacatatcacatgagggacaggtttgtggaattttccattcatagtgtcatgttggcactcatatttttcatcttatatttctagttgacct

SEQ ID NO: 656886 - DNA, 197 bp, Homo sapiens
acaggaaaattacatcaggatgctagggggaacaggattgctggcatgaattttaattgaattttgacggggcaagctacgttacattatggcagaaaaaaaagtgcaactgacatgctacaaagagattttttaagtttaaaaaaagttgggatcttttggatttcttttttttttttggggtaacttggacgcgt

SEQ ID NO: 656887 - DNA, 1095 bp, Homo sapiens
  misc_feature (162)..(162): n is a, c, g, or t
  misc_feature (274)..(274): n is a, c, g, or t
gtgtggaactgcctaagataaagaagcggagactggagtaagcaaggctccagtatggaacgctggtggtgcctagactctcacaaactaagatgtgggacgatagcgcctaggagagcgattgtctacttggggcttcttctagtcgttcgcgtcctcatntcggagagacgcgattgcacagacgatgccgatggatctcgatagagctcggtatcatgttaaagcggaacccacctagggccatggaccgctatttgatgaggaatctaangcaattcggagtgcctaaaatcctccatgtggagatgctagatgactggatgttgttagccatctatatcttaactagaagctccatgcttcgaataactcatgttacaaaatagcgttgctaggagccaatcgatagatccttacggaaaaaagatttctttggctagactatttcaaaattctgtaaagatacgagatatagggagataaataccgaatatgtatatttttctcttattaactttgtgctaagggtttataatcctacatctaatagggataggttcttcggtatcttgacggtttatttaaacagtattaccaatttttcattttatttataggattgaagattgttacatgggtagggctaaagaaacgtcttagtaattttttcacatagattggtagttttgaaaggcaacacgagaagaggaacgatttaactttaaaaaggcgatggtaactgggtttactggagaatccttgccttttttcttatcctttgggtggatttaggacttacacttaaggaacttggaatcggtgttcactatacttatttaattacggtgtagaactcactggaaattggttcggagctcacaggataaccttatctggaataacgtagctggtgccgagtttcacataataggggtaaattggacacctttgtttttataacccctttttttcctccttaggagtctgttggtatcttcacccgatcttattgttggcgtttaaacacactaatgtgaaaaggagcacgcgaatttttaagttgggactctcaagacggtttaaattgagttg

SEQ ID NO: 656888 - DNA, 360 bp, Homo sapiens
  misc_feature (279)..(279): n is a, c, g, or t
atccaagacacacccttaagcatgtccctttcatctctgacatggccattctaaagtctctctcgaacagaatccatctcacagagtattcgcttaacccagagtctcataagctttatgagttatgataaaaagagtgtccctcattccaaatccagggagttcccatagataagccctcctttgcgtggctcatattcacaccagtttgtgattgtgtcttcttcgctgccttctacgggaagttttttaaaagtatatccaagtgtgtttcctaanaatgggcacccactacatggtgaagaggcactgtctgaagagcgcagaggtttcactatagacatatgctctcgcgtgccg

SEQ ID NO: 656889 - DNA, 355 bp, Homo sapiens
  misc_feature (303)..(303): n is a, c, g, or t
ggctgcgctttcctgtccccaagccgttctagacgcggagtctcgctcttgttgcccaggccggagtgctgtggtgcgatcttggctcactgcctgcaacctccgcctcccgggttcaagcaattctcctgcctcagcctcctgagtagctgggattacagtcatatgccaccatgcccggctaatttttgtatttttagtctagacagggtctcaccatgttggccaggctggtcttgaactccctacctcaggtgatccacctgcctcggcctcccaaagtgctgggattacaggcgtganacgcgcacacagccgacaattctaatattattgccgagcttgttttcttgtc

SEQ ID NO: 656890 - DNA, 161 bp, Homo sapiens
cccacaccacatattgagaaaactagaagagaatgaacttggccagaggagaatgaaatgtgcttgatataggcatgaagcatgcacgctcgccattaagtagatcgggaaacacactagtgtcctatcgttgacatgaacacagggtatctactagttgt

SEQ ID NO: 656891 - DNA, 369 bp, Homo sapiens
tgctgactatttctagcatctcataacgtaatggttgtagtgttttgtctttagtctccggatatttaaaaaatttctttgtaatattctttgacccataggtatgggtaagagtaagttttaacatttccacatgtgtggatattctatgtttccttctgttattggtgtttagtttcctttccatgtgcataagcgcacgcatagttggtcatgcatttccagtcttcaatttcattcagcataagtaaagtgcactaaccttttatcatcattttccatgtgtttctgcaacttatcggcagtaaattctgcaagcacttttctgcaattgtccgtgtttcagttttctcaaacatcatgtccata

SEQ ID NO: 656892 - DNA, 924 bp, Homo sapiens
  misc_feature (47)..(47): n is a, c, g, or t
  misc_feature (67)..(67): n is a, c, g, or t
  misc_feature (84)..(84): n is a, c, g, or t
  misc_feature (103)..(103): n is a, c, g, or t
  misc_feature (105)..(105): n is a, c, g, or t
  misc_feature (108)..(108): n is a, c, g, or t
  misc_feature (110)..(110): n is a, c, g, or t
  misc_feature (122)..(122): n is a, c, g, or t
  misc_feature (124)..(124): n is a, c, g, or t
  misc_feature (136)..(136): n is a, c, g, or t
  misc_feature (147)..(147): n is a, c, g, or t
  misc_feature (156)..(156): n is a, c, g, or t
  misc_feature (162)..(162): n is a, c, g, or t
  misc_feature (177)..(177): n is a, c, g, or t
  misc_feature (183)..(183): n is a, c, g, or t
  misc_feature (192)..(192): n is a, c, g, or t
  misc_feature (198)..(198): n is a, c, g, or t
  misc_feature (217)..(217): n is a, c, g, or t
  misc_feature (228)..(228): n is a, c, g, or t
  misc_feature (240)..(240): n is a, c, g, or t
  misc_feature (242)..(242): n is a, c, g, or t
  misc_feature (248)..(248): n is a, c, g, or t
  misc_feature (287)..(287): n is a, c, g, or t
  misc_feature (293)..(293): n is a, c, g, or t
  misc_feature (311)..(311): n is a, c, g, or t
  misc_feature (318)..(318): n is a, c, g, or t
  misc_feature (325)..(325): n is a, c, g, or t
  misc_feature (339)..(339): n is a, c, g, or t
  misc_feature (355)..(355): n is a, c, g, or t
  misc_feature (361)..(361): n is a, c, g, or t
  misc_feature (367)..(367): n is a, c, g, or t
  misc_feature (373)..(373): n is a, c, g, or t
  misc_feature (376)..(376): n is a, c, g, or t
  misc_feature (379)..(380): n is a, c, g, or t
  misc_feature (382)..(382): n is a, c, g, or t
  misc_feature (384)..(384): n is a, c, g, or t
  misc_feature (389)..(389): n is a, c, g, or t
  misc_feature (391)..(392): n is a, c, g, or t
  misc_feature (395)..(397): n is a, c, g, or t
  misc_feature (400)..(400): n is a, c, g, or t
  misc_feature (408)..(408): n is a, c, g, or t
  misc_feature (411)..(411): n is a, c, g, or t
  misc_feature (415)..(415): n is a, c, g, or t
  misc_feature (418)..(418): n is a, c, g, or t
  misc_feature (422)..(422): n is a, c, g, or t
  misc_feature (427)..(427): n is a, c, g, or t
  misc_feature (445)..(445): n is a, c, g, or t
  misc_feature (447)..(447): n is a, c, g, or t
  misc_feature (458)..(458): n is a, c, g, or t
  misc_feature (475)..(475): n is a, c, g, or t
  misc_feature (478)..(478): n is a, c, g, or t
  misc_feature (480)..(480): n is a, c, g, or t
  misc_feature (509)..(510): n is a, c, g, or t
  misc_feature (513)..(513): n is a, c, g, or t
  misc_feature (756)..(756): n is a, c, g, or t
  misc_feature (807)..(807): n is a, c, g, or t
aatcctattctgaaagacaaattttcatttaaaaacaaagcaaaaanaaaaattcacaaccttaatnacctaaatttgtcattnaaaggtttaaaaaaaaaangnagnanctttcttacaancnttttcacaagtntcacattttcnccttaaaangaaagnatttcaaaaaaaagnagaaanaacttaaanaaaaanattcataaaaaaaaacttnacaaaattganaacaatattaananaaaatnaactaaccagtttcacccccccatccccccccgcccccncccccnccccctcccccccccctngcccccnctttgcnttcagccagagatncttcagaatcccagtnaaatgnattgtnctaaanccncgnnangnatctncnntgnnntcnccccattngtntttngtnattntctancccagtttctaatctctnanaggggctaaanctgtgaggggggaaggnccntnccctagtgtggccaccctatatataattnnatnttgtatcgttaattgctggcctttcttctgcaaattatgattttggaaaatccaacccatgcagagggataaaaaactgacatcccttgggtaacttttttttttgcaacattccaagccccccccggtcccctatccaaggacaaatgtagggcctctaggatgtcccagacccacctcggagggccagtcagttcaggtaggtcaggcccagttctcttccctcccgacagaccccgggcncgggaagcaccgaagaccatgatgctggctggagtgaagacactcgtttcngtatcaagagctgagcctaagaaatgctcatcgtttggtcaggctgggtctgcaggccggctgcttgctgcactcctggaaagccagggcccatcttctcggactctgcagtctctt

SEQ ID NO: 656893 - DNA, 221 bp, Homo sapiens
cgggggggggggtaacccaatttctctttcccccctccccttgggggaaggggcccccctgggtttggccccccaatgggggtggtgcccccccctcccctttgtccccggttttggggcagggcccccctgttttttccccggtacctctcccctttttgtttttccccttcgggcttttgggggggggtcccccttaacctgttgttccccctcgccta

SEQ ID NO: 656894 - DNA, 100 bp, Homo sapiens
ccgcttcaccaccccatctgcattattaatacatcactagtttggaaaaataaaacttttttaaaaagaaaacatgattaccggggtgggtggagagcgg

SEQ ID NO: 656895 - DNA, 236 bp, Homo sapiens
tcaacaaatttcgggttaaggatgccccagacccagggctttacccttgtatgcgggcaggcccagggagcaggcaccagtgtttttcccctcagagtgacttggggagggagaaatagggggaggcgtccagctttgtccttttttcctccctcctcccttcagggtcctggggaccaggcctttttccccattgttttgttttgcccccttttgccttaaaaggaaaatcccca

SEQ ID NO: 656896 - DNA, 188 bp, Homo sapiens
  misc_feature (99)..(99): n is a, c, g, or t
tattagtagttggaaaaattaactggacagaaaaaaagtttagtcagctggagagagagagactgagtgacccatgagactggtggctcctctgggagnaactggatacagtgaggagaaagagcactgtgaattagagcagacgctagtcagtaacgtatgcatctcaagctatgctagctgacatc

SEQ ID NO: 656897 - DNA, 435 bp, Homo sapiens
  misc_feature (313)..(313): n is a, c, g, or t
  misc_feature (317)..(317): n is a, c, g, or t
tgccctttactacaggacagaaaccacttagtttttaataagtggctcagtattacaattgcagcgatgcctggcaaattgaagttgcaagcctttgtcttactctttcagtcaggacctatttcagactgttgatgacattgacatttcatggattcggatgatgcaaggagacacatgccaccccagcagtacacaaagcacttaccttgactggtgaagtcagccagccatctcagcagggaagaacaaccttctcaaccaaaactgcaatcaggaaagcagcagcccactccttcccatggaatctagnaaancccaaaaggggggccaaaatttttttttttgaaaaattttggcccctggtgggggaatctcacactggctactgaatggacgctttgtattcatgagatggcttccaggcaaggaagt

SEQ ID NO: 656898 - DNA, 111 bp, Homo sapiens
agcagcctaaaataggcctcaggtgtgcatcacactgcatcatgcagggcatgcaggcacagcaggccaggttccaaggttttggctccccatgcattccaacacatgtgc

SEQ ID NO: 656899 - DNA, 422 bp, Homo sapiens
  misc_feature (13)..(13): n is a, c, g, or t
  misc_feature (36)..(36): n is a, c, g, or t
ccctaaaaaatcnagtgttaccccaaaacttgaccnatgcttgcccccaagctgtgccttttttcctttcccttggggtattttggttggctaaaagtattttaattaattactgttttaagagacagggcctcactccctgtcaccccaggctggagtatggtggcacagtcacatctcactgcagcctcaacctccctggctcaagccatccccccaccccagcctcctgagtagctgggactacaggcacacatcactgcgcccagctaatttttaaaaaatttttgtggagacaggttctcttcatgttgcccaggatggtcttgaattcctgggctcaagcagtcctcctgtctcagcctcccaaagtgccagaattgcagcatgagcctgggtgctagagcgaggcccttttctca

SEQ ID NO: 656900 - DNA, 398 bp, Homo sapiens
  misc_feature (196)..(197): n is a, c, g, or t
  misc_feature (203)..(203): n is a, c, g, or t
  misc_feature (205)..(205): n is a, c, g, or t
  misc_feature (208)..(208): n is a, c, g, or t
  misc_feature (223)..(223): n is a, c, g, or t
  misc_feature (227)..(227): n is a, c, g, or t
  misc_feature (232)..(232): n is a, c, g, or t
  misc_feature (235)..(235): n is a, c, g, or t
  misc_feature (254)..(254): n is a, c, g, or t
  misc_feature (270)..(270): n is a, c, g, or t
  misc_feature (319)..(319): n is a, c, g, or t
  misc_feature (357)..(357): n is a, c, g, or t
gcgcatatgcttcaggttccatgatcccgactactgttcacagcagcggatatctgggctgcgcacccagacagaagccttccagggctgagagcgcaccatagcttcgctacccctctgtctactattaaggctttgcactcagtcgggctccaggacctgaaggcctcaataccagctaccagtcccagtcatnnaacccngncgnatgcgcaagtacccnaacnggccnagnaagacgcccccccacgaangcccttacgcttgccnagtggagtcctgtgatcgccgcttctcccgctccgacgagctcacccgncacatccgcatccacacaggccagaagcccttccagtnccgcatcccggtacccagggccggggatgggtaccgagctc

SEQ ID NO: 656901 - DNA, 656 bp, Homo sapiens
  misc_feature (426)..(426): n is a, c, g, or t
  misc_feature (487)..(487): n is a, c, g, or t
  misc_feature (520)..(520): n is a, c, g, or t
  misc_feature (618)..(618): n is a, c, g, or t
ggcatgtagtgatataaatttccctcttaccattgctttagcaccatcccagagattctggtacattgtctctttgttctcactgatttcaaagaacttcttgatttccaccttaatctcattattcaccaagatatcattcaggggcaggttgttcaatttccatgtagttgtgtggtttttagtgggcttcgtaatcttgaattttaatttgattttgctgtaagccgagagactttgttatgatttcacttcttttgcatttgctaaggagcattttacttccaattatgtgatcaattttagagtaagtgccatgtggcaccgagaaaaatttatattctgttgttttagggtggtttctatagatatctatcaggtccacttgatctgtagctgagttcaagtcctgaatacctttaattntctgttcagtgatctgtctaatactgacagtggggtatttctcccactattattgtgtggnggcctaagtctctttgtaggtctttaagacttngttttatggatctgggtgctcctgtattgggtgcatatatatttagaatagttactcttcttgttgaattgaccctttaccattatgtggaccttctnttgcttttttgaccctttgatggttggtctatttgtcc

SEQ ID NO: 656902 - DNA, 391 bp, Homo sapiens
ccccaaattcccgctctgtgggaggccaagacgggtggatcacgaggtcaggagttcaagaccagcctggcctagatggtgaaaccctgtctgtactaaaactacaaatattagctgggcatgaggatatacgggaggcttctggaatactcaaaactatgatgcaagagaattgatggaaccgaggagggagaggttgcagtgagccgagattgcaccactgcactctagcctgggcgacagagcaagactccatctcgaaagaaagaaagaaagaaagaaaggaaattccccagggaaaatcctcagatgatatgataaacaggtaccgaaggaagcagaggcatgtggaggacgacccacacctcatgcatctatttgccccgcgcca

SEQ ID NO: 656903 - DNA, 129 bp, Homo sapiens
aaggtactttctagttggctcataaaaatataccagcattcatgatagcatttcatgcattttccaaggtaccaagtgtacttatttatgtggtagttgttgttgttgtatattagaaggaatacagct

SEQ ID NO: 656904 - DNA, 381 bp, Homo sapiens
taatgccaactactcaggaggctgaggcaggggaatcacttgaatctggggaggaggaggttgcagtgagctgagattgcaccactgcactccagcctgggcgacagagtgggactccatctcaataaataaataaataaataaataaataaataaataagtgctggtgaggatgctgaggcactagaacccctgtgcaccgtcggttggaatgcacaatagtgcagtcactatggaaaacagtaaggcaagtcctcaaaaagttaaaaatagaattaccatgtgatccagcagttccgcttctgggtatatgcccagaagaattggcgggatctcagatctttgcaagcccatgttcacagcagtattatatttactgcc

SEQ ID NO: 656905 - DNA, 931 bp, Homo sapiens
tctctattcttcactttcttccaactcctaaagaaacattcctcccaaagagctgaaagcaccatggacataagtatgagcttaagatatttaattttttttaatttcattattattattattattggagacggggtctcgctctgtcacccaggctgagtgcagtgtgtgcaaacctggctcactgaagccttgacctcctggctcaggcagtcctcctgcttcggccttacatatagctgggatcacaggagtttgagaccagctgaacaacatagtgagagcccgtctctacaaaaaaataataataatgagcatgatgtttgtgcatctgtgcttctagcttcttgggaggcttaaaacacggaggatcaacttgagcccaggagtccaaaggctgtagtgaactgtgattgtgccattggtactcccaactggaggacagaagcaggcccgtctctcaacaaatatgatgaaccaaccaggtgggagactgggcacagggtcaatggctgtaattcccagcaactttgggaaggccaagggtgggagaaatccttgctccaggagtttgagaccaggtctggagataggtaccaccctatttgttcgaaataaaattaggccagtacggtggtaataagacctgtaggttaggtcctcaagaggtgagggcggaagatcattgagacctagaggtgagttgctgggccaatgtgcctgtctcggctaagaaggttggaacttttccaaaaaaaaaaacaaaagtggcgcgcgccgaaatttcaaccttttgggggcagagtgaaggtacttgtccagaccgcgaatgggtccaaaacgcggggttgaccagtgttttgttggtctctcacgtcgttcgttctctcctttttctctctcgcttctctcatagtatcataacaacacc

SEQ ID NO: 656906 - DNA, 392 bp, Homo sapiens
  misc_feature (9)..(9): n is a, c, g, or t
  misc_feature (44)..(44): n is a, c, g, or t
  misc_feature (47)..(47): n is a, c, g, or t
  misc_feature (63)..(63): n is a, c, g, or t
  misc_feature (116)..(116): n is a, c, g, or t
  misc_feature (119)..(119): n is a, c, g, or t
  misc_feature (121)..(122): n is a, c, g, or t
  misc_feature (249)..(249): n is a, c, g, or t
  misc_feature (355)..(355): n is a, c, g, or t
  misc_feature (389)..(389): n is a, c, g, or t
cagagcgtnacctgtcaccctccccaagcgcctgcaccgcggtnaangagcccagcccagggngcttggacgtgaccatcatgtacaagggccgcacggtgctgcagaaggtggtnggnannccgagctgcacgttcctatacggccccccagacccagctgtccgggccacggacccccaggctccgcagcccctccaccccagcctgcctgctgcctcggaactgtgacacccccatcttcgacttnagagtcttcttccaaggtcagtgaggcccttgcctggggggctgtctccagggggtccttgggagcacctggcttgccaggtacttaagcaagagtccccttcttnagaagcttggtgggatttcgggggaaggaagcgntgg

SEQ ID NO: 656907 - DNA, 271 bp, Homo sapiens
tctgaagtagtcctgaagacccctgataagaatgtcatcttctccccactgagcatcttcaccgccttgctttcctgtctctgagggcccataatactatcatgacagagatcctcaaagacctcaagttcaacctcacggagacttttgaggcagaaactaacaaaaacttatggcatctcttgtgcactcttaatcagtgaagctgtgagctgtacctgagcatgggaaatggacagccaagatcaagtgcacttaaagtgtgccggct

SEQ ID NO: 656908 - DNA, 204 bp, Homo sapiens
tccgggtgatcttgatgacccggtcatttgctatgcaaagatgaaatgaaaaggcagccattaaaataaatggatcagttgtataccaagaagtatttggctcatggcaattaaaacacggcaactcagggtatgttaatacgccagaggcttgagtcattacatgagtatattacagagaacgatagccagtcccagtatgac

SEQ ID NO: 656909 - DNA, 263 bp, Homo sapiens
accaactggcttcaaattgggttcccatgaccccctttctgggctcaattaatttgctggaagggctcacagaactcaggaaaacatatttactggtgcaaaggatacagatagagagatgcgtcgttggaggtatgggggaaggggcatgctaccctccaggaacctccagtgctcagctatctggaagctcttccaacccagtcttatggaagcttcctgacatcagcattccttttcccagggtacagggtaggaccctc

SEQ ID NO: 656910 - DNA, 1075 bp, Homo sapiens
agcgggctgggcggctggcagtgtggcaggagcgcaggggcgcgagccggcgatcagccttcccggctgagcgtgccgcgggagctcgagcaactcggactagtgggaccctgggccggcccccaagatgccggacgatcgcaggtgttgtgcaggcgggccgccgcgtgagctgtgtgcattccatccaatgtcgaagagcccgagccccctggacgcgactcgaccggagagacggcagggcacccaaagcaaggaaattatcctaagaccaactgaacacgtggcgttgaagcaacgcggtcgtcgcacagtataacgaaccagggaccaaagctacctgagcaaacccgtcttttcacgagacgcacatgaactgtatctacagtacaaccttgcgacactcaccaaaccgaacgggacactatatgcagacacaagggctgctgggaaacaccaagtcacaaagtggagacagcctgcatccttggagaggtgttagcgacattagccagtgcacccctcaaaccaacaggttgtaggttgatttgaaccccacacgggaacttaacgccaaggaccgcgtgcacgactagactgagtttcgtccacagacaccctggcagaccgcaacacattagcgtttcgagcacaaggtggcacacacaacgaaaccgggcggggatatcggtttgtgcacccgcacacaaaaaacgacccatcgaggcgtttgtgaaccccgtttactggaacagaattacacgcggtcacgacagcgtatctgccagaaaaagcccccgcctgattgggttccccgcccaggatatgagcactcaaaacgacgcaaatgcgcaccatatcagcgctccatcagagatcggaggcattcatgcgacaattagggaaccacacagtccccctatcaccgcagcaaatttccacacacgagatcagcacaaaaagattacgtgggaccactctgtctgcccaatttcgacatctgaggttaacccgtaacagcatggtggcagacacacaacagctcacttcagcgacatcaatgcacccatgacag

SEQ ID NO: 656911 - DNA, 102 bp, Homo sapiens
accgtgtactcagtagccaaggagcgcgccgcctgcagctggagctgaccaaagtgcgtgaggagtttaaggagctgaaagcgcgcaataccaaggaggagt

SEQ ID NO: 656912 - DNA, 207 bp, Homo sapiens
  misc_feature (1)..(1): n is a, c, g, or t
  misc_feature (5)..(6): n is a, c, g, or t
ntaanntagatgatccatggcagctatcttcaaatgctgaaagctgctcatgtagcaggagtctgtgctgttttagaaaagaaagggtattacaatcagtgatggtggggatgtaatttttttacatttaactcccaaggtaatgtattaattataaatcagttgtactgaattatgctaaggaatagcttggtttattatttgttt

SEQ ID NO: 656913 - DNA, 1842 bp, Homo sapiens
  misc_feature (277)..(277): n is a, c, g, or t
  misc_feature (363)..(363): n is a, c, g, or t
  misc_feature (761)..(761): n is a, c, g, or t
gctcgtgttcgcagtgctatggtcgcgagcgcgaggagtgtaccatgtgtgcgcggcctctggcgcacgcctgagcacgcataggtaatagctgcacgggtagcagctgtaggatgaggctccggtgggcaagtgtctcgctgctcgtgggcgcgcccacaggggtacgagcacgccgcctggggctcgtgatcctgccgacacatacataagggttcgtgttgacttcacgattcgcccacaggggataccgcaggatgcaggtgcggacatcggnacctgaagacgacctgtagcaggatgagaagcgtgtatccatatgtacagaaatcgagacacatgggacacccaagcacttgacgngatgtgttgtccatttcatgaactcgatgactctgtaaatgcattcagagaaagcaccttcacccaggtatatacctaatgtctaatatgcatgaaactatgcaattagagtaaaccccccggaagataaaattcattttatacaccaatctagcctggggcgaaaactaatttcgagaatagttccgtatctggaaacacttgtgtgtccacacttcattcgtctttccggaatcggaaatttgccttagattggacgtggacatcttctatttagggccccaggggaaggaaaactcttcctttcttggggggaaatccccccttaaaagaaaggtaagtcaatgcctttggcggaggaacctttgtacctctcaaggttcgaagtttggtgtggnacatgaactcaaaggttgggttgggtaactggctgtcccagggggcttactcccacatctccagtggacacccatttggaatctcggttatagtcatgggctcccacattcgaacgagtttcggcctagattggaggaaaagtggttctcccaagaagtcgattggtaaaaataggactacagaacgaattggaggcatcggattctttcgaaatttattagaaggggtcacttccatttatcggaaatcaaatccattgcgtttgggcacaacaattctcttggggagaggccttccacagtggggcttcaattcaggggatgaaattggttggccaacaaaacaaggcactcggatagagaggacgtttgtggccaacagcgatccaaagaggatattattttcgaaccgagatatgggggaaggcccaagaacacgtttaaggattattggcacaggcaagagtactgcattggtagacaaaaacgagattgcagatggccttatatgagaatttaataggcatgcatataaatatgaagggagattggtaccacgtgaaagggttataatataaagcaacaggtgcaatctttgtagaaataggagaaagagaaaagagctcaacagagaagtggtggtatatgccagcatggggcgaagagccaccataacacagtggcgggggagcccacaccaatggtgcagacatatcgaacaccgtaccaaacatgcatatacaccgccgagcagtgagacaagacacccaacacgaagcagagaactaggagactcagaaaccaataggaagcataccgcgggggaaacgaacaagtatgaaacgtggaaggtagaagagatctatagaggaggtaaggtaacgcaaggaaggagagtaagcaacgacaggacataatcgagcaaggtaagaagagaaagaacggaagaagagatatgaagataaggaagtcagatgggtagtaacaactgaagacataaagagcagtaggagcaggcgaacgagagagacagagattgaagtagataaagagatgaggagacgttggagagaggagggag

SEQ ID NO: 656914 - DNA, 182 bp, Homo sapiens
tcgtctcagcgactactcaggagagttgaggtgggagaacctgcttgagctcaggagttcaaagttaacagtgagctatgctcggtaccatatgtactccagcctgggtgacgaaagcaagaacccaactcaaaaataaaacaagggtttctacgtcctgttaggacccactcctgtaagtc

SEQ ID NO: 656915 - DNA, 145 bp, Homo sapiens
ggcacgaggcgcaagatcaaggggaaaaggagaaccccatgcggaactgcgcatccgcaagactctgcctcaatatctgcgtcggggagagcggagacagactgacccgggcagccatggtgtttgagcagctcaccggccatga

SEQ ID NO: 656916 - DNA, 931 bp, Homo sapiens
ctatgaagactgacgaattgccgccgcgatgtgctacacagcaagggcgcccccggtgggtgcggcccccccccccgcccccgtcttctcaagggaatactcgccgcgacgaggggccgcgcgatatcgcggccgtctcgatgggagcacgccgtgtgaacaaacaactccccgggggtgctcttggtccgcagagagaaaactctcttagggcgacaaacatctttccactaactcccctggtggtgatatcccctggccaggccgctccgtggggtacacgcagcggacttctttctctacattgggggctccgccgctgtatttttaatggccgcaggccggcttcccgccacccacccggggacgggttccacacgcccccacacccgccggcgcccccctgttgaaaacaaatgtagtcgccacgcgaacacacgtgggtctgggaaccttccccacaagtggccccccccagggtgcgctggtcccgagtgggtaaaccctcccacagggtatactcccacacgaggcttatctcctcaataaagaggcgcttggagtaaagccgcacgcatcggcccctcctttccacgcgcaattacatacatggctcgtgctaaaagctcattcgagctctggcgtagtttatttgttcagccgcacgatgctagtttcgcatggagagatcaaagatgatcacgccaactcgcctcatatcacgccttgtagcccccctcaagagacattcgaggtgtggggaagagcggactaagaacgaggaagagtcttaagaaaacatagatactacgatttttgggggaactattagactttcaagattaattgtcataccccgcggcttttccggaaaaagtccccccttcgaatataaaaaaaacatttttataggaattcaaaaaacaaaaca

SEQ ID NO: 656917 - DNA, 453 bp, Homo sapiens
gtagcggcgcaagaggctgaatggacagctatgtagaaatgtgactggacaacaaggggtatgatctaatgttgatggacagagaggggaagcacagtaaggcccgtctgtttggattcttcctggtctctctgtgtggcattccttccacctgggtacagggcaggacctctctggagacaggggtcttatgtcctacttttagacaaggtagggcagagaatttttttctttctgtttctgagatgaagtctcactctgtcgcccaagctgcagtgcagtggtgcaatcacggctcactgcagcctccacctcctgggcctgagtgatccccctgcctcagcctcctgaatactgggaccacaggtgtgcaccaccacacccagccaatttttctccttccttcctcccttcctctcttttttccttccttcccttatccccattcagcct

SEQ ID NO: 656918 - DNA, 158 bp, Homo sapiens
aggacccgacggaacggatctgcctgtgggggcagtgcctcctaattggggggtagggctagctggagtgtataaggctcagaaaatcctgtgaaaagaaaacttctgaggtataaataggattatcccgtatcgaaggcctttttggacaggtagtg

SEQ ID NO: 656919 - DNA, 1197 bp, Homo sapiens
  misc_feature (384)..(384): n is a, c, g, or t
ccccctccacagcatggagcgcggccagacgcaggcaatactcatttctcgctcgtctcttctctctcgcgcgtactactgtgttgactaccgtggttgctggttcgtctcttcttcgtcgtctagtttgcttcgctggtttgatgtccctcctttgtgtatttctgtccgttctttacagcggtgtgtccactattctggtatttagtgctcgcccctcgttgtgtggtcaccttctgcacgcacaatacgtgagtggttgccttcatctcgcattgggctgtgtacgaccaggttgtgtgcggcccaccttgtgggtcgttttcccggcgcggtagtgttctgcgccctgtctccgcgctattccggtctcttagtgtatanacccgctttggggtacctccgcgacttcaggtcagcccgcaggcttcggcccttgtcccccttggttctttgttccgtccctcaggtgtgtcccacgggattaccctttgggcaagactcccctgggacgcccagctgtcccccgttttgcgcaacgccagatgggctaagggccgcgggattagggtccccctgaaccaggcccaacagcgcccatacctgggccgatcgatgtcttacagcagcctaaagccccacctgggtctctgagcccgaagaagtggccttgcagccattacgtgacaccccaagatgaagtacagctgaagacccacctacagccaatcccacgggcagcccagagcttaggctcagcctcccctggccccggccagccccctctcagtagccccaacgaggggaaggagtcacagaaggtgtcacaggggttggtggtaccccctatgagatttcggtgtgagccttcggcacctcccctccccatcgcctctgcgcctacaccccaagggccccacggtggcccccttccttccctcaaggggctcccctcccgtgcatggacacttttttaaacccccgattcccagaggatgaggagtgcttttctaaaatgcagtaggcttggggaatcgcgagagttggggcccctgagactggggtagcaacccccccttttatcttgttaagaccttcccttccttgatcccctggaccagactcagtggacatcttgtgccattgctcgccctggagggaacccgatcatttttaaacccagaaataattttttta

SEQ ID NO: 656920 - DNA, 1603 bp, Homo sapiens
  misc_feature (64)..(64): n is a, c, g, or t
  misc_feature (67)..(67): n is a, c, g, or t
  misc_feature (70)..(70): n is a, c, g, or t
  misc_feature (84)..(84): n is a, c, g, or t
  misc_feature (89)..(90): n is a, c, g, or t
  misc_feature (109)..(109): n is a, c, g, or t
  misc_feature (116)..(116): n is a, c, g, or t
  misc_feature (546)..(546): n is a, c, g, or t
  misc_feature (759)..(759): n is a, c, g, or t
cgcttggcgccgcacctctgcccgcctcggagacccgcagccccgcgccgcgcctggccccggnccnggnccctccgcgggatnctggnncctcctcgagcgccgccancggccgncatggcctctctgggggacctggtgcgcgcctggcacctgggcgcgcaggctgtggatcgtggggactgggcccgcgccttgcacctcttctcgggcgtcccggcgccgcccgccaggctgtgcttcaacgcgggctgcgtgcacctgctggccggggaccccgaggccgcgctgcgggcatttgaccaagccgtgaccaaggacacctgcatggcggttggcttcttccagcgaggagtggccaacttccagctggcaaggttccaggaggctctgtctgacttctggctggccctggagcagctgaggggccacgctgccatcgactacacgcagctgggcctgcggttcaagctgcaagcctgggaggtgctacacaatgtggcgtcggcacagtgccagctggggctctggacagaggcggccagnagcctaagggaggccatgtccaagtggccggaggggtccctgaatggcctggactcagccctggaccaagtgcagagacggggctcactgccgccacggcaggtccccaggggcgaggtcttccggccccaccggtggcacctgaagcacttggagcccgtggatttcctgggcaaggccaaggtggtggcctctgccatccccgacgaccanggctggggcgtccgccctcagcagccacagggaccaggagcgaaccatgatgccaggtccctaatcatggactccccaagagctggcacccaccagggccccctcgatgcagagacagaggtcggtgctgaccgctgcacgtcgactgcctaccaggagcagaggccccaggtggagcaagttggcaaacaggctcctctctccccagggctgccggcaatgggggggcctggccccggcccctgtgaggaccccgcgggtgctgggggagcaggtgcagggggctccgagcccctggtgactgtcaccgtgcagtgcgccttcacagtggccctgagggcacgaagaggagccgacctgtccagcctgcgggcactgctgggccaagccctccctcaccaggcccagcttgggcaactcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgcaaaaaaaaaa

SEQ ID NO: 656921 - DNA, 1759 bp, Homo sapiens
  misc_feature (706)..(706): n is a, c, g, or t
  misc_feature (708)..(708): n is a, c, g, or t
  misc_feature (1199)..(1199): n is a, c, g, or t
tctttgggtcctgaggtgctcgtctttcttgttgtgcagcaaggagtcatcgcttggtgttgcgtactcttctcgtctgtgtgagtctccctccttggtggttcgtctcctttcttcttacgtctcggccgggcgggtgtcgttcctctgccacattgtgtggaacacatccctgtttttcggcggagtgcgccacactccctttgtgttcggatgatctttttgacttcctcgtttgatgagccagcgtctcgcccatggccccaccctttctggggggaagaaccaaccaccaccacgtgagctccgccacaaggctcctctggtgggtgcgcccccccccatgttttcacccccgcttgttgcctcgtcgcggggccacacgcgatttctcggaggctctttctctctctcagggggggatccctcgcctttttttttcccgtttgtgaaaggatgtggtccccccccggcgaaggatggggggaatgttatatagatggggccctctactcatcagccccccacggagttgcgcccacgccttcctcttgggtggttggttcgccccctgtggtgaggggttttggtaagtggccgcccccccgcgaattgctttctacggcgaagcctcctttttccccgccccaaggagttccttcattggtgcgcagggagcgacatatactcccgggggccgcccccncnaatatatattgttgcaccagcaaagcactcttgtggctcttcttgtgggtgtaagatttaccccccgtcaggtgaaggagtgaagacttttttatgcaacccacaggatgtacacttgggggtgctcctcctcacgacgacaagaaatttttgtgacgaggcaatgagagaccgccacagcccaccaccagagtggggggtgctcaacacaacgacacagacacaagatactgctggtcttggtgaggaggttttgtggagactcttgtctcttgtggagaaacacgcacacgcgtctctctaccagcgagagactctgtgatgagacacggtccccacacgagtcccccggatctccctctgtgtgagagactctcgcgacgccctggtgtacacctctcccacttgtgagaaatattcttttgtgatagagcccacccgactctttgtgggagaaccaccccacaccccctgtgagaggggaagagttngtggagagccgccccctttgactaccgccgctctctacacagagattgtgtgagacacagacggtctcaacacagggggggatctcccctgtcgtggcgcaacacacttggtgagattctcagagagacctgtgcccacacagagacaccgcgtgctcagcagagaggaccacagaccccccaggcgccccgcggagattatctgagggcccctctgcttgagaacactctctacaggtctctcacagctctggagaggctctgagagattctcccaccctcttccccccgcctctgtctctggagaagatatgtgccgagaggagctcttttattctcttggtgtgagttgcccttgtgagccagcacgcacaactccacatgtccaaccacatcccacaagagcccccacccccccggagtatgtggagatggccaaagtggtgttttgagagagcccacatgacaccccacaagttttgagaggcaccttaagcccccacgagaagcccgggtaccccttggggagaccggaggcccattaaaagttccgagttcca

SEQ ID NO: 656922 - DNA, 1624 bp, Homo sapiens
  misc_feature (64)..(64): n is a, c, g, or t
  misc_feature (67)..(67): n is a, c, g, or t
  misc_feature (70)..(70): n is a, c, g, or t
  misc_feature (84)..(84): n is a, c, g, or t
  misc_feature (89)..(90): n is a, c, g, or t
  misc_feature (109)..(109): n is a, c, g, or t
  misc_feature (116)..(116): n is a, c, g, or t
  misc_feature (546)..(546): n is a, c, g, or t
  misc_feature (759)..(759): n is a, c, g, or t
cgcttggcgccgcacctctgcccgcctcggagacccgcagccccgcgccgcgcctggccccggnccnggnccctccgcgggatnctggnncctcctcgagcgccgccancggccgncatggcctctctgggggacctggtgcgcgcctggcacctgggcgcgcaggctgtggatcgtggggactgggcccgcgccttgcacctcttctcgggcgtcccggcgccgcccgccaggctgtgcttcaacgcgggctgcgtgcacctgctggccggggaccccgaggccgcgctgcgggcatttgaccaagccgtgaccaaggacacctgcatggcggttggcttcttccagcgaggagtggccaacttccagctggcaaggttccaggaggctctgtctgacttctggctggccctggagcagctgaggggccacgctgccatcgactacacgcagctgggcctgcggttcaagctgcaagcctgggaggtgctacacaatgtggcgtcggcacagtgccagctggggctctggacagaggcggccagnagcctaagggaggccatgtccaagtggccggaggggtccctgaatggcctggactcagccctggaccaagtgcagagacggggctcactgccgccacggcaggtccccaggggcgaggtcttccggccccaccggtggcacctgaagcacttggagcccgtggatttcctgggcaaggccaaggtggtggcctctgccatccccgacgaccanggctggggcgtccgccctcagcagccacagggaccaggagcgaaccatgatgccaggtccctaatcatggactccccaagagctggcacccaccagggccccctcgatgcagagacagaggtcggtgctgaccgctgcacgtcgactgcctaccaggagcagaggccccaggtggagcaagttggcaaacaggctcctctctccccagggctgccggcaatgggggggcctggccccggcccctgtgaggaccccgcgggtgctgggggagcaggtgcagggggctccgagcccctggtgactgtcaccgtgcagtgcgccttcacagtggccctgagggcacgaagaggagccgacctgtccagcctgcgggcactgctgggccaagccctccctcaccaggcccagcttgggcaactcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaagagcccgatgtcccccttgcagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgcaaaaaaaaaa

SEQ ID NO: 656923 - DNA, 279 bp, Homo sapiens
tgtcgtgctcgaaagagtgcagccatgaggagaatgggttctggtgaagcccttaagacaaataagtctcctgagtccaaaccattgcctggaaagcttccaaaaggtatctctgcaggagctgtccagacaaatgttaagaagggaccccactccctatttaatgctcctcgaggcaagaagcgcccattgtcaccagattggaattattgcttctgtgaggatgccttttttaatatgcatacccatgaaatttaatacacattttaaaacctctga

SEQ ID NO: 656924 - DNA, 574 bp, Homo sapiens
ggcaattcaggtggcccagaaagcccctggtggctgcggtggagctgggcaccgccccgactgaggcagctgctggaagaggggttggcagaggtcactgccctccctgcaggccccacccaggaggccccctctgaggaatctctttgcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgcaaaaaaaaaa

SEQ ID NO: 656925 - DNA, 105 bp, Homo sapiens
tgcatgagatctgcagcgtttgtccacacggcagggcaaattaccttgtagagtcagcatggaggtttgctaactctgcctgtgttctttgcagattttaaccag

SEQ ID NO: 656926 - DNA, 844 bp, Homo sapiens
tggtagatttctggcatagatttgaaaaacttttaggttgttaccaagtatgaagtataaatctggggaagaggtgtatttacatttaagggtcggtaggaacaggccaccttgtgtacaaattttttagtttccaaaataatcatatattaaagtgagggttgcctgatctgtactttgtgtgtagttacctttttatatttaaaaaattaggaatgaagatgttatgtgtcttagcaagacttaaagcttgatttgatcttgtgtttaaatgccagaatgtacttaaatgagtgacttagaatgccgataaaattgcagtttcatgtatgtcctataagtcatgctcatgtatatttagttacgtataatgctttctgagtgagtttaactctgtaaagtcatttggttaaatcatttggcttgcttgtttactcccttctgtagtttttaactgtaggaactttagagataagtctacattaaggaatgatcacatctaaagctttatcttgtgtgtaatctaagtatatgtgagaaatcagaattgggcataattggtcttagtggatcatccaggcttgacaagtcattattcctgggctgtggtacgtgaatttggtgagattacctgctgctaggaaaagtattgatggcaaagccccgttttgtttttgctccgactaccagtctgatcataccatgggtgccaaataccctggcgtagatggccacagggaggcggcgcctaaacgcgcggttttttcggaaacaccacgaaaaattttgggtgccccaaaaaattacaccatttggcggcgcgaaaaaagtgtccacaaaagta

SEQ ID NO: 656927 - DNA, 1015 bp, Homo sapiens
tgtcagcaaaaatcttttaaataaggagatgtaggatccaggggttagtttttggtacgcctcggttgggcccggtcggcctcgggcaccgctcgaacttccgggcccttggagcggactgtagggtttgggtggtgggctgtcgcggggtccctgggggccttgccgaataggccggtaacactctctctgcggcctcttggcgaggaccggagaagcgaggacagttgccaacagccccttaaggggatgtccagggccagctggtccggaaagtgaggtattcttggccccctctggcctcgtggaggatatggcggttggcgggcccggtctggtcagcgcgcgccagtgcactatactcttcagttgggggtacctcctctgaaacccggcatatccatccgagtttatgggtcccccaaaaccacggggccgcactttgggtttcccccggccagggaaagcttcaatctttccgggataactccgggaaaaggggacatgatgggaggccaggtggggggcaatctattaaaaaaccccccttatcaaagggcaaacctggggtagaaagttttggaagttggggcaccattcgggcgcaaaaaaaccgtgtaataagtgggacacaaagaggccttcgggttaaaaaacaccgtggcccatgggcgcctccctttgcgcccgaacgcctttcggggcccctgtgatacaggggcggcttgttccaatccccagtcatgggcgccctcctgattcgggcctcagactcttaacattgttcggggaacgtgtacccgggaccccgggttgtttgccccgtgttcgcctttagccttctaaaactcccttagcaaaaaatggagtgaagggaattttccacacacggtttgtcccagatatgtatgtccaaattgtgaaacgcttggtggaacccttaatgccgtgaccagggatcaacccgattgcaaaagtcaggttacaaaccctgttgggaagagaacctaaaaca

SEQ ID NO: 656928 - DNA, 1747 bp, Homo sapiens
  misc_feature (64)..(64): n is a, c, g, or t
  misc_feature (67)..(67): n is a, c, g, or t
  misc_feature (70)..(70): n is a, c, g, or t
  misc_feature (84)..(84): n is a, c, g, or t
  misc_feature (89)..(90): n is a, c, g, or t
  misc_feature (109)..(109): n is a, c, g, or t
  misc_feature (116)..(116): n is a, c, g, or t
  misc_feature (546)..(546): n is a, c, g, or t
  misc_feature (759)..(759): n is a, c, g, or t
  misc_feature (1489)..(1489): n is a, c, g, or t
  misc_feature (1507)..(1507): n is a, c, g, or t
cgcttggcgccgcacctctgcccgcctcggagacccgcagccccgcgccgcgcctggccccggnccnggnccctccgcgggatnctggnncctcctcgagcgccgccancggccgncatggcctctctgggggacctggtgcgcgcctggcacctgggcgcgcaggctgtggatcgtggggactgggcccgcgccttgcacctcttctcgggcgtcccggcgccgcccgccaggctgtgcttcaacgcgggctgcgtgcacctgctggccggggaccccgaggccgcgctgcgggcatttgaccaagccgtgaccaaggacacctgcatggcggttggcttcttccagcgaggagtggccaacttccagctggcaaggttccaggaggctctgtctgacttctggctggccctggagcagctgaggggccacgctgccatcgactacacgcagctgggcctgcggttcaagctgcaagcctgggaggtgctacacaatgtggcgtcggcacagtgccagctggggctctggacagaggcggccagnagcctaagggaggccatgtccaagtggccggaggggtccctgaatggcctggactcagccctggaccaagtgcagagacggggctcactgccgccacggcaggtccccaggggcgaggtcttccggccccaccggtggcacctgaagcacttggagcccgtggatttcctgggcaaggccaaggtggtggcctctgccatccccgacgaccanggctggggcgtccgccctcagcagccacagggaccaggagcgaaccatgatgccaggtccctaatcatggactccccaagagctggcacccaccagggccccctcgatgcagagacagaggtcggtgctgaccgctgcacgtcgactgcctaccaggagcagaggccccaggtggagcaagttggcaaacaggctcctctctccccagggctgccggcaatgggggggcctggccccggcccctgtgaggaccccgcgggtgctgggggagcaggtgcagggggctccgagcccctggtgactgtcaccgtgcagtgcgccttcacagtggccctgagggcacgaagaggagccgacctgtccagcctgcgggcactgctgggccaagccctccctcaccaggcccagcttgggcaactcagttacctagccccaggtgaggacgggcactgggtccccatccccgaggaggagtcgctgcagagggcctggcaggacgcagctgcctgccccagggggctgcagctgcagtgcaggggagccgggggtcggccggtcctctaccaggtggtggcccagcacagctactccgcccaggggccagaggacctgggcttccgacagggggacacggtggacgtcctgtgtgaaggtagggtgggcatggcccttcccaggcagcaccgtggtgcccggggtgtggggggcttagagctcggcctgtgctgtnagcagacgtggcacccanaggccacgcctgggtaacgccctgcagagcccgatgtcccccttgcagtggaccaggcatggctggagggccactgtgacggccgcatcggcatcttccccaagtgcttcgtggtccccgccggccctcggatgtcaggagcccccggccgcctgccccgatcccagcagggagatcagccctaatgatgctgtgtccatgatgcttttaataaaaacaacccccactgcaaaaaaaaaa

SEQ ID NO: 656929 - DNA, 453 bp, Homo sapiens
aaccctgcagctctctctgatgctgctctccttttctgcatgctcacatactgtcacgcttagtaacctcagattcgaaggagacgacatgcacacacatgatccaccagcccgtgtgggattccctctgcccttctggcatctgaaggctgtgattcaaagatcccccctgcaaacttcccacaaatgaaccacctgattctcacaaccgaagcgagcattgacacctcccattgagggacaaaaacaaagtcacattctggcctgctggcaagtcacctgtcatatccagctcatcttcatagtaccatagtaagtcctatactttagtaaatatacagcctcttacacgcttctatgaggtgccctatgtgttgtctctggggtcagccttgtgcttgacacagcgaccgctcatttccgttcagtgtgaacaaccagacctcaccaatt

SEQ ID NO: 656930 - DNA, 271 bp, Homo sapiens
atacatctgtgatagtcacgtgcattaggctgtagtatttgtctatctcttgggctgaggcgggacaatggtgtgaacccgggaggcagagcttgagtgagccgagattgcgtcactgcactccagcctgggcgacagagggagactccatctcaaaaaaaaaaaaggaaaaagggaaaatggcccttactttggtaacacttaaccaagcatagataaatatagagggccaggttgggaaaacccagtttgtgaagattacatagcctta

SEQ ID NO: 656931 - DNA, 379 bp, Homo sapiens
  misc_feature (14)..(16): n is a, c, g, or t
  misc_feature (22)..(22): n is a, c, g, or t
  misc_feature (42)..(42): n is a, c, g, or t
  misc_feature (52)..(53): n is a, c, g, or t
  misc_feature (75)..(76): n is a, c, g, or t
  misc_feature (98)..(98): n is a, c, g, or t
  misc_feature (100)..(100): n is a, c, g, or t
  misc_feature (103)..(103): n is a, c, g, or t
  misc_feature (108)..(108): n is a, c, g, or t
  misc_feature (151)..(151): n is a, c, g, or t
  misc_feature (154)..(154): n is a, c, g, or t
  misc_feature (184)..(185): n is a, c, g, or t
  misc_feature (208)..(208): n is a, c, g, or t
  misc_feature (230)..(230): n is a, c, g, or t
  misc_feature (249)..(250): n is a, c, g, or t
  misc_feature (256)..(256): n is a, c, g, or t
  misc_feature (258)..(259): n is a, c, g, or t
  misc_feature (266)..(266): n is a, c, g, or t
  misc_feature (268)..(268): n is a, c, g, or t
  misc_feature (276)..(276): n is a, c, g, or t
  misc_feature (298)..(299): n is a, c, g, or t
  misc_feature (306)..(306): n is a, c, g, or t
  misc_feature (328)..(328): n is a, c, g, or t
  misc_feature (334)..(334): n is a, c, g, or t
  misc_feature (338)..(339): n is a, c, g, or t
  misc_feature (342)..(342): n is a, c, g, or t
  misc_feature (348)..(349): n is a, c, g, or t
  misc_feature (359)..(360): n is a, c, g, or t
  misc_feature (363)..(364): n is a, c, g, or t
attacagcccttannncatttncagcttaaggacattttaanattgcatgannattagcaaaattattaatttannaccccaaagtaaattgcaaatntnaanatttnattttttcactcttttatcacatgctccaatgtatgtacatangtntctgtggcttaaataatatgttgttatttnnatacatttttgtggtgcaagtanttaatgttattatttgattgtnataccatatgtgccattannattctntnnaattaanantatttcantatgcagaaaataataatatanntgccctngacccttcacatactattttgncatatntgcnnctnattttnnaataaataanntgnnactcttttgtactcc

SEQ ID NO: 656932 - DNA, 869 bp, Homo sapiens
  misc_feature (449)..(449): n is a, c, g, or t
tgcatgtcataatgtacctgtactacggattatctgcctttggccctgtggcacaaccctacctttggtggaaaaagcacatgacagccattcagctgatccagttgtcctggtctcactgcacatctcccagtactactttatgtccagctgtaactaccagtacccagtcatttattcacctcatctggatgtatggcacatcttcttcatgctgttctccaacttctggttattaactctttataccaagggcaagcggttggcccgtgcacttcaagcaaaatggaactccaggttattggcccagtcaaggcaacttgagaagccattgccttaaattagggcgcccaactaaggttgcttcaagactgaactttaggccagtgtcccgtcaagttgcctctcccaactacgactgtgaccaagcttattgttggtcaggactngagcagggggggactggcctcccctccccacaggtgctctacagggaccacggcttttggttcctcacccacttcccccgggcagctccagggatgttggctcatttgcttgtcttgcactccagagctgggggctaaaaggggttgacagtatttccccttcctgcttaaaaccttgcgagaggggcctccggtgggcccacaaaaggtctcgtgtcttttctcacacgaaaggttgattatgtctcgtggacccgtgtcactctcaccccaatgagagtagttcggccagtcgggggggggccggaaaaaacgcggggggtatcaccgggtttatatgcgcgaacaccaaaaaaaggcggcaaaatcgggcacagtccccttgtaggccaaataaaaaaggcggaacagaagagtttg

SEQ ID NO: 656933 - DNA, 287 bp, Homo sapiens
aatcactcggtaccatgttcatccgtgatgctgatcctcctgcatgatttacgatcagaatccggggcggacaacctgtccgccgctgacgaccggttcgccggttccactggtccattgcggcaggatagtgattttttgtgtggcggaaaatgcgccgacatagccatccggatcggtggcgcgaacccgcaggtaatactgaccggctgctggtcgcgggatcttcagttctgcctgatccagttctttggtgaggtacagcgtatggaaggctggatcggtgg

SEQ ID NO: 656934 - DNA, 408 bp, Homo sapiens
ggttagtgttaagcagtatagtattggtatgggtcattatgcatcatatcagttagcattctattttggatggcagaatgttatgcacgtaggtagcagaattaatagctccttagacaacgacgtgctgctggtgtgtattggttgtaaattgttatgcacgtctctggaagacggaaaaatagactactactagaaagaaaaatgactttgttgtattttgctattatctatatatttcggcggcccagggggcccagaggtgtgtgggggcgtggcctataaaaaaatacaacacaacaaaaaataaacaacaaaacaaaaagtgtcgctttataaaaagtggggcgagaaaagagctctctcctatattcaacagtcgtgcgcgcgcgaagttgtgtgtggtaa

SEQ ID NO: 656935 - DNA, 167 bp, Homo sapiens
ggtacagagttggcatctgattgtcaacaaaacaaagcttgaatagcatcctaggagggcagacaggcaaccaggctgtagacactcttctatttgatcaaaatcagaccagagaaaacctactccacacagatagtataggtatatgatattcatctttttcgttt

SEQ ID NO: 656936 - DNA, 197 bp, Homo sapiens
cctaggaccagtaacgcatgggttatatggcagggatatggaaatttctagactttttgacagctactggacacagaatctgagttaacattgatacctagagatccaccccaacatcacaccaccttgttattaccttcggtggggccacatagcaaatcaagtccccgctatcatccaggtcacagtgggcccac

SEQ ID NO: 656937 - DNA, 138 bp, Homo sapiens
caacgaatatcccaggattcctctaacgattctcgccttatttactttcttctatatatttgattacttattgctagtgcttacactcagcatataaaatattctacccctttagagataacaaaaactatatatcaa

SEQ ID NO: 656938 - DNA, 205 bp, Homo sapiens
gctccgaggattcggcaagctatccggttcaattggtctgtgtatctgttttcattctagtattacactgttttggttactatagctctgtggtataatctgaagtcaggtaatgtgattcttccagttttctttttttttgctcaggatagctttggctaatctaggtcttttgtgttccatataaattttagggattcttttt

SEQ ID NO: 656939 - DNA, 343 bp, Homo sapiens
cctacatagcgttgcatgcggaggatgcactgaggagctgggactacaggtattcaccaccatgcccagagtgcagagagactctatctccaaaaaaaaaaaaaaagaaaaaggccccttccttttgggccgggaggggccaaaaatttttcaatacccacctttttagggggtaaggggttcaacaaaccaacctttttaaaatgggttaaagggcccggccttttttttttttaaacaaacttttacgggcccaccggcggggggggttccttggggggggttttcagaaggaggccttttttatagggggggtattacccaaggaaaccttccaggggga

SEQ ID NO: 656940 - DNA, 558 bp, Homo sapiens
gcgcgcgttccccatctcaccaacacaaatattaacaaggccccgcacctctcacaataataaagctcaaaacacctgttattctcacacatttagttccgcacaatgttggagatatcttccagattgtgtgagaaacacttcgtgacacaactacaaaattttccaaggttcaccacaaacttcacctaaaatagcggaggctaccaatttgtggcggcaaagacatacccaaagcgcttctggattccacattaaaagggaaacttcgcaaccatgtgcggatatggccaacacccattatattctattgcctggtacttgaaaaggttcaacggattcaatgtttacccaatattcataagctgaaaaaatcgtccacccacttatcctggtagactttcagacgatgtctttccctctctagaatctgttatgaacacgttgttgctggattcagtaataaatatgtaaggcctttctttttaaaaaaaaaaggccttacatatttattactgactccagccaaccaacgtgttcataacgtcgatcggccgg

SEQ ID NO: 656941 - DNA, 518 bp, Homo sapiens
tggttcataacagatttctggtacagttggagtcaatttaggtagggttatcatggatggagagagtgagtcttttaaattcccagcagagacaggcatatctggggtattcagtgaatcttggaatctttctttcttcttcttctccttttttttttttaaatggtgttttcacctatgggtccagtaaaacaataacaggtgcacgggaagtgggttttatacaggggaatgaaacgggaacaatattttacagcagatggggagaaaagtggcagagtctggtttttggaagtctaagtggtggacacttcagtcccagctcacagatgatgtaaaatggacaatggaaattggatggtcgcaaataggggacagaagttggccgtggtagggtgtccttatagggtggtagcaagcacccaaaagggtacctattactttctttagtacccttggattaaaagaagtggggttcccggcaaggcatggtaatccccttagatgggggacccttg

SEQ ID NO: 656942 - DNA, 87 bp, Homo sapiens
gtggaactaatttgcccgagggctacagcaaggccaagtggagacagccgtgacggtaaaacttacccctacttaccaccctccaag

SEQ ID NO: 656943 - DNA, 218 bp, Homo sapiens
cctctctcttaccccgttcttttaccctttcccttaccggtaccttgttgctactcggtctcgtgccggtactttacgccttacgactggcgttacccaccccgcttggggtctgccttcccaccgccccccgacctccgggaccgaccccgacgcgactctacacggtgccgacgggagtccacgcgctacgccttcagatcatcctggatcactcg

SEQ ID NO: 656944 - DNA, 137 bp, Homo sapiens
atattcggctttgcaagcctataaagtgctgcagctcctatagctttgctgtagttatagtgtgcagctcggagccatagacagctagttagttagttatgagtgagcacagctgggtgccagatacaattttaatg

SEQ ID NO: 656945 - DNA, 658 bp, Homo sapiens
  misc_feature (2)..(2): n is a, c, g, or t
anactacgaatgcctaatccaaggattcccaaatcagcccgcacatccataggttgttagatttacctatttagataggaggagttctgacggtcttgaatctatatttttccttaagggtatgttttggattaggtgtgttatgatggggccggggtggattatattgcggcgtaacgtccttacccctaagtaaggggcctgagttatttgagtgtttttccggggactagggaggtagtgttctcggtaggcgttactttagggattcggggggcgacgttctaacgactactatgaaagctatttttcggacgatttgcgttcgacgagtgggggacgctctattatagggtgtcttcgaggtttaaatttgtcttagctgagggctcttgggtttaatgtataaaatttaccggtcgtagttttccgattttgctgcctgggtaagttctcggggtgtacctatggacgtgctattcatttttctccttagtcgtattgaaagggtatgatgtttctctcttctcgtgtgcgtttttgaaaaaaagggtgggtattttcggtctcttttcgattggttaatgctctactgtttgtatggtggtgtatatccttaagtggatttgtggtttttttcgttttggggtagaggtct

SEQ ID NO: 656946 - DNA, 908 bp, Homo sapiens
tcgggcccgttcgcgcccgtcctgtacggccacgtaccgcggggtggcgggcgcgctagcggcgcccctttgagctagcacgccacggtgcccgacaccccggagcagcctgctgtacgcgacctagaagcggcccttacctacagccgcggacggtcggctgagcggccaggccgtgcgccggccctttgcgtcagcctccgctgggcctcaatgtaccctgcttctgtttgtatatatcccacacacgacatcaacggtgcctgaccttctctgaataccgccgccttgcaagttactacatagtacgaagtcctcatcaagagcaaagcagacgagcgcctaggaacaaggtttctccctatacttggtacactcagcgagctacaactaacatagctgagcgcatgtccgacatatacgcctgcccaccagcaaatgcccgtacaccacgaagacattcgtcctcacccacccactcagagttaggcctcacctggcactgcactacgtcgtacaacgcgccccctggccagaaccactcgacaaaccacacagattccatcaccgaactaatcacacagaacgggcaacagaaacacatggcttatcacacaacacttgcgaagcaggcacaacaccccacagcttttagcatgccatagaataagcaatcccccagacacgaatcaatttgacagcagggaacagctgattatcaaccttctattcaccaagtttaggagggcaaccccaccacactctgaactttaaaactccaactcaaagaaaaacctcgaaatcccattcatccctgccatacacatggataaggcactcaatcttgacccagtcctcacccattctccacattccaagcaacatccacacacagcgtcatcacaaca

SEQ ID NO: 656947 - DNA, 340 bp, Homo sapiens
ggcagctgctgttgcggtcgacctcaggatcccccgggttgcccgtctgcccctggttagagcctgtctggcccttctgtttgtgagctgggattatccccggaaaggaagtctttctgtctcctggtgttgggtgccacgaggtgcatgctgctcagaaaggccggatgacctcgggggcgagtgcgttccctgcttccttctaccgagggtcagcgtattgttcatgtccccggtacacttctatggagtgctgcatgtatagctcgtggtgttagtgaccggttcccttacctggtctgcacgggtacggctagcctagggcgcgtcgagtcagtct

SEQ ID NO: 656948 - DNA, 327 bp, Homo sapiens
  misc_feature (84)..(84): n is a, c, g, or t
agtcgcaccgttagaggtgcagtgcaaccccatcgcggtcgtcaggtggatgaactgacgtgaaaaatccgaccagctccaggncgataccaggctggccaaggggctggaggacgggcgggcgggtgcatcttcatcgtcgtcacccccccaacgcaccaggtcggtggcgcggtcaagctcccagtagatcaggcctgcgacttcgaccgccagacgccagcgctgacggctctcacgcatcaactgggcctgttgatgctggcgagtgacatcgcgcatctgcccaaaccagccaatcacctcaccctgctgctgaccctcgtc

SEQ ID NO: 656949 - DNA, 402 bp, Homo sapiens
  misc_feature (64)..(64): n is a, c, g, or t
  misc_feature (83)..(83): n is a, c, g, or t
  misc_feature (98)..(98): n is a, c, g, or t
  misc_feature (116)..(116): n is a, c, g, or t
  misc_feature (225)..(225): n is a, c, g, or t
  misc_feature (233)..(233): n is a, c, g, or t
  misc_feature (257)..(257): n is a, c, g, or t
  misc_feature (307)..(307): n is a, c, g, or t
  misc_feature (340)..(340): n is a, c, g, or t
  misc_feature (400)..(400): n is a, c, g, or t
caatatgtgactttttaaaaaagctgtcaaataggtgtgaccctactaataattattagaaatncatttaaaaacatcgagtncctcaagtcagtttnccttgaaaaatatcaaanataactcttagagaaatgtacataaaagaatgcttcgtaattttggagtaggaggttcccccctcaattttgtatttttaaaaaggccatggtaaaaaaaaaaattccnaccagtanataaggctgtaaaatgagaatttngccccctcccctcttcccccagtactattttccaaaggtaatctattacnaattttttatgtaattttcagaaaatttgtagnggtatataagcaaaaatgtaatctttattttttaaataaatgggatcaattattaaaaanaa

SEQ ID NO: 656950 - DNA, 407 bp, Homo sapiens
agttatttggtatttgctatcaatacatattttgttaacatattaggatagacatctcatcttcaaatcttcatggacatactaatttttgcatccttctaatcaaagtttttggaaagtggaaagcacttaaaacttgcaggatagagtaattaactgatggtggggcattcaagtggtgctagccagcagacatcttacaggatctaccacaaaaataaatataattattgttgtaatgagtgacctttgaaaaaagtggaagtgggatgctgagatgcgttattctggcctgggcatttgaagatagtttccctgaagaagtagcttacaagctgagacctacaggatgaacagtagttacccaaagaaggagggttccagtccaaagtaatagcaaaaaaaaa

SEQ ID NO: 656951 - DNA, 454 bp, Homo sapiens
  misc_feature (6)..(6): n is a, c, g, or t
  misc_feature (26)..(26): n is a, c, g, or t
  misc_feature (75)..(75): n is a, c, g, or t
  misc_feature (81)..(81): n is a, c, g, or t
  misc_feature (284)..(284): n is a, c, g, or t
ccaagnttccactttttcccttttgnttggccccctttaacttccggtagcccggcagcaagcccaattctggcntccaanggttttttgccagtgtccaacaaccaacggaggcattaaaactcaaaccatcccaaaacgtcttcactgtcaaaggacattctttatcaaaggtgtcatccggtcagctctaccacggtctttcttacttgaacttatcacctctgccctgctttccagaactgtacccaccactccgcccaccaaggcgatccttgactgantggcgcaaggcactgagggcggcatctacaatggcttctcccgttctgccaccctgataatcttctggcttgtttttgttagctccaaatatcttgatggtaggaaatccctggacaccatactgacctcccagggactgatgtttgtctgcattgacggccccgacttt

SEQ ID NO: 656952 - DNA, 407 bp, Homo sapiens
  misc_feature (22)..(22): n is a, c, g, or t
  misc_feature (225)..(225): n is a, c, g, or t
  misc_feature (404)..(404): n is a, c, g, or t
agcaagcaagatttgcagccanctttaatctacccctaggtgatatagtacagttgaaagaggctgaactctggggttagacaaacctgtctaagaagggcttcattactcctcgctgtgatttcttagcctcaatttgtaaaatagggggcaataaaacctctctcataaagttttgagaatcaagtgaaataatttgtgttaagtgccctaggatagtgcctngccatagcagtcactcagtaaattatagtttgatctctttagagagattcaccttttgaatacagcatataagtttccctttctatcaagagtagagtccctctcaattgtaatatgttattaaatgtgctgagattttgtatccatctgttaattctcactgtgtgggaggccttttnggg

SEQ ID NO: 656953 - DNA, 242 bp, Homo sapiens
ctttagtcggcgtaagaaaaggcgtaaacaaggcttaaaatgacgcaattctcccggggtcagggattacagggtctttaaatcaccttgggttaaatctctttaaaaaaatcgcctacaaatattaaatcaccaaaatttaaaacaaaactaaaggcgggaaaggcaccttcatttaaatcaaaaaggcatggcccttctatggggtataatccggggggagacttcccggatgggttggc

SEQ ID NO: 656954 - DNA, 135 bp, Homo sapiens
cacctcggtcgagaatgagtcgatgacgcgctgtggattccacctggctagctgagtgctctcgggactccgggtaccgttccgccggcgggagtagccgtggttcatgtcgtccgcgcggagccgtaccgagct

SEQ ID NO: 656955 - DNA, 156 bp, Homo sapiens
gtctgagcaagctgggaacatgaagcgttctgcagtgtcctgccactatgccctcagagggctctcggcagcctgtgagtatgcgcggccttccatcccagcactgcctccttttcaactctccacatttggtattgccttcccagcttgctcaga

SEQ ID NO: 656956 - DNA, 340 bp, Homo sapiens
gagtgaagtggccctatcttggctcatggcaacattctacctcccaaattgcaagctattctcctgcctcagcctcccagtagctaggattacaggcatgcaccaccacgcccagctgattatgtgtttttagtacagatggggtttctccatgttggtcaggctggtctcaaactcctgacctcaggtgatccgcccacctcagactcccaaagtgctgggactacaggcataagccaccattaccagcctcattattttataatttgattgcctatccgaacccacaccatacttaatggaatcaagagacaagtctcccaaccttgtcgacagtact

SEQ ID NO: 656957 - DNA, 100 bp, Homo sapiens
gaaagctcatacccccagtgatgtagaatccattggtcgcatcctacctttacttatcagttctcttccccacgacaatattcatgcgcctagccatggt

SEQ ID NO: 656958 - DNA, 514 bp, Homo sapiens
  misc_feature (18)..(18): n is a, c, g, or t
  misc_feature (158)..(158): n is a, c, g, or t
  misc_feature (509)..(509): n is a, c, g, or t
acccccatcccaatcaantatgaactataaattctgtttctttaatagttcaagaaaatctttactacctaaaatctgatctccccaggcccaggtgtggtagctcatgtgtgtaatccccagcactttgggaggctgaggcaggaggattgtttganctcaggagtttgagactgggcaacatagggagaccccatctctacataaaattttacaactagccaggtgtggccgggtgtggtggctcacatctataatcccagcactttgggaggccgaggtggcgtggatcgcttgaggtcaggagttcaagaccagcctggccaacatgttgaaaccctgcctgtactaaaaatacaaaaattagctgggtatggtggtggcatgcacctgtaattccagctactcaggaggctgaggcaggagaatcacttgaacccgagaggcggaggttgcggtgagccaagatcatgccattgcaccccagcctgggtgacaagagcaaaccnccatc

SEQ ID NO: 656959 - DNA, 426 bp, Homo sapiens
  misc_feature (121)..(121): n is a, c, g, or t
cctctccagccatggtcccctttaattataattgatctgaaggattgcttttttaccattcctctggcaaaaagaggattttgaaaaaatttgcttttactataccagcctaaataataangaaccagccaccaggtttcagtggaaagtattgcctcagggaatgcttaataattcaactatttgtcagactttcatagctcaagctctgcaaccagttagagacaagttttcagactgttatatcgttcattatgttgatattttgtgtgctgcagaaacgagagacaaattaattgaccgttacacatttctcagacagaggttgccaacgcgggactgacaatagcatctgataagattcaaacctctcctcctttccgattacttgggaatgcaggtagaggaaaggaaaattaaaccgac

SEQ ID NO: 656960 - DNA, 335 bp, Homo sapiens
cccccccccccccccaaagggggggggggtaattttttattcttgaagatataagcacagaagagagggtgctcattaacagaggtccattactgcaatgttctcttaccagttaaccaagctgttcacagtttaacctgttgaatattatttgagctatttaaggcttattatttttgagtatgacttaaatgagggttaaaccttgtttaagaaaaatgcactgatttctgcattatgtgtacagtattgcacaaaggattttattcattttgtcgcattattttgaatatgtgtcttttcattttaataaagttataatccttatttattat

SEQ ID NO: 656961 - DNA, 109 bp, Homo sapiens
tgtaagaatgctttaatgataacaacaaataagttatcaaactgtttccttatcctcttatactgatgtagcataaaaatggtcccggttaggagttataactagccag

SEQ ID NO: 656962 - DNA, 260 bp, Homo sapiens
gagttctgtgcgtagcttctgagaagctggtattacagacgtgcaccaccatgcctgactaatttttgtattttacgtagagacaagttttcgctatgctgggccaggtgacctcgaactcctagcctcctcatatgatccacccacctcagtctcccaagtgctgggattacaggcatgagccactgcacctggcctttacatgtctttcgtgctgagcttaacttcacttaaacctttcagcaaattcctcccctttc

SEQ ID NO: 656963 - DNA, 135 bp, Homo sapiens
caccaaatcagctctcagagtgctggaatacgcatcagccatgcacccagtcagttacagtaaaatctaaagaatgtcatcatttgtaacagaagagtatcatgactttttaggagtatttcctaagatctgaga

SEQ ID NO: 656964 - DNA, 415 bp, Homo sapiens
  misc_feature (122)..(122): n is a, c, g, or t
  misc_feature (285)..(285): n is a, c, g, or t
  misc_feature (296)..(296): n is a, c, g, or t
  misc_feature (363)..(363): n is a, c, g, or t
  misc_feature (389)..(389): n is a, c, g, or t
gtggctcacacctgtaatcccagtactttgggaggccaaggtgggtgggtcacctgaggtcaggagttctagactagcctggccaacatggtgaaaccccatctctactaaaaatacaaaanttagcctggcgtcctggcaggcgcctgtaatcccaactactcagggggatgaggcaggagaatcgcttgaacccagggggcggaggttgcagtgagctgagatcacgccatcgcactccagcctgggggacaagagggagacttcatctcaaaaaaaaaaaanaaaaaaagaangtgttagttcttaaatcttcttagttgctctttgggttacattttaaacacactaaacatatttttntgttcagcaacttaataatttctcantctgaacgtgacttctgctgactgtt

SEQ ID NO: 656965 - DNA, 313 bp, Homo sapiens
ggtgatttcttgcggtgtcttgtcgtgaaatcttgcctattcctgagtccagtatgccattgcctaggtgtctttcagggtttttatagttttgggtttcacatttaagtctttaatccatcttgagatgatttttgtatatggcataaggaatgtgtccatggcctcgtagtatagtttgaagtcaggtagtgtgatgcctccagctttgttcttttggcttaggattgacttggcaatgcgggctcttttttggttccatatgaactttaaagtagttttttccaattctgtgaagaaagtcatcggtacc

SEQ ID NO: 656966 - DNA, 1170 bp, Homo sapiens
gccccggtactagccatgggctcggtgggctgcggccagcaccattacagcacacactccgttgatagcatgggagccagaggaaacctgaacgtgggtggagcgttccactgagtctacttcagtgagacagcaaggcccatgctgatggggcgaggatggcagggacgtgggcattttggacaccaggggaaatggaaatgctgctttcaaaacttagtttcctttccatttcttcctagtctggccttggacacaaatctggtagaaagaagcctgataaatcgagggcacttgtacccatccctgtgccccacagaaggttcttggcagagaagtgcaagaatgggtgaacacggcggtggcagggctggtgtgtgatggccatgggctgggactccgtatcaggcctgatcacctagcctggcgagcataactctgatctcatttgaatgtccagagggagcatcataagagcccagagctccgataaccaaagagtgatattgacatttatggagatagggtagaaacatagtatggataaaatactaacttaataataggtagggagtaaagcgatgtagtctttgacattaggacactggtaggtaatttgattgactttatgagtacgatgacttatctacataggcacaagagaattcgagggatagacacggacaccaaagagacagtgacagtggcacgacacacactcggacacacagccaaacagactacaacacaaggacaccatacagcgccgaaaacatgacgagcaaggaaagacaccacaaaacaataagacacgacaacagaccgctacatgtgcgccatgagcaactaggagagtgacaaggcggcaacccggacacaagaacaaaggaaacagggaacgaccaacagggaacacgggcgcaacgaccacacgcgaggacaaccggccgtcacaacacccccgcatcgcgagagagagcgccacgagccgaccacaagcacagggagcggagaccaacagacgcgcaccggaccaagcacacgacaacgcacgaggacacgacgcacaccgaaacactgacaagcacgaagcacacacgagacgaagaagagaaagacgaaaagagcagcaagagacagcaggggacaagagaaagattaagcgcgcgg

SEQ ID NO: 656967 - DNA, 737 bp, Homo sapiens
gtggctgtactggcctggaattttgggatgcctggcgctgagcattgactgatccctgactgcgacgtcacctgtggaggaggacgaggaggatgcggagtgactgctggatgactgaggactgcgagtgacgtgtgaggcctgctggtgcgagggactgcggacgctgttgactgaggacgaggagtctggagtgagcctgctgtggcggtgcgtcccagctcgttcctgtccagaatgacatgtggtccagaaactggctgagccacgagggaccatgtgtaggtagtcggcacaactatcctggatctgggtggaaacgagactggcaatgtggtgacactgccaaacctgagtttctacagaaatgagatccggcttcctgcccaacggctgtttcattgaggacattcttcaggaacgtggacgtgacaattatgacctccttgaggacaatcactcctacatccagttggcgtgtttcctctgcgaggaaccaggagttgaacttggcatgccaagcccctcacgctcagggaggtcgaggtgtttagaagctcccaggagatccaggagcggcttgtccgggcctacgagctcatgctgggcttctacgggatcctggttggtggaccgattgcacggtgccacggtgggccgagcacatggaataccagaaggcgcttccagaagctgaacttggcgcagccacaacaacctccgcatcacacgcatac

SEQ ID NO: 656968 - DNA, 1183 bp, Homo sapiens
  misc_feature (1183)..(1183): n is a, c, g, or t
ggcggagactgcttctggaaggaacgccgcgatggtcgcgcagggagagccccaggtccacgttcaggacttgtattggtccggcgatggtggtactggacaaaacgatcttcgtgacagacagtcgatgatgactggtcgaatttagacgaacgaagtcatgtcagccgaccgtctgggtggtaggagggttctatccccgtagttggttcgcacgactcagacgagacggacgctatgtcagctgtcaagtgctacttgcgagaccacagcgcacggtctgagggcaggaatagtgtccgaggtgaggacatggagtaggaatgggccctattgtagtagtcgctaagcgcgcaggctgattgccagtcgagatagagtggttatcgaatggtgaacaagtcgcaggagattcatcctgtaacgaaaggaaattggtaggcgcttaaatcgtggtgctcactaatgcacgaatcgtggatcacggacgctgtgtggatcgacgaacacaattcctctcacttcggttgtataggtcgttcggtcaaccagagacgctgcgatttcattcagatgggtaccctgtgaagagggtcagtaccagtgggtgcataaactgctcgagttggtattgcctcttgcccaacccgcgtcgcacaggaacgagcgaaatcccgttgcgaaaagtgaaccgaaacggcgagtcgattccctacgatcgttcatcaggaaacagagtctcataatccgtggagcggacgatcagtggtaggcgtcaacgaaagggcccaccttgtgcctgtcccttgaacgtagttgtgttcagagaaaagctgtccaagttatggcgaccagaacaccttccctgaaaggcgtatacgggggcaatggtgtgcaggtctgtgcacccaatattggcgccttgggtttcacgtccaaggcggccccacgaacagcgagcggaaaacagctttccggctctaggttgggaacccctctaagtctccttttttcgggacaaggtgccacataagcggataaagtctgaactgccaaaccagagaaacgctggttagcggacccgaggttcaagcgttgccgaattggaaacactcacaagagcggttgaggcggctcttatcacccccttggagcacttgtacgaggcggaggacctgtcggn

SEQ ID NO: 656969 - DNA, 177 bp, Homo sapiens
cctgatcccggatcctgggtatagtgggaactcttacatactatctttgcaacttttctataaatctaatactattccaaaataaaagatttattaaaattagggctgggtgcaatggctcacgcctgtaatcccagtatttcgggagccggagacaggagaatcacttgtacccag

SEQ ID NO: 656970 - DNA, 188 bp, Homo sapiens
cctaattttagaagtttcaatagcattcttatgattttataaattgatgtggcatatgcagatatttctaagaaatatatagttcagttctgaaatgtttattaaccatttatataaaccgatatcatctacattgctgcctgggggttcctttagctaggtgctgattgagaacttctaaaactagg

SEQ ID NO: 656971 - DNA, 721 bp, Homo sapiens
ttggctttctttcattgtcttgacgtgcgctgcagatccacagaccagcataggaaccacacaagagtgaaacctttgctaagtggcacctgcagtgccaatgtgccaaagtggaagaggaacaatgggaggcagaaagaaacgtgagcaatgccctcctccagctgatggaagatgaggtgcccaggagacaatgcagtgagaatggcaacccagctgactgtcctgcatggcctgggatgctggtgtgtgtgtgcctccaatgggtgtcttataagatgatgtgatgatgttgtgtgatgttgattgatgtgcattggcatgctgtgctcatgatttttgatgctctccatgtggatgaagcctctgatcacctctgattgagtgattcttgaagcctgtgccctccaaatgcatgagtgaaatgcgccccgacttcctcatgaatgtgacaatatgtgcttgggtccaatgtagttgactccagtgacccatcagtggtgagccatctgtaagtgactccaagcttgccagctgtgcatcctcaatgctcttcaagacagtaaacacacggccacgcaacacatgttgcagctgatggtctcagacggcagacacatacgaagcatagcttggtatagacattggctagaggtgtctgtgagccgggagtgaccaggtgggtatcgttacactgtgttccggtgtggtgggcaagctc

SEQ ID NO: 656972 - DNA, 356 bp, Homo sapiens
gaccaactcgattgtgtgagcgtgggtcatactgtctaagtacgacttcatcgattacctacctattatcaatatggtgcttgaatatattcctataactgtagaacagtgtggaaagtgatggtaactttgaagtaggtcatgtatgattggctctggaataattgacactagtgtagtgttaatggtctttgcgtaaatgctaatggcttatccattggatctgcttctcttaacaagtctaagacgaatatgacctcattaaatgtgctgagatatttggaccagatacacatccagagattgaagcagtcccagctcatgggcttactgtgcaagccctgccgccttccgtg

SEQ ID NO: 656973 - DNA, 233 bp, Homo sapiens
tgaacgcgtagccccagtcataggatcacgaccgcgagtgaaccccgacgtacatcagccacccagcggaccgcatgcctcgccaccagtggctcgactttatggcagcatggtgtggcgagagctggctgcgctggtgatcgatcatgctgacaccccatcgcggcagaacggcgtccggcaagtgctaccactacatggccggcatgaaggctccaatctctaccacatct

SEQ ID NO: 656974 - DNA, 136 bp, Homo sapiens
gatggcgtaaccgaacttctgaagctcttgcacaacacatcccaggacttgtacacaaatctcgtatatgaagcatggttggctgcatcaagcatgcacactgcagtcaaccctatcatcacactcagcatgcaac

SEQ ID NO: 656975 - DNA, 290 bp, Homo sapiens
acgcagccatggctcgtggtcccaagaagcatctgaagcgggtggcagctccaaagcattggatgctggataaattgacccgtgtgtttgctcctcgtccatccaccggttccccacaagttggagagagttgttgccccctcattcattttgcctgaggaacagacttgaaggttgccctgacaggagttgagggaaagaggttgtgcatgcagggggttcattgaaaatttgtgtggcaagggcccacctgatagtagcccacccctggtgggttgacgggttgtata

SEQ ID NO: 656976 - DNA, 749 bp, Homo sapiens
  misc_feature (118)..(121): n is a, c, g, or t
  misc_feature (124)..(124): n is a, c, g, or t
  misc_feature (126)..(126): n is a, c, g, or t
  misc_feature (128)..(130): n is a, c, g, or t
  misc_feature (134)..(134): n is a, c, g, or t
  misc_feature (136)..(136): n is a, c, g, or t
  misc_feature (171)..(171): n is a, c, g, or t
  misc_feature (513)..(513): n is a, c, g, or t
  misc_feature (515)..(515): n is a, c, g, or t
  misc_feature (578)..(578): n is a, c, g, or t
  misc_feature (601)..(601): n is a, c, g, or t
  misc_feature (607)..(607): n is a, c, g, or t
  misc_feature (636)..(636): n is a, c, g, or t
cagttggtcaaggttgcagtgagctatgattataccactgcactccatcctgggtgacagagtgggaccctgtctcaaaatacaaatacaaatgaaatctcaagtcagaccagtcccnnnnagncnannnaggncnaaccacatagctgcatgatcgggtttgtgtggctntggatgaggagacccctgtccaattgttggctatgtaatcagtttatttttcaatatagtaatcaaatatatttcatcatacttgatggtctcagatatgtgtggattttggaattccccttggaacaggttgtaacatcttattggctccataattccataattttttaaatctgatcagtttttaataagatcagaattgatattagactacctaatcggttttgttaatgagaaaataaaattgtgttgtttgcattttatccaagatgggtgtcgtattggctaaatctcatcaatacttgaacaaatgcaaaattagagcttctttatcatgaaacncnatgtaattcttgaagaagatgccatttcttttttttctttttttttaagatagagtctttctnttgtcacccaggctggagtgcantggtgngattttggctcactgcaaccttcaccttntgggttcaagcaattctcctgcctcagcctcccgagtagctgggattacaggcgcccgccaccacacccagccaatttttgtatttttagtaaagatggggtttcaccatgtt

SEQ ID NO: 656977 - DNA, 231 bp, Homo sapiens
gtgcctgacagcgagctggggacaaaccaccccagcctttgagtagtcgtcacttggtagctttgtattcaccccttcccaggagggtggtttagagcagacccatgcattgagcttcctcgagctcgtactgcctctccagggataactcaggcaggctgaggtgctcctaggggctcagctgttagtgaataaactggggaccctgttgagaaccacttctcttcttct

SEQ ID NO: 656978 - DNA, 908 bp, Homo sapiens
  misc_feature (118)..(121): n is a, c, g, or t
  misc_feature (124)..(124): n is a, c, g, or t
  misc_feature (126)..(126): n is a, c, g, or t
  misc_feature (128)..(130): n is a, c, g, or t
  misc_feature (134)..(134): n is a, c, g, or t
  misc_feature (136)..(136): n is a, c, g, or t
  misc_feature (171)..(171): n is a, c, g, or t
  misc_feature (513)..(513): n is a, c, g, or t
  misc_feature (515)..(515): n is a, c, g, or t
  misc_feature (578)..(578): n is a, c, g, or t
  misc_feature (601)..(601): n is a, c, g, or t
  misc_feature (607)..(607): n is a, c, g, or t
  misc_feature (636)..(636): n is a, c, g, or t
  misc_feature (905)..(905): n is a, c, g, or t
cagttggtcaaggttgcagtgagctatgattataccactgcactccatcctgggtgacagagtgggaccctgtctcaaaatacaaatacaaatgaaatctcaagtcagaccagtcccnnnnagncnannnaggncnaaccacatagctgcatgatcgggtttgtgtggctntggatgaggagacccctgtccaattgttggctatgtaatcagtttatttttcaatatagtaatcaaatatatttcatcatacttgatggtctcagatatgtgtggattttggaattccccttggaacaggttgtaacatcttattggctccataattccataattttttaaatctgatcagtttttaataagatcagaattgatattagactacctaatcggttttgttaatgagaaaataaaattgtgttgtttgcattttatccaagatgggtgtcgtattggctaaatctcatcaatacttgaacaaatgcaaaattagagcttctttatcatgaaacncnatgtaattcttgaagaagatgccatttcttttttttctttttttttaagatagagtctttctnttgtcacccaggctggagtgcantggtgngattttggctcactgcaaccttcaccttntgggtgcctgtaatcccagctactcgggaggcagagaatcacttgaacccaaaaggcagacattgcagtgagccaggatcgcacccttgcacttcagcctgggcgaccgagactccgtctcaaaaaaaaaaaaaaaaaaaaaagccatgtgttgtggcatgcagctgtagtctcagttcctggggtggctgaggcgggaggattgtttaagcctgggaggtcgaagtttctgtaaactctactgccccagtgtactccagcataggcgntaa

SEQ ID NO: 656979 - DNA, 474 bp, Homo sapiens
gtcctcgccactgagatataataagaaggctaatgctctttttctgtcacctatagaccacgccctcttctattaaactcacatggtgagccacatatgtgagcgccgcttttacgcgccccacaaaaaacacatatacttaacacatttcacagaacacatatatcccacaagggagaataactcaccacattttgttataagagaagttgtaagaactatatgagactggaggtataacccacatgtaattccctctatcttttaactctttttttctgtgaacacatttaatgttctcacatgtaaatttgcacttaacttctggtggagattgtttctagtaactgtatattgggctttctttcgttaaataagagattattttcacatatactataattgtaaataattttgataaccaatagtttataactctagggatataaaaaccagattctgattccccttcca

SEQ ID NO: 656980 - DNA, 766 bp, Homo sapiens
gagacacttggggtctggacgcaacggaggcgggagcgtgaacgcccctccagccttcgagtcgtctggctcttcgagggcgagaagaagatcaccattaacaaggacaccaaggtaccaagtgcctgttatattcaccatcaacaaagaagaccacacatgggaaacatcattaaatcacagttgttgacctaaaggacccgcaagtgctattgctagctacaaagtccccccacccctgtggagcacaagatcatcatccgagtgcagaccaggcggacatacagcccccaggaagcctttacacaacgccatcaccgacctcatcagtgagctgtcccgtgctggaggagcgcttccggacgtgccatgcttccccttcgccttctgccgtgatggtcagtttccctgaggccctccccagccacactttctgtacagccgtgagaactgtgagtcaattaaacctcttttcctccaaaaaagacacaaacgacaccacacaaacaacaagcggttgtggggagcggcactcgacgccccgaaaaaaggcttataacaccccaccggtggacgccgccgccccaagagagggaaggcggaacgtggggcacgcgggggcccagagagagcacccgcggcacgcacacgggggggagcccaccaaataaaaaacccgcggggaacggacgtttggaacaaaccagaagggcccggaggcacacgggcactcaccgggcccggaaacagtaagcgccacgaggga

SEQ ID NO: 656981 - DNA, 1028 bp, Homo sapiens
gggccagcaaagcggcggcgcaagagtcccgccatggaccgatctcacccgaggacccccagttccagaatgctgcagcaatgtgtaccgcagatgcaccgctccgatgctgaacctgcgccagccatcttcgcatgccaacaatggacctgcttcaaccacttcatgcttgaccctcgaacaccgaaccataggagcactatacctggtggcattactaccaaagaacctggctgactggcaggacgtgatgctggcatgctggtggacattggaccaatgtccagggcgcgatggcaggccgcacctgggaagacggatgtaacacatggatgcagcaagatacaacgtcacaccagcagggatcgcagccagtgactgcacggtatggctctagcggacaccaggatcacaacacaccgcatacctggtagcacgagcacaggcatgtagatagcctacgagagtcaagcacaggcttctgagacaaagactgacagatctatacatagcacagacagtgatcacggaagacggatgcactgcacaaggaggataccacgagagcacagcacccatccacaggcacgatccaatcacacataagcgcactctgcgacgtgcatccagaacacatgagagcaacacacatccatgcgatgacgctgacaagcacattaaacgacaagtacctcatatcaagagagagatcacaccgacgatactaggatatagtacaaacaaaacaatagactgcgacactacacaataagacaaaaaaaccactagacaccagactgaaagcgcccagaagatccatacccatgaatacatcacatagaccataccaaagcagccacatgaaacccaaagccccagagcaacgaagccaattcacacagaaaagtgcaagagcagacacgggcccgaacacaggaagagaggacaaacatcccaacggacggcagccacaagggaaataccactatccatgcacatgttggacgaacagcaacacgaaggaacac

SEQ ID NO: 656982 - DNA, 192 bp, Homo sapiens
atctcgacctctacgcccacgtgtgtatacacatagcacaggttagtgagcgtgtatagtacctgtacctccagtgccgccccgagtgttaatgcctgccccttccttataagtgacttatctatcaagtgtgaggaccccaactacagtagccaaaatcagcttttccgcttgatcttggaacatgcataa

SEQ ID NO: 656983 - DNA, 1902 bp, Homo sapiens
  misc_feature (997)..(997): n is a, c, g, or t
gccgctaacactgatctgtagaaagcgtggttatactggtaccatgcactcggagaatggtcttcagaatgtaagatatggtgataagataatcgaggatggtgagtcgagaactcggaaactgaggagtaataggtcatctccgtatacgacgattgccctggctgatcggaacgacatcgaagtgtgaactgtggcgcatcgctacaagagctgatgatgctcactccacggtgcacagacaaatactgtcctatcagccctgccaagagctcgagggcacgctgaaatgacctggtttactatatgttggtactctactgcttgtgcttttctatctaggaggtgaacgattgccactttcgcactgttgaagaaatgtaggctacgtaggaaaccttggacgttgaaagaaccccttcgattggtgtgtagtgtttacggcgtgggggggacaacccaatcacagtgaagggggacataggctacttgtactccaatccgagcgcaatagattgcaaacgaaatgggaacgcaaagagtgtcgcgcttgcccaagacacttgctgggcttcctacatagacctactagtggcaggatagccggcatttcctgaagaaagttcaacatttacggaaccttcgttccattggggggggggtaggtagcagaccatacggcaatttcgccaagacgttgccgaataagcactttcggacctcaatccttcaccttgaatgtaaacagtggtcttggtgtcagcgcacgcacgttcacgaaaacaaccacgaagattctcatacaacacattgaaattaaccctgttgaaggagggtacattaagtaagttgtcaagagaagaaacaagtgactcgttggggcgtcatacatatgaacgttaccacgtaggatgggatgtccagatacagggattgatcgttagagatctacgggacacgtgattggaacctgaggactccaagagaaactaggacnccccgcaaaggcaacattggacaccagcgacaggaaacggcacgctcgcgacaaagagacgtaggactcgcacaagtggtccgcacaacggtgctacatagaacggcacagggctgcgacacacactagaggacacccgcgactaattcaacatcaacagaggaagcgacatccaggagaacaacagggaggaagcacagagagccaacaaggaaaagacacagaccacaaacgacagacacacgagacaagagtgggcacaggaaaccacaaatagaaacagggcagagaaagcatacagccacaacagacacccgaaaagatgagcgaggaagaagtcagacagaacagacaccacaaacaacgacaagggaacaaacaactatagaagagccaatgagcaccacgatgagcagaaaccaagacgaagtgacgcacaagacagcgagaaagcgcccagaacaataacaaaggtgactacgacgacaatagcacgactaaacatgcgtgaacaaacaatgaacgacacccagaggcagaacacacaccacaaggcaaacacaacatacagagacatataaacaagcagaagcaggtgaagaagcagagcaccagccagacacaagaaggaaacaagggaccacgaaaacacagcagagggagcacacggggagatagcaagcaggggagcagaagacgcacgacggcaacaggcacaagaacagaggagaaaagacaatagcagcgagcagcgagcacacaaacgtgaccgatgacaaggagcgcaacgccaacacacatagaacgatacaagcgacacaaaggacacacaacgacgacgcacaaggaaagcaacacagtaactcacaacaagacgaacacacaaggacaagacgcaagacaga

SEQ ID NO: 656984 - DNA, 220 bp, Homo sapiens
tgacggaatcgttcagctaactgaggaacatgattgtacctaagtcaaagataagtaatgcagtctctccatgagaacttcacatgtcatgatattatctagaggataaggatccattattttagaagagagagatcaacaactttgtatattattttttaaacaagtaatggaatctggcaagcagaccccactggcactaccttaagtacatggttgg

SEQ ID NO: 656985 - DNA, 839 bp, Homo sapiens
agcgggctgttcaagcctgggtcgttccgggagctgccgacggagcggagcgcccccggcgctgctgaagctggcgtcgctgccggcctcgtgccacgcaccgcgcacgacgctggagacaggaggagacgccggatgtgagcaccaccggcgggaagggtccgcgcgcacatggctggctcgctcgacgcccttgacccaccgactgtccgggaaacacgatggctcgccccaaacaggatttagcgtgaaaccagccgcaaggattccgggccaccacccaaccgagacccacgcggcgccgggggactgacttcgagtggaccgaggtcatgggatctcgccgagacgcacaggatctcagggacacctgattctgcagactggtctgcagagcccaagtcgcccgacaaagcgggcctgggccgagacgcaggtttcacagagcgcactcgcacagagtcgtatttgataactgcacggataaaagcttggcagggaagcgatatatcacgttcgtgactcacgacgttaaggtggcattatacgaacgtcgcgtaagaggccaagggaaagccgtgaaccacagtttatgcgcgcgcggcccaatgggatttccctcagtcccctaggaccctggagacgcccaggggtcgtccaaaggcggtgcgcagggccacactcgggaagaaacagggaccaccagggctacacaaacagagaaacaggaaggagcttctcccggggcacctgaacgcatggatagggcaagcctgaggcagccagagaagggttcagcgcccaggggagggtgaccccatgggcatggggttgacgag

SEQ ID NO: 656986 - DNA, 122 bp, Homo sapiens
acaaaaacattcctgttatcgaggctgctcgaaacccacacaaataccgaatgctcatcgcaatggtggatctgatctatgctgatgtggcccagccagaccagaaccggattgtggccctg

SEQ ID NO: 656987 - DNA, 176 bp, Homo sapiens
acgaaaggcgatcctggatgagcaaggacgcgggggagcatagatgatccgatccgcgccgacgcgctgttccgtgctgctgctggtgctgtgtgctagtgttctgggcgtcgctgaggtcgaggcagccctgcgagcaggacgagatccagcgcctccccgggctggccaagcag

SEQ ID NO: 656988 - DNA, 148 bp, Homo sapiens
ggacttgcatgggttgtactctgcgagcagtcagtatatttacgctggtagcaaccacgctgtcaagtcaggtcagagcaatgccagcagacaccagctccacgaacacatccagcctgggagatcatcatcgcacagcctcagcagg

SEQ ID NO: 656989 - DNA, 246 bp, Homo sapiens
  misc_feature (146)..(146): n is a, c, g, or t
atatgtcaccaatctgccaagaaacagcctctattggtgtgcatgtggaatttgaagccacactcacctttttgcatctctgtctcccccatcaacattgcatccccaatactcataggaagggttggggaaatacacaagctatnaggaagaaatgtagatcccactgaagatattggacagaagatcaaagtttttatatctatatctaggtacgttttttccacagtacggggtaccgagctc

SEQ ID NO: 656990 - DNA, 617 bp, Homo sapiens
agcgggcggggctgctggcggcggcggcggcggcagcggcggactccggcccctagatcagacattctctctcattacccggcgcgtgggaacgggtccacaggccaccttggtccgccctagaacccccatgggctgacgaccgccgccgagtcggatgacaccacaggacacggtcagagataagcgcagcacccttcactgacacttgctcacatctcttacctccttgtacatttgtccctgttctctgtccctctacataccactcatgcccatactctgtccccttgacttagcccaggccactgctactatactcgcatccctaatttctgcactcttgtactgtctactcctaattcctatatatccttgtagcatcacataatacctgtacacgcttgtcccattcttcctcgaatctaccatcacctaagatccatcatgaccctaaatctctggatccccataatggaccaatacgcttaccattttgctctggatgtaatcgtattaccacaccgttcatctcgcagcaagctggcacgatagaatgcaacgcccaattactggagttccgcattctgaagacctagacaccaatacacgacgac

SEQ ID NO: 656991 - DNA, 304 bp, Homo sapiens
ggaagcttttggggggcccctttgcaaggggcaaaattccttgccccagcagggtgccccaccaagatagcaaaagttggaaaagagccggctggaaaacatatcccctgggtggaaaacccctccccttgaagatcgagaaccaggccttttgggtcccccataccggttatgtcagggtaggacccttcctgtttacaggagactatgaaacccctgccccgtcctcccttggggctgcccccattttaggccccagcccccccccccccgggggctctttaaaacggcatgttgctcccca

SEQ ID NO: 656992 - DNA, 100 bp, Homo sapiens
gagccatggccgccgagccctcctgctcctgcttctgtcttttcttgcggcctcgggcaccataggccttccgcccggccttaagggcccttgcaggcta

SEQ ID NO: 656993 - DNA, 648 bp, Homo sapiens
  misc_feature (36)..(36): n is a, c, g, or t
  misc_feature (97)..(97): n is a, c, g, or t
  misc_feature (99)..(99): n is a, c, g, or t
  misc_feature (103)..(103): n is a, c, g, or t
  misc_feature (108)..(108): n is a, c, g, or t
  misc_feature (113)..(113): n is a, c, g, or t
  misc_feature (115)..(115): n is a, c, g, or t
  misc_feature (132)..(132): n is a, c, g, or t
  misc_feature (139)..(139): n is a, c, g, or t
  misc_feature (173)..(174): n is a, c, g, or t
  misc_feature (197)..(197): n is a, c, g, or t
  misc_feature (201)..(201): n is a, c, g, or t
  misc_feature (204)..(204): n is a, c, g, or t
  misc_feature (206)..(206): n is a, c, g, or t
  misc_feature (216)..(216): n is a, c, g, or t
  misc_feature (218)..(218): n is a, c, g, or t
  misc_feature (225)..(225): n is a, c, g, or t
  misc_feature (231)..(231): n is a, c, g, or t
  misc_feature (233)..(233): n is a, c, g, or t
  misc_feature (238)..(238): n is a, c, g, or t
  misc_feature (262)..(262): n is a, c, g, or t
  misc_feature (296)..(296): n is a, c, g, or t
  misc_feature (303)..(304): n is a, c, g, or t
  misc_feature (332)..(332): n is a, c, g, or t
  misc_feature (336)..(336): n is a, c, g, or t
  misc_feature (341)..(341): n is a, c, g, or t
  misc_feature (351)..(351): n is a, c, g, or t
  misc_feature (353)..(353): n is a, c, g, or t
  misc_feature (386)..(386): n is a, c, g, or t
  misc_feature (394)..(394): n is a, c, g, or t
  misc_feature (399)..(399): n is a, c, g, or t
  misc_feature (402)..(402): n is a, c, g, or t
  misc_feature (411)..(411): n is a, c, g, or t
  misc_feature (413)..(413): n is a, c, g, or t
  misc_feature (415)..(415): n is a, c, g, or t
  misc_feature (453)..(453): n is a, c, g, or t
  misc_feature (471)..(471): n is a, c, g, or t
  misc_feature (502)..(502): n is a, c, g, or t
  misc_feature (648)..(648): n is a, c, g, or t
tactgctgaagaccaaatcccttgccactctttcgnttgctactaattcaaacgcaaacaaaaacaggaaaaaacaacaggagcacaaaagccagcntntccntttcnttatncnatggagccaggtgccanaagtggnctggtccatctccctcctcagcctctgccaaaannctgctccaatactcccctcattngaantantnaaccaggcgntntaaaacnaaccanantccantaaagttgaccaccctaccgaganaaaccaaggctcacaggtgaaaacccctttcaanaaaattnnttccaggtaggaatcaaaatattatgcntttnccatnttccgggttntnctccatgggacattagggacacttcagctttcntccattanttatnttntttattgcntntngggagataacatggccacaaatgagctttatgggaggnttggaatctgacgtctgntggcggaggatggggcaagcgaacacggagngttaccagcacttcatgcctagttcaatctcaatcggtaactcgtccttgtgattccagaccccagtgcactgccgctgctcaatcacagccttgatgttcatcaacacaggcagcgccacacagccagaggcaaagctgacgctn

SEQ ID NO: 656994 - DNA, 240 bp, Homo sapiens
ggggggggggggcccccccccctttttttgcccctttttgggggccccttttttttttaagcccccggttttttttttggccccttccccttttttggggccccttcccttttttgggcccccttccctttttttacccttgcgccgggccggggccccccccccctccccccccccaattgtgggggggggggggtttttttttttggggggggcccttttttaggggggtgggattta

SEQ ID NO: 656995 - DNA, 215 bp, Homo sapiens
  misc_feature (19)..(19): n is a, c, g, or t
gatctagaggatcccttgntggagacgggggtctcactatgtacccaggtgggtctcgaattcctgggctcaagtaattctcccaccagggtcccccgaaacactggaatcacaggtgagagccaccacacccagccctccttttctttctttctgttttttttttggtttgggtggtagagtggtggatggtttttgggaaatgggagtctaac

SEQ ID NO: 656996 - DNA, 737 bp, Homo sapiens
ggcagtgctcagccaggagtctctagacagcctctccccaggcgattgcagttactgtggtggccgaggaagatgcaagactggaccgatagagctgggggaacgtcagggcgttctggctagcttttgtgtcccgacaccagaagggtcccccatcccaccaggcctgctccgttggagcccagctcaccttttggtgctaaggtgctggggagtcagggaagagcaccatcgtcaaggcagatgaagatcagtccacgaggatggctactccgaggaggaatgccggcagtaccgggcggttgtctacagcagaggccatccagtccatcatggccagtggatcaaaggcatgggcaaccgtgcagcatcgactttgcgcgaaccctcctagagcggacgaggccagggctagctatttgcactgattctgcttcgccggaggagcaatggcgtgctccctgatgacctgtgccggcgtcgatccggatgggctctggggctgaccatgtgtgtgcaggccctgctttggccgctcaaggggaataccgagactcgaagcgacgtccagctgccttactagcctgacacgaaactgggagcgtatctgctacagcagtggacttacgattctcccacagcagcaagcatgttgctaatcggaaccccgcggtcaagagaacccaacgggggcactcgtgggagaacgaccactatcagcctttcaaggcaaccta

SEQ ID NO: 656997 - DNA, 1167 bp, Homo sapiens
  misc_feature (432)..(432): n is a, c, g, or t
  misc_feature (439)..(439): n is a, c, g, or t
ctttataggaagaaaatatgggaattggattacacatagatgatgatgtttatttaaaaaaaaaacaacagcaacaaaaatcctagcctccagttgccttttcctttctttagctcctgtttttggtgaattgctaaactgattgactttcagcctgtttaggcgtagatcctgagaggctatttgtcttacgagatataccaacatcctgaaagttaaagaaaaaagtctaatgtatgaatgtgacgtcaccgaatttttatcaactaattcctgtttattttatgtagaagggcagtactaggggattaagcgaggacttctgtttacaatggtaaatctgaaatggaagaaacagtctttaagccttgtgtgtctgtgatctcctctgtcttaatccacgctcaggctaaagatgggataatgtgaaanggcagtngtcccgaggcgtgggtgggggtgcttctgtgcctcacgggtccctggtgcaagatgtccctaggctaacgtagcatggggtggggggctaggggaccagggctgggcctgatccacctacctggtaactccagatattattgccaagttggagacctaaaagtaattctcttgtattttggagatgaatgaacaaagtcgattcacctgggagggattctaaagcaaagcatgacgactaagtattacctcgcctcttgccagaactcctactgtcctcacctcatcgcatcactgtaaaagtattacgtcgtgcattaaagaccagagaggacttgcttttacccagggaggggacattgcccccaatcctgtggtctgggcagtttgccttggttggatgtttcggggccttttttccaccatgggaatttctcaactctaggtctaaggcagtgaacactgggcaaccctctcggttccgaagatttcccttcggacgggccaggaaggatcttaagggcctgggtgtgcggactgcagtcctatggtggacgggcccactctgctgttctcaaaggggcattcaaacacgaaccggttaagccttcagcccttttgcaacaacagggggctaatcccgatagacaaaggggccttcggaagagtacacacacaaagtctcaaccatcacagcaacgacacataaaatttcgtacccaatacaag

SEQ ID NO: 656998 - DNA, 311 bp, Homo sapiens
tcccccatctagcttacaactcaaagcgacctggcggtgcttcagtatcctctagaggggcagctccgccgcgcacggagagctgcccctcttgtacgcccctgctttctaagctccaccctgtggctggggaaaggaaagtaagagaccacagggacaatttcaagccccccagtctccacagggagctacgttctccctggctacctgcctggctttctctctcctgggctaagagctgaggagatctgcggcgctcagtcctggacctgaagtattctaaaaccctgctctgtggctgtctccagagc

SEQ ID NO: 656999 - DNA, 406 bp, Homo sapiens
caacggaactcggaaaaacttaggcccgcagtgattaccaaagaacctcagcatctagacatcaccagtattataggcaccgcctgaaaagtgacacatgtttcactgtgccgcggaaccctaattcgatgcaaggtagcataatcacttgtaccttactacagggacctgtctaaatggctccacgagagtactgctgtctcttacttataaacctagagaaattgaactgcccgtgaagaaggcaggcatgacaacagcaagacgagaagaccctctggagctttcacttaataaatgccaacagtacctaacaaacccacaggtcctaaactcccaaagctgcattcgaaattacggttggggcgacctcagagcagaaaccaacctccgagcagtaaatgct

SEQ ID NO: 657000 - DNA, 146 bp, Homo sapiens
  misc_feature (23)..(23): n is a, c, g, or t
gagtaggtactaattgttatctncatttcacagaagagcaagtcaggcctccgagcactaagtgacttggctgaggtcaaactgcctgcgagttttatctaattagtgacagagagaacctaatgtgtcgcagcatagaatgtcag

SEQ ID NO: 657001 - DNA, 526 bp, Homo sapiens
  misc_feature (432)..(432): n is a, c, g, or t
  misc_feature (439)..(439): n is a, c, g, or t
  misc_feature (483)..(483): n is a, c, g, or t
ctttataggaagaaaatatgggaattggattacacatagatgatgatgtttatttaaaaaaaaaacaacagcaacaaaaatcctagcctccagttgccttttcctttctttagctcctgtttttggtgaattgctaaactgattgactttcagcctgtttaggcgtagatcctgagaggctatttgtcttacgagatataccaacatcctgaaagttaaagaaaaaagtctaatgtatgaatgtgacgtcaccgaatttttatcaactaattcctgtttattttatgtagaagggcagtactaggggattaagcgaggacttctgtttacaatggtaaatctgaaatggaagaaacagtctttaagccttgtgtgtctgtgatctcctctgtcttaatccacgctcaggctaaagatgggataatgtgaaanggcagtngtcccgaggcgtgggtgggggtgcttctgtgccacggtccggcnaacgtccctaggctaagaagggtatgctctgatcggatcctta

SEQ ID NO: 657002 - DNA, 135 bp, Homo sapiens
ctactagacccactcgaacttgccagtactcccagtatcgcagacccagctctgatttgtgaagaaagatccccagacgtgtctatgaactctttggctctctccaggcaggtggtggagaagtgcgcctgggtg

SEQ ID NO: 657003 - DNA, 101 bp, Homo sapiens
aagctgtgcgtggtcgtctagaggtcccgaggtggacacggggagagctgggacacgggctacttctaggtacgaccacatctacaacgttatcgtcacag

SEQ ID NO: 657004 - DNA, 946 bp, Homo sapiens
  misc_feature (653)..(653): n is a, c, g, or t
  misc_feature (716)..(716): n is a, c, g, or t
  misc_feature (721)..(721): n is a, c, g, or t
  misc_feature (726)..(727): n is a, c, g, or t
  misc_feature (731)..(731): n is a, c, g, or t
  misc_feature (752)..(753): n is a, c, g, or t
gtggaggtcaggatgtgtctcatgctgctcatgttaagactattaacacatgatttgagaaataagtttactctagaaatgcatatgtagtcctgaccatcactagctgagagcagactattgatttccagctgtagatgtttcgcactagccatgttcgtgttgacggtcgtagttcacctgtatggaattctaccgaatcagcaagatctgattctgcaggacattaatggtaaaactagatcatcctttctaacagacgagttcatgtgatcctgtgacgggcctttgcactaggtcggaatgcagtatgtgccgtacgacatgaagtttttgaaatttcattcgatcccagatgtggtacaagtatttggccaaagctcattatcgctatgtgtcaccgctggcctgctcctggatgatgtgcctgatcagtcgtcagcagttgttgaacagggctattctttttacaaggtgtgaagtgtggctcttcggcttcgtctttgccatggcattaagagagaaagttccctgtcttctttcaatattagttatttcaaatgaatatgtgctacttaaaagcttgtttggttgtctttgtatataatttgccttggatttattgtgcacagtttgttgagttgtatgttttngtgaattatcaggagtaaatttgacaagtacatgtgaataactcctgtaaatgaattttatancaaanatgtnntganctattttttaaagttgtgcannttagcaatttctcgctatagctttgacttttctatgctgtgaattaatagctgcgatttggcaaacagtcctgttgtctttgttaaaccctaatttttaagaggtaatggcagttttttagcagaaacaagaagatggacatggattaaaggttatgtattataaagtaaaaaacaaggtaataacatcaaaa

SEQ ID NO: 657005 - DNA, 107 bp, Homo sapiens
tcgagctcggtaccggtgttttcgatgccccagatcttctgtgggcatgagtgtggctggtggcatctctggcacggtggctgctgtgctgactcttccctttgact

SEQ ID NO: 657006 - DNA, 261 bp, Homo sapiens
acggactccccttgccttgtaccgggggggggacgacgccgcaagacagcttccagagtgaccacagttcttttgttcttttcttttcttttcttttcttttctttggagacagagtctcgtcctgtcgcccaggctggagtgcagtggcccaatctcggctcactgcaaggctccgcctctcgggttcgtgccattttcctgcctcagcctcgcaagtagctgggcactacagtcgcctgccaccatgcccggtcacatg

SEQ ID NO: 657007 - DNA, 248 bp, Homo sapiens
tacaatttctacaccgactgtttaattgggacagagtgtcagttttgcaaggtgaagagttcggtggatggatggtggtgagggttgcaagacactgtgaatgtgcgtatatgtgccacagtaactgtatgctgaatacagtaaacatggtacatgtagtgttgatgtatatttaagcacaatttatattttaattttattgttttgattttaccttacgttctgggatacatgtgtgtgaaatagaa

SEQ ID NO: 657008 - DNA, 332 bp, Homo sapiens
ttagagatctcgggagcttaccttggtacagacagtactagtcatggctgttaggaacaggctgcacagaggaggtgagtggctggtgagcagtgaagctgtcagtgttatagccactccctattgcttgcattacctgctgaacttctcatgtccgatcagcagagacattagatcctcacagaagcatgaaccctattgtgaactgcgtgtgcaagggatctagattgtacgctcctcatgagaatctaatgcctgatgatctgtcactgtctcccatcacccctagatgggaccatctagttgaaggaaaacaagctcagggctcccgg

SEQ ID NO: 657009 - DNA, 225 bp, Homo sapiens
tgtctcactaactgtaaattttctgagatagggctcactctgtagcccagactagaatgcagcagtgtgatgtcaggtcactgcagcctccattcttccagggaccacagtccaaaatacaccatggctgggctattttttttggagaccagcatattaagggtaaccgagcttggaatttcgtacatcattggtccataagctagttttccctggtgttgacac

SEQ ID NO: 657010 - DNA, 479 bp, Homo sapiens
cttaagaagcatcctgagtcaagtgattctcctgcctcagcctcctgagtagctgggattacaggcatgcgcaccacgcccagctaattttgtattttaggtagagatggggtttctccatgttggccatgctggtctccaactcctgacctcagctgatccgcccgcctcggcctcccaatgtgctggaattacaggcgtgagccactgcgcccagcccattttattgatacacattcaagtttaacacttacgaatttaaggactttatgccttggaagcagtacatgacacctgagacaacttttcaaaactatcaactgaatcatctttcattatctcagatatgcctaacctcagtctcttctttttttcttttggtctgagcacggaatttcgctcgtagcccaggtgggagtgcaatggcgtgatctaggctcaccacaacctctgcctcccgggttcacgtgattcttttg

SEQ ID NO: 657011 - DNA, 1456 bp, Homo sapiens
ggaggcattgagtgcagccagctgcaggggcttctgctgagggggcaggctggagtttgaggaaaccgcagataagttatattctctttgaacagatagagattaatacaattacttaaacacatatagtcaataggtatactaagatatgtgcttagctgtacgtttaaagcgtaaattttaatacgcttaaagatttacggacgaccactattgaagactttagaagatgtacgctctgacggaacggaaagcgatacacagcgtgtcctaaacaccattgactgagacggttcgacgcattgcaagcctgtcttccacttggcagttaccaccactgttgtattttaacaaacgaacaactttggacgcagaaaacgggactacaagaagcccccgaaatataagtacccaatagaaaggggccaagttggttttgaggatttacaaacttggaggcggttgacttttaaaacatggcttaacagcggtgtgacgtctcaaacactgtttggacaggggtagattaacaacaatgaactttgtggacagcggcgattcctttttaaacaacaggcacgatttcaaacgcggaagcgttgactataacaaaaaggagctcttttgaatattttcctaatgttggagcgggctaggggggagatcatcttggggcggtccacattgtaaagagagggccattaggtttgagcgggccattttaacttaaaatagtggccgagcgaactggaaaactgtgcgagacaggattttaccttttgggatcaatgcttggtatagtgaagttgaaacacccaagcttgtgggacgaacagtattagacaggtttcggaaatggtgtggcacacacaacgtgggagaagtcacgagaacatgttccggggtaaagtgtcgcacaatcaacaaggcaattggacacgcacgccttagcggcaaccctttcgcacacgcacttcacgaacagcattcacttttgtgagcaaagccacaacacgtatatacattttatcagtctgtgaagatcaccatcataactgcataagacgtacaacaacacctgttgttacggtcatcacctgctcctcgagacgaacgttctaagcaacccatgtgatgacggcgcggcgcccacgtaatgaactcgaacactcgcgcatacgcgtccacaagacacacacgttcgccacgaatgtttgtgattcaccaataaaaacaccggtggacaacggcttgtaacaccacgagttgggccctatggacaacaggacctttagcacatcatcacgaccagcgtgctggtaacagcatgactaagtaatgtgcatgacagcagttcactgccacataactcgacagttctattcacgtccatgccactcaagactgcaccgtgactcacctcgtccagtcacattgcatgatgtgactctgcgac

SEQ ID NO: 657012 - DNA, 191 bp, Homo sapiens
ctggaaaaaatttttagggaagggaaaaaactttggatttcccccctttgaaagggtatcattttagcccctttttaggggggcagattcatcaaacccccatttaaaaaagtttaatttaagtcttttaaagccttttaaagaacgatttttttctatttggtggcaaaaaaaattttggttggtttgga

SEQ ID NO: 657013 - DNA, 261 bp, Homo sapiens
tacgatcgcgacagcgcgacatcgtgcctctgcagatcaaagtgcagcgcgagcagagccagcgccagagcgacaaggaacaaccggacacgctctggaagatcgaactggctttcgatatccagcctctgggccccttgcaggtccaggcacagctgctgcgcggcagcctgtccagccagctgtgggccgaacgcggcgaaaccgccgagctgatcgccggcgaactcgaacatctgcgcgaacgcctgcaggccgccg

SEQ ID NO: 657014 - DNA, 259 bp, Homo sapiens
cagaagaagaagaaggcacaggaggatctctaaagcagtcgccaaacaccactttgtcaaaagactcttccatcagacatgggaaaaccatcgcggcggactaggacccatatgggaattattacctcctcagggccgagaggccagaatggatataatctgaatcctgttcaattttctctaaactgctacttagctgcactgtttaatggaaataccaggaccagtttatataggtggtttatgggaacaattatat

SEQ ID NO: 657015 - DNA, 82 bp, Homo sapiens
  misc_feature (35)..(35): n is a, c, g, or t
  misc_feature (69)..(69): n is a, c, g, or t
  misc_feature (71)..(71): n is a, c, g, or t
  misc_feature (81)..(81): n is a, c, g, or t
cctaaatgcttactttttaagcatttacatttaanaggtgaacatatatatagaccacttatactttanancccaaatcana

SEQ ID NO: 657016 - DNA, 339 bp, Homo sapiens
gcccccccctttttttttttaaatgggggcccgcaacttttttaacaaagattttacttccgggggaatcccaaaaaaagggtttgggccttttttttggggggggtttgctatttttaaacttgggccaaggcccaatgtgggggggtagaggggattttgttccttccccccgcccctttaggggagggaagaaaggttcatttttaaggtggggggccagaggggggggggtttaggggagggaatccgggaagttcaaatttaagattgggggggggggggccattgggatgggccttttcccgggtcaaaaaaagaaaaaagcctttttaacca

SEQ ID NO: 657017 - DNA, 239 bp, Homo sapiens
cgcaccatcctactttctgactactctgggaacctcatacaagaggaatcatacaatattgtgtcctttcgtgactggcctgtttcagcgcaacgtattcaaagttcatccatgttgtaacctgtcaggatttccttcagcatcttaaaaatataatttgaatatagtttttttttttttttccaggaacccaccatattttacaacccattacaaagttccatacaattctgccacat

SEQ ID NO: 657018 - DNA, 413 bp, Homo sapiens
  misc_feature (153)..(153): n is a, c, g, or t
gaaaagccgtcttagcatggttcctcatccgcctccttgcccgccggcagatcgctctccgcgcgcgcgcctcctccgccggcgcggactccggcagctttatcgccagagtccctgaactctcgcttgcttttgaattcccactgcatcgangatcaccggtcgtggcccacaccatgtcaagacgccagcccgtaagacagccaagcgtccgaaaattcagccaggcagaggaacttaacacggacgaacgaacgcgaacgcttgtgggacagaaggcaggacaaatggacagagacgccccatgctaaaacgggcaatggcttacatgcacggaacaattggcggaacgcagcgcaggcttgaacaattgcacggtaagaccgaaagcaaagaagcgccagacaggttag

SEQ ID NO: 657019 - DNA, 366 bp, Homo sapiens
  misc_feature (355)..(355): n is a, c, g, or t
atgagcactgtgccggcccatgttaaccatttttaagtgtatagttcagtattgttaagtacttgacattgttgtaaagaactcttaatcttgcaaaactgaaactaaacccactaaacaacagctcctcatccccactcttccagcctctggaaccaccactctactttctgtctctctgaattcatctactctaggtccctcatgtacatggaattaatattcatatttaaagttagctttcctaataatatagtatctttgggtaatataaactcagcttcttacaataaaatatataggttgggagtatattttataggttttgttaaactaaagaaaaacaggaagggtnggaactcctta

SEQ ID NO: 657020 - DNA, 857 bp, Homo sapiens
  misc_feature (386)..(386): n is a, c, g, or t
atgtttttggtttgtctgtcgccgcgcatttttttgtccttgtgtctccgatctctttccctctcgctggtggttgagcagctcactctgcataaggatggcgtcgcgtttcgtttaataccacagcgtggtggccgctcacagcacctctcgtcttctaaatgcggtaggtggaggcgcgccccactgcgtgctcgtcggttgttggtcgtcatcagcgtgcgtgatcttgccgcttctcctgtctgcgtcttcagcgcctcgtcaccgcacgcgcacagccacctaatctttctggttttgctttcttattaattctttctggtcggagagaatagataatgttgcgctgggccgcgccccgaagatgagatttgttcgcgcgncgttttctccctcactagtgcgttgcgtgccggtcttctctgctcttctggctgggagatagatcaccaccacatttattttgcgggctctcgctattttttctctctcttttggaattttttgcgtgcgcacctcagaagacgcactcgctttgggtacacaacatctctggttgttgatccacccaccacgatgatgttttcttcttcatactcctcccagccgcctcgtaggggcggtgttcttattgtggggctcgccccatatttatgatgttggtttctccccctgtggaagcacggagggttctggtggttagttgtggaaatgaagttagaggattctgccatcccgagaggccttccccccgcgtccccccctatttttgaaacccccccccgcggttcgccttttttaaagagggggttttttttttttttttttttccccttttttttagggggttttta

SEQ ID NO: 657021 - DNA, 577 bp, Homo sapiens
  misc_feature (430)..(430): n is a, c, g, or t
ctgaagtgctcctgctccagctccaggcagctctacacagagagggaaacactcatggtttggggggaagtaaaggaaaagtctgtacctggtaatctagagaattcttcctgatcttatccaagacaacttagccagtacctctataagactacaaaagccacaacattattgagattggagtaccccctaatgaagatacagctgcagtgaccaaggacttagatcataacacccaagtcccctcaaatacctggaatgccttcccaagaaggatgggtagcccagaacgtgaagactacaataaaatacctaactgttcaatacctagacaatgatgaacatccacaagcatccaagcatccacagcatttccatccaggacaacatgacctcaccaaagagaaatgtgcaacctttcagacagatnattcaaaacagttgttttgtggaaactcaaagaaattcaagataacacagagaaggaattaagaatcctaccagaaaaatttaatgaacagactgaaaaaagttaaaagaacaagcggaaatctgggagcaggagcacttcaggggt

SEQ ID NO: 657022 - DNA, 151 bp, Homo sapiens
gggttgctgggtgatctacaggatctcgggtgttctatcaggcagcattgaagtcaggtggttcgggacgggcaggaagagagactagggtggtgtcacaggctgatacagaatggagactggacttccagaacctggtgatgctggaaca

SEQ ID NO: 657023 - DNA, 259 bp, Homo sapiens
aaggtaaaattttggggggtaaaaattatgtgaaacataaaaatttaataatttctgtcccccccaggggagccgcttgtccccaaaaaaagtaatttcttttttttgctttaaggaaaattaaaaaaaaatagggaaaaggggggaactttttttaaaaatgaaacctttgttcccttaatgtctaattataaaattttaacccctccggccttttttttgttcccccaaatgtattaaaccttccgttttactggta

SEQ ID NO: 657024 - DNA, 610 bp, Homo sapiens
gtgacactctgtctcagatacacctagctccgctgtttgtcaaccctacgctggattgggcgctggggacgatgctgggcgagcagttccctgagctgtgcagctcaccctgcccacctgtggaagtcacaattgaggagccaggtaccatggatatgggcaagcatatgtcgaatgagtactacatgcgctatgacactgcataggccggcttcagtgacgatgatgaagatgtcaacagcagaggaatgaagagtacgtgtcgtatgcaccctgtcaagcagactgatctggaggactccgttgatatcactccttaccttggccagttggatgagtacctgacgcacatagcacttcaattccagttggccagtcataccgaagctcgagctaagtcctacacgaaatcgtggccaagatgtgcaggacgactttactaggatgagctggccgtctggttcctgcttactggtgctctttagcccagtttcaggtcaggcctgctgaagaggttacggaggcctcttgaccgaatcgcctaaagcatcgcacttttacggccccacctagatcctgcagacttcggaactctcttttctcccttttc

SEQ ID NO: 657025 - DNA, 1318 bp, Homo sapiens
acacacaacacaaacaaaccacggacaggaacgaggcccggcgcggttaacgggacgccgacatcgcatcacctagcgtgactctagatagtcgactataaaagtaggcataggtattatagtacgagacgtatacatatactatagacacacttgtcttataaatctaggcctgtataccggtgtccgaggcgaactcagtaagatgatgttaagaggaaacctagaagcaacgtgcgcatagagaaaaaccacggaccgacttacgcgccctggagtccgcggtgggcgagagcgagccggacggaccgcggccagccatggcagctcgctctatgccggggagccggcaccgaaccgcgacacagacgcctccagaggaccacccggacgaggagatggggttcacctatcgacatacaagagttacctacaagccgggcgagaagacgtacacgacagaagctgccgactactatcagctgggaaatctgcccaccgacatcacggaaggaggcacttacaagagagctctttaccgacacagactctggcgagccccagccgcacgtctatcatcaaacacgggacacgcagcgcataacaggcatacatccagcataggacaatccagaaccactgactgaaatagcgaaaaggcagaagcatcggacgcgcaccactcatctcaaaagagcagaaacctactaccgggatactcgactatacgcctaacacataggaacgcagcccttgaacatgtccaagcaacactcaactaccaagacagctctacacaacagaagccggatcagcaaccaacgcaattcaacctcaaccaccgagacacccaagacgccaccaaccagccggctcgctagcgcagcggcaaatccactacgagcgagcacaacgcctacacaggaaacaacgctgccgccacaaccacgccaccccacacagccactccgtgccaccacacacacggcctccggaaacacaacacggcgcagaacggcaggacaatgaccctggactacaccaacgcacacaacagatagccaagctatattgtggctgtgtacccacatgggataacacacatatggaatgatatgaaacattggagttgatcacagaaataaacaaatgaactgcaaaacaaactatactacaaatttatattctggcacctcaacacaaactccgacgactagatgagctacacaatgatgacaattaaaactatgaaataacataattacacaagacaaggcataataatcacattgtacaatacgaacatgatacgcctaca

SEQ ID NO: 657026 - DNA, 139 bp, Homo sapiens
caggagaatcgcttggacttgggaggcggaggttgcagtgagcagagatcatgccactgcactccagcctgggcgacgagtgatattgtcactgtctcccccttgctaacctcctaggggcttagatatatccagagta

SEQ ID NO: 657027 - DNA, 168 bp, Homo sapiens
ccagagcattccttctattacaggctgaagatagcattggtaaaaggtaatgctataatagtatttccctcttctcaataaatgtgcaaaactggggaatctggtgctgatctgcagcatacttgaaaaacacagggaaaaacgtggatgttccaagccagccttaca

SEQ ID NO: 657028 - DNA, 176 bp, Homo sapiens
aagtctgaaggtcattctagcaaatataagcatttacacacttttaagatgtgtacaattttagtaactactcacattatagacttgtacaggtatatgtctatcattttagaaataatgagatttttcttttttcttttttttcttttttttttttttgtgatatttaaaaaaaa

SEQ ID NO: 657029 - DNA, 206 bp, Homo sapiens
acattgctcgcgcaccgagtgtcctcagtatctccggaccccgggtgcacgacgctctggttcaacagagttggatatcaacactgatggtgcagttaacattccaggagttcctcattctggatgataaagatgggcgtggcagcccacaaaaaaagccatggaagaaagccacaaagagtagctaagattatatgccactccag

SEQ ID NO: 657030 - DNA, 407 bp, Homo sapiens
  misc_feature (3)..(3): n is a, c, g, or t
  misc_feature (71)..(71): n is a, c, g, or t
  misc_feature (95)..(95): n is a, c, g, or t
  misc_feature (116)..(116): n is a, c, g, or t
  misc_feature (119)..(119): n is a, c, g, or t
  misc_feature (123)..(123): n is a, c, g, or t
  misc_feature (134)..(134): n is a, c, g, or t
  misc_feature (164)..(164): n is a, c, g, or t
  misc_feature (175)..(175): n is a, c, g, or t
  misc_feature (192)..(192): n is a, c, g, or t
  misc_feature (238)..(238): n is a, c, g, or t
  misc_feature (242)..(242): n is a, c, g, or t
  misc_feature (248)..(248): n is a, c, g, or t
  misc_feature (259)..(259): n is a, c, g, or t
  misc_feature (264)..(264): n is a, c, g, or t
  misc_feature (272)..(272): n is a, c, g, or t
  misc_feature (283)..(283): n is a, c, g, or t
  misc_feature (294)..(294): n is a, c, g, or t
  misc_feature (314)..(314): n is a, c, g, or t
  misc_feature (326)..(326): n is a, c, g, or t
  misc_feature (332)..(332): n is a, c, g, or t
  misc_feature (340)..(340): n is a, c, g, or t
  misc_feature (344)..(345): n is a, c, g, or t
  misc_feature (351)..(351): n is a, c, g, or t
  misc_feature (353)..(353): n is a, c, g, or t
  misc_feature (358)..(358): n is a, c, g, or t
  misc_feature (369)..(369): n is a, c, g, or t
  misc_feature (391)..(391): n is a, c, g, or t
  misc_feature (396)..(396): n is a, c, g, or t
ttngggtatataccacaagtaagggggggtgggaaagtccctccatcattggatttccttaaaaaagcgantcccagggtgtgcaattaatccangaccacatacaaggatccatnganctanataaggtaaantctctcaggtaacggtaaaatttggaggtnggataaaaaantactccaggggtcctantctgaccacgtccttaacggatctgtggccctgggcttgggggtcngggnaagaangagggagaaanggtcnagggaganggatagggggntgagaggagtncccttagaagttggagcccntggggtgggganttttcntcccccantcanngaagcngnagtangagcaattcanggtcacattaacagtaatctcngggtnagccacactaa

SEQ ID NO: 657031 - DNA, 181 bp, Homo sapiens
ttctactgttgactatctttttgcatagctgtgagatgcgctactcgatttcccagccaaccacagaaactactattgccagtgtaagccatcttgtcagaacttaaattaacacagtgattctaagtcagcaactttctcatactctgagttgacactacagtttaatgaacttacatgc

SEQ ID NO: 657032 - DNA, 408 bp, Homo sapiens
  misc_feature (390)..(390): n is a, c, g, or t
cttaacagggtgaacctcagtaatactgtctggaaatgtacaatggactaaaccataaatcatctcctaagattcttcctgaccatttcctaacatgtaaagaaatgacattgttgaacaatttttttttgtttgttttttgagacagggtcttgctctgtcacctaagctagagtgcagtgccgtgatcttggctcactgcaacccctgcctgctgggctgaagtgattctcctacctcagcctcccaagtagttgggactacaggtgcacaccaccacacctagctaatttttgagttttttgtagagatggggttttgccatgttacccaggctggtcttgaactcctgggctcaaaggacccacccgccttggcctcccaaagtgnccaggatcacaggcgtga

SEQ ID NO: 657033 - DNA, 371 bp, Homo sapiens
ctttcagtcactgtaggctatgtagagacaagaagtcttctaacataggtgtacctggatacacgctgacccattgtggaaaggtagagagtggaactgccattgttgacaaagccaaacaaggcctcctcagctcggagctgacttcgattccggatcaagaagtagaactgaccaactgtgagatcagaaggcaccaggtatctcttcttgtccaggtctcctatccgcgcttcgggcgccttttctactatcaccggcacccggtccgggtatttctttcggctcttctcgccctcagagcggcgcttctcgaacggctgctcttctttgtacacgcccttcctcctcccgggaaccgagctggcccg

SEQ ID NO: 657034 - DNA, 332 bp, Homo sapiens
cccagccacgtgccccacagcctgtccccacactgtccctaagcccctggccgctcccagccgcctgtcccctctaatgtccctcagcccctggccgctcccagccgcctgccccacagcctgtccccacactgtccctcagtcccccagccgcctgcccagcaacctgccccccacactgtccctcagccccctggccactcccagctggcccgccccttctccccctctccgccagttactgggtgggctctggttgtgtctgcctcaggtgaccatgggtccagtgtttgcctccattgatgtaaaaatttgccaggaaaaaaaaaaaa

SEQ ID NO: 657035 - DNA, 198 bp, Homo sapiens
ggcggtcctataggcaggtatgtgatctagcgctcattagacacacgttttatttatcctaaaaatatcaagattaatatataatacaagggccaggcacagtggctcacacctgtaatcccagcacttggggaggccgaggtgggcagataacttgagctcaggagttcgggaacagcctggctaacatggcgaaac

SEQ ID NO: 657036 - DNA, 1232 bp, Homo sapiens
  misc_feature (140)..(140): n is a, c, g, or t
  misc_feature (728)..(728): n is a, c, g, or t
  misc_feature (1110)..(1110): n is a, c, g, or t
cgtgtcaaaggcgctagctccaatcgaaggaaggttgtagatgagagacacggatggacgatgaagagagactctcaaagagagccaggctgacgtagacagatggaagcttacgaaagcatggctagcaggagccgacnagcgtcgcatgcgtggctgagcaggagccgacggtggtaacgcaatacacgcgcagcattgggcagagcatcgccactttacgcgggcttggcctcttcagaatgtagtgcgtgcagagtctagaacaaacgaaaagcacggtgggttataaccttgaaatcgatttgcaggcgtcgctagtaaaagacgagacgaacgccgtggagattgcaaaggggtatggaggcgagacttattagcatgaagaagcttgactgcacagcacatcccacggaagcactcttcgaggaatacgacgcgaccacacctttatgctcttggctattcctatatgagcccaatgtagtgctgatcgcaattcgtaggttggatccttggatcgcacaaggaccaagaaaaagctcactcataatggatcgagaatcgcgatctaggacgctgttggtaggctatagatcactgaggaaccgagtatggcttttgccttgtacaagaccaagagaccaaggcacattcttgtgcgcgctaaaaggaatcttcatctagtacttacccttacaatacgaggcacttgcatccatctactngaggcacgacagcacgctagcgacatctcttaaacacattgtcatcttcgcatccaagtttgtttgacccatacaccccaacgagcgccttcgttttcactcctcaggtagtgaaacgatcgagaacctagcgttcctccacaagagaccataatataagagcctcgacagtgtttgccattttcgactcaaggaagattttaaggagggagagtacccctttgcaatgcggctttgagtgttgaaacttggtacaggaaatgcacggttaaaaagacccgctcctgaaaagactgggcgaacctctttaatttcagcggtagtatccaactatttggctccaaaaagttgtgggccaccagaaagcgttggactcccacantcgtcgacagaacacttgcaagacccagagtggaattacgcgacatatcagcgagtggcaaagtcaacacacgcttacaggcaacacacacaggaggggccaaaggggtcaccaccgcacac

SEQ ID NO: 657037 - DNA, 507 bp, Homo sapiens
ggagagagagatagagagagatagagagagagtgagatgaaaatgagatcatgagtgagagagagaggaacagagagtattgaagagcatggagaaagaagggagaattcctttaaagctcttttgatggaaaaatgaaattatgatacatatggtttcatttaattgtacagtctgacccctcaggctctctctctctctctctctctctctctctctctctctctctctcgtctctctctctctctctctctctctctctctctctctcctccctctctctctctctctcctcatataatactctcacacgagatatcatcatctactctactatatgtgtgtaatctcgcgagagcagcagtagtagtgggagagagagagaagagtgtgagcagcagtagtagtaatgatgtgtcactgtgcagtcgtagtagagagtagtagtagtagtgatgaggagacgacatagcagagtagtagtagtagtagagatactttatctac

SEQ ID NO: 657038 - DNA, 302 bp, Homo sapiens
  misc_feature (77)..(77): n is a, c, g, or t
  misc_feature (88)..(88): n is a, c, g, or t
  misc_feature (90)..(90): n is a, c, g, or t
  misc_feature (93)..(93): n is a, c, g, or t
  misc_feature (190)..(190): n is a, c, g, or t
  misc_feature (290)..(290): n is a, c, g, or t
gccctgctgctggccagctgcagcctcagccccacaagtcttgcagaaacagtccattgtgaccttcagcctgtggncccgagacgangngtngacatataccactagccaggtctcgaagggctgcgtggctcaggcccccaatgccatccttgaagtccatgtcctcttcctgggagttcccaacggncccgtcacagctggagctgactctccagggcatccaagcaaaatgggcacctgggccccgagaggtgcttctggtcctcagtgtaaacagcagtgtcttnctgcatcttcag

SEQ ID NO: 657039 - DNA, 412 bp, Homo sapiens
  misc_feature (1)..(1): n is a, c, g, or t
nttaaatcagctcggtaccggcatgtgctgtaggccagcggccgttctttattgtggggctgtcatgtgagtcgtaggatgtttgacagcatcccaggcctctaccccaatcatcgtgacaaccagaaatgtctgcagacttttgccacatgttccctggggtcacactcacccctggttgaaacactgctctaattccatcttcatggcatcgtcaggagatgacgtcacttgcctttacgctgatgtagaaaaccagaggctaatggtaacaaaaccggtaccggggaacatggggttttgaaaccacatttgttctgatccttgacaagactctgcctgatggctgagggggagacgggtcagggcaaccgctggcctacagcacatgccggaccggctcgatttatcg

SEQ ID NO: 657040 - DNA, 210 bp, Homo sapiens
  misc_feature (146)..(146): n is a, c, g, or t
cccatgcctgcaccagacaccctgttgaccatgactcaacaaatttgtgttgggagccgtctgcctccccagctcagtgcctttctgcaccccttctctcctgcccgcagctgctgcatccgccaccccctccaaccactgccctnagcccccgaccttatttattaccctcccctcccacacccccaatctacctggtgcaggctacct

SEQ ID NO: 657041 - DNA, 132 bp, Homo sapiens
tctgcattgcaaggccaaggagttgtgtaaggcagcggacatcgaaatatgaaaaactaccttatggatgtttgtgccccttacttgagccttgccatactgcagcggataccgcagctcgaaattcgctaa

SEQ ID NO: 657042 - DNA, 429 bp, Homo sapiens
  misc_feature (49)..(49): n is a, c, g, or t
tccccctcggaacccaatgagcatgagtctggagtttcttgactgattnatttttctttagcgtaattaagtggttagctggtagtctcactgagaaatctgtaaatgccagaatgcaaaggtcattgctccaaggttatttaatttatatagaggaaataaaaaagtagtataggttgagtgtcccttatctgaaatgctcagaattagaaatgtttcaggttttggattttgtagtatttgtatttatacttactgattgagcatccctaatccagaaatctgaaatctgtaacgttccaatgagcatttcctttgagtatcacgttagcactcaaagagtttcgaattttggagcatttcagatgtcagattttggattatcagattagggatactcaacctctaatggctcattgggttccgatg

SEQ ID NO: 657043 - DNA, 610 bp, Homo sapiens
  misc_feature (314)..(314): n is a, c, g, or t
  misc_feature (350)..(350): n is a, c, g, or t
cagacatgatgcctctttactcctatatcctcaaatatgtatttcctaaaaacaccattacaatgatcaaattcaggaaattaacactgatacacatattattttctaacctatagaccttaaaaattattttgacaagttttaagtttaaaattctctgcaatgacaggtttcaaatgaaataaattttaataggctaatttttggtttctgtcagaaatcttgaactgtgatctattcttatatgtctgacaggttttttctttaaatgaggcctatactacactcaagtgtaagaaacactgtattttagntttagtaagaaatctttaggtaggagtgaatttttnaagtctttgcttattaaaatcaaggtaaagtaaaaagctatttctgatttgtagttacgaaattcagtagaaggtctggagtgagacctaggacctcacttttggctgtccaccttgaggacaggaataataaaagtattatcttagttaagttcttatccagattcttaaacatttttgatgtcaaggaatcttaagtgtcctgtacagtgacacatctagttttgtttttgtttgagacagaatgagatcctgtctcg

SEQ ID NO: 657044 - DNA, 421 bp, Homo sapiens
  misc_feature (331)..(331): n is a, c, g, or t
cacgaggccttcgcgcgggtctaggcaaaggctcttcggcgatattgccgtggcagggtgacggcggtcatgacgagctcatcacggggggctttagacggtggtgctccctgatgcgctggcggcgctgacgatcgagcgttccatcgtcctggaagcggaggggcggagcggagccatggtccgcacatcccgaatatccgcgaccggcgcatcggcgcgcgtcgtcggcgttggcttcctcattatgtactcgcctgtttagagttgttccagacaagtagcgcaccgatgacataagaacaaatattattgtcgaataaatacgatnagaaaaactgatcttaaggattggttttcctgacatgtctcagacagcaaaacgcccgcggaagcgaacttccgcgggcgttttgtccgt

SEQ ID NO: 657045 - DNA, 572 bp, Homo sapiens
ggctgtctcctctctccgccatggcgtgtgctcgccctacttgatactcgtgctgctactccggaaaagggggagtcatctggcaaaagatgtcactttgcctgtctgctattcaaggctcctacttcgaccaggatattgtgaactttgttcactagccaaccttgcgcaacaaacaatcacgacatgcccctatgcgtgtcaggtgaatttatccacggtcatcagactagtgctgaatcttgcgggtactggcagagctgtggctcgaattcccagagttctgaggtggtgggactcacccgctctggccagtggtgctctttggtacaatcactgtgtcgtggacggccgtcatgtttgcatccaaccaataatctggctgccgtttggcatcgttgtagtgaacacaacccatagaaacgatatcgaccatctgttgctgccctggcctgcctcaggccctaccagctagctggttcactgtctactaggtcatcgctacttgacgcgaagttcctgtaacttcctttggtagttgaaggatcccgttgatcggctacagagaacgc

SEQ ID NO: 657046 - DNA, 860 bp, Homo sapiens
ccagcactttgggaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaacacacacaggaacagggacaaaaaaattagctttatacctcttcctggtctcaaccggccatgaaaattctggaacactccaaattcaggtggaatattccaaaacaaacattcactagcgtttacaacataatttaaccttccttatagtaatagtatacctttaaaaagcctacaggggtatatcatcttctaaacgcagctacaactctcagtgcagctacattaaccaataggtccctaagtggagaaaccaatttgggcctatttcactggctgttgtagcctcaagtggcctaacatgggggtgccaatataaaatattcaggtaaaatttacccttgaattgtgtaaaacccatttcggactacggtctccaacttggcacagaaatctccaaagggcccggtattcacaggtgaactcccttcggaaaattcatcaatacaatcaggagtgtcccccaggtaatggacctggctgggggtggtgaccttaggtaccattaagtactccaaatattcattcaaaagccctcaaaattactgggaattagatatttaacccgaagatccttacccaattctacaaagtagaattct

SEQ ID NO: 657047 - DNA, 589 bp, Homo sapiens
agcgtgggtctgagtgcggagctgctgtcatggcgggcgtctgtggggcttatttcccgtcctgctgctgcctgctgctatcgggggatgtccagagctcggaggtgcccggggctgctgctgagggatcgcggaagggacgtgcgggtcggcatagagacgatcgcttcgagattgaggggccgtgcagttgcttccagggggtgaacgtctctatggacctggatctcgagcggcgccgatgtgcctggtagacaggcacaatgagcacgtcgtgtttcccttgaagacagagtgggagttgttgtggttcagtgatatatccgttctggactcttatgtacgtggaagttgagtactctccagacttgacaggattgtgatcccgttcgagtggagtatcgacgttcgagaaccaggacaacaactgagagcagagatatgtgaacttacagtcaaaacatcagaggttgtcagactggccgaatcctctccaaatgagatcttcaggtccaccttcttactttattagaagggaactcgtggggctggacagacttggctaatgaacccaatggttatgatgatg

SEQ ID NO: 657048 - DNA, 454 bp, Homo sapiens
  misc_feature (5)..(5): n is a, c, g, or t
  misc_feature (145)..(149): n is a, c, g, or t
  misc_feature (201)..(201): n is a, c, g, or t
  misc_feature (206)..(206): n is a, c, g, or t
  misc_feature (233)..(233): n is a, c, g, or t
  misc_feature (243)..(243): n is a, c, g, or t
  misc_feature (285)..(285): n is a, c, g, or t
  misc_feature (321)..(321): n is a, c, g, or t
  misc_feature (331)..(331): n is a, c, g, or t
  misc_feature (335)..(335): n is a, c, g, or t
  misc_feature (337)..(338): n is a, c, g, or t
  misc_feature (342)..(342): n is a, c, g, or t
  misc_feature (347)..(347): n is a, c, g, or t
  misc_feature (349)..(349): n is a, c, g, or t
  misc_feature (358)..(358): n is a, c, g, or t
  misc_feature (362)..(362): n is a, c, g, or t
  misc_feature (374)..(375): n is a, c, g, or t
  misc_feature (378)..(378): n is a, c, g, or t
  misc_feature (393)..(393): n is a, c, g, or t
  misc_feature (430)..(430): n is a, c, g, or t
aaagncagaaagggggcaggggagggcaggggtccacgggggtggggccagtgcaccaggggcagctcagctctccaaaggggccagcatctgcacctgctcctgctgctgctcctgctgctgttcctgctgttgctccagctcnnnnngggagagagtcttgtcctggctctctttctccttgaaggtgctgaagaaggngttgnccttgtccctcaggtccttctccaggntgctcaagtngccttccacgtcccccgcatgggcgcccagtttctgcctganctgttccatctgctgcaccagggctttgttgaagtnttccccgtanctcnanncggngtcgnanctcctccanctgntggtccaggtgnncanccagctctgccagtnaattctgcagcccctcggtgttgcccctcaggttgcnacggacgtgctcggccaagggggc

SEQ ID NO: 657049 - DNA, 504 bp, Homo sapiens
ggggcccagcggagattccaactgtggttccaaaacattgagctggtgaattgggcagacgggggccagcacaccagcatccacccagcttgaggctcaagttgcccttaccaccccttcccccaggaggggccaatttcttcggtcagcaagaacccaagcccacatccaaacttgcgtgtcccaaaccacttatttccctgttcccctttgcccccccccagcccagaggggtttgagcccccaatttcagggcctttttgtaccccaagccagcccaagattgggcattcctttttgcaccaaagtgcgggccaccctttggggggggggggggttttcccattttcataccctttcctttaaagggggggcattaaaattccctgggcccagcccatgggggggcccctaattatgccttcccccagctttggggtaaaaatgacccctttatgcaagttgtaaggggttgaccagtaaagaggaagttttgccccccca

SEQ ID NO: 657050 - DNA, 899 bp, Homo sapiens
gccaggaccgactcgccctccgaaactcaatgtttggggctgcggacttgctcgtcgtgcccacaaaagtaaagcttggggacctggggggagccggcagtatcgattcgagatccccaaatactatcgggtaaacggagagtggccgtcggtggcagagacctgttcggcatggagcctaatgatagtaccagtaccgctgtggaggagcctgacagacttggaggtgtggtgaagacctcggacatctcaaactcgtacacttaattgtgggggcccagatgaatgtaaaagagtttaaggagcacattgctgccatctgtacagccaatcccatctgaaaaaacaacggatcataaccagggacgagttctgcaagatgataagaagctacaggaccttacaaatagtagggaaggaacaggttcatccaacatggatggaaacaggggctccaccatcagactcaactccacttcatggagagcactctactgagacggggtcatgcctcagccacacatcaatggtgggaggagataccacacacctggtactcaggggagcctagaggaccaacctgatacaatgaacaggacatgcccaaacaagcagatgtacatgggtggacaccaacaaaatcttcacccaagagtgacgggctccagcaggaggactgacacaatcaagaaggggaaacagggccccgaaatacaagaggagaagccacaggggaacggagaggatgatggatcagagacaaggaacagggcgataaaccgaaaaatacgaaatcacggaggagcggacaagagagagacccacggagacacagacgacagacccgaaagacacaggagaaaccaggaaacagacacagagcaccaacacaagcagga

SEQ ID NO: 657051 - DNA, 1425 bp, Homo sapiens
  misc_feature (385)..(385): n is a, c, g, or t
gcaccggcgttaccattaattgctccttcggccacgccaatcccagtcccggtggcggtcccagcctcagttcctagcgccaatgctatcaccggctgtggctccgtgttccctgtttgcgtctccactccttcatcctcagaccctgcggctgcctcggctgcgactgttggttcctggccacgagccccgtgcctcagcgcaacgctccaagcgcagatccccacgtagcgctgtctctgtctgagtcccttgctcttccaagtggttccttcccctgtgcgggctcggctgtcgggttcacggtgttgtcaccctccagttcggtctttagtgccctccgcagtttgttgggtcacgctttacgaagcacgcacggcaattngacagcgaggtgccttgcgcccggatttttacttccgggcgactcccttggctttgggggaaagccttggttcccgatacatccctaactcctacgctcgggcagtggttcaccccccctatttttgcctatattccaggtttcgacccccggcgagccatacgtgcacgtgtcaccgaaacgacgtagcaagcgtttgggcctccgttcagaaccgcttcgacaccttcttttgccgatataggacattatgttgtctagtatggcccccgtgtccctcaacaccacacagggtttttcctcccgctatcatattcggcccttcacttttcactttggcagagaacctcgggtaaataccgcgtacgcaggtagtgtccgagcttggtattcacatttcacctccggcacgccccattcttcgctaggtttgcctttgtgacttccccattagaggggtttccctatactccgtctcccttgtacgaacgtgccccccccgcaaggacactcaggtcgccctcttctcttcatatcgatgtggggtgatacactcccacaggtttctctcttccaagggcccccgcgcgcgtccgcgttaggtgggcacctcccttccccttaggccctagacgcgtttcagcggggcgacgatttttcacctgtgctcgcaaaggtttccccgggtgcttcgcagggccccccttgggggcagaccgtcgcactttatgattccccacagtgtccaacagtgggtacccacgcggccacacaatatcagcagccatgatacctcatctagacccacccctgactagagagccgccattctagattaagtgattgttgtaccccagtgagtgcaatacaactagactgccctgggctttcttaagggccgctcccaacacacgccgagttatagataatctggtgaaaacttatctatcacgccagtagatacgaatttgagcgacaccatcaagcttatacggcacacgtagtggtcatattatagcgggccgcgctcattcactcca

SEQ ID NO: 657052 - DNA, 204 bp, Homo sapiens
  misc_feature (1)..(1): n is a, c, g, or t
nataggacttacacgcaacgaccctgacacggaggaacacggtaactgacgcctggacgactaacttggggaacactaatactttcacggtactagacgactttgcaaactggctacaggctctaaacgtggtaccccaccagtgacctggactcaccttttgacaggacggacgaactacgtaaaacgactaacgcttgcgca

SEQ ID NO: 657053 - DNA, 168 bp, Homo sapiens
ataagaaaagctaaagcttgaacttcagtcagaaagtaaaggagtttaatgagcaataagaaataatttgaaggtacaaaatttactggtaatagcaagtacacaaaaaaatagaaagtgaaaaagtaggcgtcggggatgaagttaaaacagagtttttatcagttt

SEQ ID NO: 657054 - DNA, 186 bp, Homo sapiens
agaagctagatatcatagtactaatggtggtctaggagcagctgggcggatagcaccgggacatattttggaatggatgaggtcttggcaccctgaagacagtccagcgaggacttggtcttagattgagcaatttggactagagaagatagtatgacagcacggtatctgagatctgtagggatt

SEQ ID NO: 657055 - DNA, 115 bp, Homo sapiens
agcatcatttagacatggcgaaaagcatctacatcccgtacatcacgacacttccgtccacacaccatcctgaagtcacctcaacttctaccaccagcatcaccccgcaaacaca

SEQ ID NO: 657056 - DNA, 193 bp, Homo sapiens
accatgcggactcataggccacaccttcaatcatcttcttgggctcacaagttgtttcttatgcagagatcaaaattcagcctcatccacctggagctattgtatatcttactatcctctcaataaaatatcctcaggattaggagagcctccgatcgtaggacaggaggctcccaggtatcatagatacacc

SEQ ID NO: 657057 - DNA, 105 bp, Homo sapiens
aaatagattagcttcatcacgattctcatgtactcttactatggttccgtcgtcagtgccttccagtgcagtcatacctctggtggaagcaagtacatcacgtca

SEQ ID NO: 657058 - DNA, 140 bp, Homo sapiens
cagattgcagagtcaagagcttttcactattgacaagatggtgatggactattacacacggaattgggactgtattgagtctctgggcagatcccacagaggcagagttacaggacatgattaattgaggtagtagctga

SEQ ID NO: 657059 - DNA, 1610 bp, Homo sapiens
  misc_feature (891)..(891): n is a, c, g, or t
  misc_feature (1143)..(1143): n is a, c, g, or t
aaaaaatcgaatacctttatttgtgctcccttaagcagctgtgttgaaaaggtggcagttgacctctcagcagcaggccgtggtatctttgtgcccgtgtttgagaagccaaaatcatcagcgtgtacatagttcgagggtgtttttctcagacagcaagtaaaaaaggttggtggccaaacctccaggtgcgtgattctccgtggaggaaggttccggggtctcagcactgtgggcaaggtataggttaccttagccgtgccttgaacaccctatagtatcgtggggtttgagacactctcgtgtttgtgccgtgaagtataagacgggattgtctcagttccccttacaagatttatctctaccagcaaatgtgtgtgtctcttttatctatctctgtgaacagagtggtctacaacagagagctgtggtcctcccttgtgaaaatgtgtgactccctgtggccatgtgtgtatcaccccctatagaagcgccagggtcccaccagctgtggtgactcttctcttattgtgtcgaactccagaagggagtaatatctgtagacaaccacacaagagcctgtcgcgcccatgttgagagagacgcccccttttgagagaataatcacacactatgagggagacaacccaagaaaaagtgagcagtagtgctctcagaaagctctcaagagtgcgccgtgacaccacagaagtctctccagaggtcttcttactcagagaagtcgttgtgcccacaactacaaataaagaagaggagccttcgtgacaagctgtggacagccacaagtgtcttccaaaccaccccaagaggagcacgaagacgcagagaggctactaccaccaccagggcttctacaaattctcgacgaanttattacccccaaagtggtggggggaacccaaaacgtgtgtggacacctttcacgaccaaacgctggtttaaagagaaaggctaaccccgcgagaggtttaaagacgcccacgtgtggacccatatcgcgttgttctttttcccaacacacccacgagggagaatagtaacccactactacacaagagatgaggtgtcacaaaaatgtcgagccccgaatcaagagtttagtcataaaaggagacaatttancagtaaaaaacagacaacttctgatggccccatgtgggcacccatttggattagacccgaacacgcgattcatcataccgtatcgataggttagaggaacatgtgtgccccgttaacacagaggaggccatacggatctcattcaagccctgctagcacagtgtgagttgtacaaacacacccggacatgtgtcgcccatgacataccgaactcgcagcgggcacccaccccaggaggacaaaccgtgttgaccacacctagcagacatctggccccaggcaacacacacaagggactcacacacaaaagaccctcacgtcagaaaagtagcacacacgtacctttcgcaacgagagcaggacagcaagacaggcagtccaagcaagacgctcgagacagaacaaaacacctatgggtagaccaaccacgaccgatcgcatacgaaccatggacgacacaagagtaa

SEQ ID NO: 657060 - DNA, 951 bp, Homo sapiens
ggcggcgcgcggaggaggccaagatggcggcagtgcggttcgcttcgcgggtagtgtgggcccgcgggcgcgggctccccgggcgcgcgtgccccgggtctggcttgtggaggcgcgcggccggggcaagctcccggtttagggggacaccttccaggggccggtggcccttgtgtcggtcgagggtcgtggcctttcccggaggccgggagaaaggttgattgctggccaggcggcgtggggcattgcttgggcggcccacggggtgttgcgggggctttggcccggtggcttctggcatttccgggttgtggtgtggccaagttgcacctgggtggaggtgtgacccccccccaatggttatccggggggtcctccaccgggggccctcccttcttcttttctctgggacgccaaccaccagagcattcccgaggggggggggttcccccaggggtattataagcgggacgcggtggtgttgggccccttcctttggcacagtgtttgggcacttcctggtggcgcttacccggccaacacttgtggtggggcggccgtgttgtttggcaacacggggagggattggcacgcataaagacgaccctggcttggcgaaagagtggacggttccacaaggacgggcccccaaattggaagaagtggggaaacgactggttcaatggcgggcgccaaggagaaacggctttggtccagggtatttcccaaagaacctataacccccaaaaggtggagggttggtcggagtttggcaaaccagcgggtgtattgcgccccttgtgacctcaaggtacaattcgtggagaagcataggcatgggtgggagcgcacatacgtattctccctggtcaacggggctactggaaacacaccacggcgttgtccattggaggaaggtcttacataacccctaattcctggcaggcatgg

SEQ ID NO: 657061 - DNA, 126 bp, Homo sapiens
cacgaggagtgcttcgagcggagcgaacccatccacaggaaacggcaactgactcacagcagacccctcaccccatcctgttcctcttcttgccctgtcctgcagtctaaggagcccgcctacctc

SEQ ID NO: 657062 - DNA, 516 bp, Homo sapiens
aacccatcgccaacttttattatgtgataaatagagaggagatgtcaggatcgctgtatacagttgaggatgaggcggtctttccttctctgtactattctttcttcttatatttattatctctcttgtcagtattaattgccatctttattttctttaagaatcaagacatctgctttcctggttgagaggtacagtgtatggaaaagacaaagaacagatgaatacattttgctcccccatgagtcagtctctttctcctcctctcctctccccctccttttaattattcaacaccatcctttttctttattcacgtatcctctcatctcaatgttcatgtcacactgttattcttaaatcatacccactggaggggagagagggttgtctaagatctaaaatatggaggttacaatttataatgcacatatataaaacagagctccgcagcgtttcctctgacctcttcgataccactcccagatgctacaccagagctaagcacaaggacct

SEQ ID NO: 657063 - DNA, 949 bp, Homo sapiens
  misc_feature (949)..(949): n is a, c, g, or t
tatctctaggaaacagtctggcttaactatttttggagaatataactgttgccccgtctctgctgctttagatgttgctttacatagaaccagaaaagtggaattgtctgcagactaaagcgatgtgtgccatgtttcatctaatcaagcagagctaaaatgtgcataccgaataaatttatattaataaagttactaaactaagagtactcaggttagtttactatatttgcaagtcgaagatggacagtaagaagttgactggtcaagagagagcagtgctgaaggaggagatccaggtttaaatctggcttattaagctcaatgccaattttaatggattttctgtatagattactcatgtcagaccaagaactttgataattatttccgagagaggcgtttaattgctaagtaaaccaggtgttataaagaattataagagatgatctctgtttttcctggtcagagatttacgacaaactgaatgaggtatagcctcaaacccaatagaatagaaggttggttgtcggccaaagaaatactgaggctaggacatacaggaaccgtttgccggagcgagtgatgggtaccacgtgaaaaaggcttctttcagacaccaattcgcgtagaggagcgcagcgggaccccaagagaggttatggtggaacccacgcgtggtccaaaaggctgggtacacccaaggggaagaaacaccggcggcgcacaaggacaacgacacacgggcgtgggggatcttctctcgcccaagatagaaaaaccggcgcccgggggggggagaacacccgagagcgggctcgtgacgaaagagacctcccaaaagatgggggggctctgaagaggcggcacacacaacggaggagagcatatccaccaggggggggaggctcccacgagaagaggggcccgagatatcataaattacggn

SEQ ID NO: 657064 - DNA, 710 bp, Homo sapiens
  misc_feature (5)..(5): n is a, c, g, or t
  misc_feature (81)..(81): n is a, c, g, or t
  misc_feature (83)..(83): n is a, c, g, or t
  misc_feature (103)..(103): n is a, c, g, or t
  misc_feature (113)..(113): n is a, c, g, or t
  misc_feature (212)..(212): n is a, c, g, or t
  misc_feature (223)..(223): n is a, c, g, or t
  misc_feature (255)..(255): n is a, c, g, or t
  misc_feature (305)..(305): n is a, c, g, or t
  misc_feature (323)..(323): n is a, c, g, or t
  misc_feature (350)..(350): n is a, c, g, or t
  misc_feature (423)..(423): n is a, c, g, or t
  misc_feature (446)..(446): n is a, c, g, or t
  misc_feature (454)..(454): n is a, c, g, or t
  misc_feature (467)..(467): n is a, c, g, or t
  misc_feature (469)..(469): n is a, c, g, or t
  misc_feature (477)..(477): n is a, c, g, or t
  misc_feature (534)..(534): n is a, c, g, or t
  misc_feature (700)..(700): n is a, c, g, or t
tttgnttaatattgatttggttgatttatagcatcttgtgatctaggttggctttgggaaggtgccacagggaggtttgcnanttcagggagcaggtagatgntacagtggcncccgagcgcgccaggtgccagcttcgacgtgtaaatggcccgttgcgggcgctgctgggaaggaagacaagaagggtgagggtttgtttttaccaagtnttttttgagtnctgtaggacgtgggtgggatatggggacagtnagggtaacacaaacagcaacgaatgcacaaagacaagttccaggaacacncataaactcataacgttnaacaaaatggtaataaaacgacgcttnttttggtttggtgaggttggtgttttttttgtggtagatgccacctgcagctggctggctgggaagcgttggncaagttttttggtatttgggagnttaacagnataaaaggttgtnanttctatanggaaaaatttcacatccttcccctgaaactgacttcaggggcaaagaaacgagactncttgaagaccagcctctgctgggaaaggggcttctgagacgagtgtcgacggcagagcagaaggcctggggaaggcaggggtccctgggcagaggctgggagggtgggcagagaccagggagggcccttcatctggtgggtttggcaggtgtgtccctggtgctgncaccaggagc

SEQ ID NO: 657065 - DNA, 684 bp, Homo sapiens
  misc_feature (28)..(28): n is a, c, g, or t
  misc_feature (65)..(65): n is a, c, g, or t
  misc_feature (73)..(73): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (169)..(170): n is a, c, g, or t
  misc_feature (225)..(225): n is a, c, g, or t
  misc_feature (231)..(233): n is a, c, g, or t
  misc_feature (243)..(243): n is a, c, g, or t
  misc_feature (246)..(249): n is a, c, g, or t
  misc_feature (273)..(274): n is a, c, g, or t
  misc_feature (304)..(304): n is a, c, g, or t
  misc_feature (330)..(330): n is a, c, g, or t
  misc_feature (469)..(469): n is a, c, g, or t
  misc_feature (471)..(472): n is a, c, g, or t
  misc_feature (475)..(475): n is a, c, g, or t
  misc_feature (519)..(520): n is a, c, g, or t
  misc_feature (525)..(525): n is a, c, g, or t
  misc_feature (529)..(529): n is a, c, g, or t
  misc_feature (553)..(553): n is a, c, g, or t
  misc_feature (556)..(556): n is a, c, g, or t
  misc_feature (560)..(560): n is a, c, g, or t
  misc_feature (645)..(645): n is a, c, g, or t
ggggagctgtggtcttgttcacactttngggggcccttcttaggagttctgcctgtcccttgganggttcagngtcttgggtccagcggntntngggagcccaacctgcgtggacaaccccttgtggcagcccttggtcactgctgctctgggtgggcagcaggtttanntttcatagttcacatgttcccaccacacaagtcaaatcaaggcatgaaaattttngggaannncgggagggcnggnnnngggagcctggaagaggttgcaggnnggggaaggggacacagtgggcttccgagangctggcaatttcttgacttggatggngttacgtagtattcactttaaaattattctttaaattgtacgtacatgttatatacttttcagtatgcatatctttaaattttaaaaattaaaaaaagaggctaaaagtgaataaaagggcagatgatggaatagaaangnnatngggggggggagacgacgaaggaggaagatggccagggtggaaanngaggnagtnctgggggtgataatgctggcctcngtntctnttcttctgtctggatactggttctacttctagataccggagcccgaccagcatacccaggatggagaaaccttaaatacggaggnaaggctagtgtctaacatacatacggtacctttcttctc

SEQ ID NO: 657066 - DNA, 477 bp, Homo sapiens
  misc_feature (452)..(452): n is a, c, g, or t
agatactcttcgtcatgtattccactagaggagcagagggcaaactacgttcccattaaagccacaaggtttaaaaacctctaaccttggaaaagcacacttcaaccctctgcacaccaaacttctctactgtggtttcccctctgccgctttctccttggcgttccccgatcactgcctctagggtctttacaagggacagcgaacgtaaggtttcggagctggcttcgcccccttctatttaccgggggctggtcatccttcgggccaggctgactgtctaggggtggccctcggatacctggtccccgcaggtgacccccctccctcccaccgaggaggagggcgcgtcccgctcgctccgtggagacgccgcggaggcgcacacgcctcacgcctcctcgcagaagccacaggggctgcggctctttgtcgcggccacaccggaaacngcccggagcgcgcgcggggcggccg

SEQ ID NO: 657067 - DNA, 526 bp, Homo sapiens
agcggtgggccgaaaagcacggggggctggtgaggaagaagccgccgccggcgcccgagggcaagggcgagcccgggccaaacgacgtccgcggggggggaagccggacgagcagcgctcgggaggaccccctgggccggccccttgccggcccaaatgtctcggcaaccaaagggcaggggggcaccgggggcaaagcatgggagcgctgatgatgccctgcggccgctgcagctggtccgggcgccgaaggcccggccatcagcgacggggaggagggcggcggcgagccaggcgctggcggaggagctgccggagccgcgggcgcggggcgccgggacttcgtggaagccccccgccaaggtgaacccgtggactaagaacgcattgccgccggtcctgaccacgtgaacggacagtccctcccagaacactctgtgtccagccaaggtggtgagggcagctgttcctaaaccatgcgcctaaggcagcagggttggatgactctggagatgcacatcaattg

SEQ ID NO: 657068 - DNA, 839 bp, Homo sapiens
cggacgcgtgggtccaactgctctgacattgttagaaatgttagtattttattccgtttgagcaatacgcgttctgccactacacatttctataaggaagtcacaattgcttcatggtcatgaccccattagtcagtgtaccagctgtgttggggataggaagtatatctggcagatagatattatacaccttcctactataaagcagcatatcacaacatatagtacacatccatttcattcccttgaaagtgatatctcttataacaaaatgacaagctggagttcacggccatatcaaatcgtcctggaaggtgatcaaaaatcacaattctttagcaactatcaaacctcaacttctttcctaagtaagatacagcacccaattccagtctacagtacatattacactctactatatgtaccaagaaggctaggttatattggtggatgaggtctcttgacaactggctaaaagggaaactcttgatctatgggtaaatgtctcttacggatattaaccactacagttaaattggaacttactctatgggaatgtgtggtctctggtctaacctcagagcattaaaccaggtacaacagctcaggatcagcacaccaattaccagaagaatactccctgccgtaaaacacaacatgatactgcccgagaagacacataagatgataacaacgaccgacggagaacctacaacaggccgcactcagtcgctacggcaccaatgaccctgcaggccgccactaacaggggccacaacacaacggaccacctaggccatcccgccggtcaagaaagacgaaaacctacacaacacaaa

SEQ ID NO: 657069 - DNA, 224 bp, Homo sapiens
gaagaaatcacatcatggcatcattccatatccctacacccctacaccctggtccatcagaaacctggctgactctaccacccattacttcccatttccttagtctccatcctcagaccaaacccagcccattctccatccaccagtctccttccccagcacctctgtctcaatctgctgcctgtgggtgctcctctcacatcgcaccttgccaggccattgca

SEQ ID NO: 657070 - DNA, 390 bp, Homo sapiens
  misc_feature (255)..(255): n is a, c, g, or t
  misc_feature (285)..(285): n is a, c, g, or t
  misc_feature (320)..(320): n is a, c, g, or t
  misc_feature (345)..(345): n is a, c, g, or t
  misc_feature (373)..(373): n is a, c, g, or t
  misc_feature (379)..(379): n is a, c, g, or t
ggcacctctaatcccagctacttgggaggctgaggcaggagaatttcttgaacccaggagatggagattgcagtgagcgaagatcatgccattgcactccagcctgaacgccagagggagactctgcctcaaaaaacaaacaaaccaacaaacaaacaaacagaaaaacattgtcacacagacaaaaccaatatgggaaaacttccaaaggaaagggtgcgggcatcacttttaacgggtgaggcacagcggccnggggagccttccgggttcttagggtggcantgggttcttttcttgacagtccttctcttgggctnttcagagacctccgtttttagcttncgttgcccttagagtttttttgggagtnccttgnttcttaggggt

SEQ ID NO: 657071 - DNA, 490 bp, Homo sapiens
gggggtgcgggtgatctagaggatccctttgcggtgcctttcccagagccaactcaaggcttctacatcctggggtgagctgaacaggcagagtgaaaggctgtatcctgcagtgtccctccgtcccagggggtgtgtggacagagctgagaatggggaccaggtcattcagagctccaggctggaacagtgctcttggtgcaacaagaaacttctccctcagcccctccttgaacctcagatttggagatggtaaccaaaggaagcagctgggacaggtggagaaggaagtcggaatgagtgcacggtgagcccgtgctcctcaggggcctcccctgtctctgggtggaatggttatcataggggggggcaaaattagcaaaaaacaaaaatcaatgacaagcaaactgaaagcgaaacgaaaaatcaacgaagactctgtcctctattcctccaaagaatgcaaatcagaaaaagcccctggctagat

SEQ ID NO: 657072 - DNA, 706 bp, Homo sapiens
  misc_feature (446)..(446): n is a, c, g, or t
tgggtagccattgaaaaagcttaggtggctataagcctgtggaaagcgtcagtgagtggcttttataaaaaggtggatctggtggatgacagtcaggaaagaggatgtggatagaacagagactagtttataaagtttagggggtttctcaggcaagaataacattgagggtgtggcacccaagaagtggttacgcagtgtggcagaagtgcgccattcaaggggtgtgaggtgtgaagggagagaagagtgtgtacctgtgcaactgtggcattaggtggatagagtgtgcgttaaggctgtgaggagagaggaagccactttaaggaggacttccgaggtctctgtgggccaataagaaaacagggcacttgcgggagtatggggcggaaggtcccggggtaaaattttgtggttttcaatattctaatgcgatgttcggggcnagccatctcacttttaggagcaagcagcaatgcgggagacactgggggagtatttcaactatctcaaatgtttaaatatcgctgggtaaaggggctaatataatattttttcacccgagaaaagtgagggcgagcatatttagacacaatattctggggaggataattggaaagtttgggttccaacgggtgaaggggaggggcctcttctatcacaagaaaagtagtccctttggtttttcaaaagttttccctttcta

SEQ ID NO: 657073 - DNA, 356 bp, Homo sapiens
ctacatgctcgacacagacaccagctactgaggaaaaggcctcataggaaatgacatcgccaccatcgtcttccaggaccgtggagcacttccttttactccaaacagcatccggtctcactttcagcatgtctttgtcatagtcaaagtgcataatccatgtaccgaaaatgtgtgctatagtgttggagtttccagatcaaaagatgtgccaccatttggcccaccgattcccaaaggtgtaacttttccaaagtcagccgtgctccgggacttccttttagccaaagtaatcaatgcagataatgcagcccataaatcagaaaagtttcgagcggttaccgagctcgatattc

SEQ ID NO: 657074 - DNA, 488 bp, Homo sapiens
ccaaatcgcaatcacaatgagatgctcacacccagtagaactgaaaaaaattgacaataaccagtgctgtgaggatgaggaggaataggggattcaaaggaacgcctcccatctgccactctctcctgacctgacctcctcccaccctcagttttcctaattacagagtcatcaggtttctgtccacccagaagtgacggcaatgacaggctaagaggcagcgtccaagagagttctggggagacagcactgggggagcccaggtttcccggctttgctggggcctctctgcaggagaaagtcaccatttcttttttccatctctaagacatggccacctttctgcctccaggtattgtcacagagccaggaccctgtttgtgggcccagtggctgagcccagaggcaggacggggcaagagacagtctcgccccgtcaggctgaccatgtgtttctgctgggattttaaatgctttccccataaaaa

SEQ ID NO: 657075 - DNA, 424 bp, Homo sapiens
tccacatctatatccccaaaacctgatttcccttctgtgttctccacaggtgtaccactttcacttactaatccaggtatacactctaggagtcaccttagatctgacactcagtcgctcctaattcatatgattctatagttaattgtccaactcttaacgagagataaaagggtgccataagataattacatcaggaaaaaatatcccaggcaacaccaggctctatggtcagcctactataatgcattatgaaatgcggtgattgccgaatcctgacattctcacctctaaagatatactctcatgtccatatcctcttttccattctgactaattaagcctcaactgtctattaccagtgcgtgcacatagtccatgggtgcagtccgtcagagggtgcagttagtcagtgggtacagtt

SEQ ID NO: 657076 - DNA, 288 bp, Homo sapiens
agctgggattacgggcgcctgccaccacgcctggctaatttttgtatttttagtagagacacggtttcaccatgttggccaggctggtctcgaacgcctgacctcatccgtctgcctccgcctcctggagtgctgggattacaggcatgagccaccgcgcctggcagttggatgagttttgattaatatagaccttcatgtagccatcagtcgaatcaaaataacaaatgtctctatcaccctggcttaagctcgcctgcacttaaactgtctgcaactaggagccta

SEQ ID NO: 657077 - DNA, 242 bp, Homo sapiens
agcctcagcaacatagtgagacgctgtctctacaaaaaaattttaaaaattagctgggtatgctggtatgtgcctgtagtctcagctactcgggaggctgagaggtgggagtagtgctgagcccgggaggtcaaggctgcagtgagccatgatcacgccactgcactccagccagaatcacatgagagcctgtctcaaacaaacaaacaaaaaatgattcttgccactaagcttaagaaaag

SEQ ID NO: 657078 - DNA, 259 bp, Homo sapiens
catactacggacttgaagtccctccgtgctggtatgcagtcctgggctgactcttgttgtgtgccccctggtacaggtctcacagacgtggcagttccgatctatatccgagatctagcacaatttcccagaacagaggactctggttgttactcattccaatcaggccctatagcagttgtttgagaaaatctatggcattagacatttataagcgcccacctactgcgtttagggtcatggagaaaaaaagctggag

SEQ ID NO: 657079 - DNA, 246 bp, Homo sapiens
tgtaaatgctttcagatctttcataaattccaatcttatgtgtatttttctaaattctataagcaatacatgaatatgctttggctgtaaaaatctcaattattgatgttttttaaggagaagtccagaacgtggttctcacacctgtaatcccagcactttgggagactgaggtgggcggatcacctgaggttgggagtttgagaccagcctgaccaacatgaagaaaccccatctctactaaaa

SEQ ID NO: 657080 - DNA, 878 bp, Homo sapiens
ggactcatggaagagatgaacgccatgctgggccggagaaggaaagccacgccggttggggagaaaatcgcgcaaggatgaatctgctcaatgaggagccagaggccagagtcccggatccagagtgcaatctgtgcggagaccctggtgagaagaacgagcaagcatagcgttgcctaacggatgagagtctgtcattcgtatcaggatggaccgagcttcgcggaataccgcgaatgcacgtgctacagcgccgagctccatgttgattactcggacctacagagggtgaaacgaggagcttctgggaagaggtgaaggaaggacattgcgagaatagtgaacagaggaaagtcagttgaagccattcgtctcagtgagctgtaggaaagacgggggttactcgcctgaccacaggggacccagaaggacccgcttcctccctttccgaaacacccggcactgtcaccctgctattccctgcactctacgttgacattggaacttggcgtgaagactacagcaggaatgcatcgttcccactcccacatacccacttgcgaaaacgtccaaggggggatgtggccttccctgctcaacacaccacaacatggctggctgatttggcttggggagagcccccgagcacttttactaccccttatggatccttcccactctgacatcacccataagggaccggtcccatctgctggcggattgcagccaagtggaaagcccaacagtgaaaaggggggaaagggacaggaaggggaagtttcagagtaaaccgtatgataactaaaattaacaatattaacgacatataatggacttacaaagaatataggataataataagaaaacaaaatattagt

SEQ ID NO: 657081 - DNA, 456 bp, Homo sapiens
ggtcaaaataaaggttttatgaaagtccatattgacttgtctgatgagttgtttgcagacaaaaagaagagtatgtagtgtgcatgcttcaacagtgcctggcccacaggaagcactatagaagtggtgttgagaggcagcagcatgcagggtggttaaagggagaggctctcgagccaaattggctgcgatcaaatcctggcttttccccttacaagctgtgtaactttggacaaataatctctctgtggcctccatgttctcatacagttgtgagaattaaatgagctaatatactgaaagcaattgtacaaaaaaggtgctagataagttttctgctactggaggaaatacacctttcttttatttaagtacctttaaaaggtctgaggtttttcatactgaaaaagaatactccagcctgggcgatagcgagactccgtctcaaaaaaaaaa

SEQ ID NO: 657082 - DNA, 374 bp, Homo sapiens
aaaaaacagatagcaaggcaacaggcctgtctaatcccaaaggagggtggcgagggaatatttagtgtgtgtgtacaattgggacctttaaaaaccgagtcagttctataaaatagagtataaatactagattggtgatattaccatgaaataaaccaggataaagaattttaaagtcctggaaaaagtgaccttcctgaggcagaaaacaaccttttgcagaagagacagtgctaggaacgttcttactgaaaaaacaggggtctcagcaacagagtattagagaatcccaccccacccaatgaaactgccagcagacttaaagaaaaggtatttctcccatcagcttggcggatctctagaagagtaccaac

SEQ ID NO: 657083 - DNA, 1388 bp, Homo sapiens
tccttatgggtttctctagtttaattccatggccaaagaactttacaaaccagtgagattccaagcgctttcctcccaggtcttcagagagattcaaaatccaatatacccaaatttcctagtcctaccaattctgactctcccacaacgagcagagaatctatttttagccaaaaactatcggctgaatacaccgaggtttttaattcgaggagagccagatatgtgtgttcaagagttgttagaggttttccaaacacaagaagaatgtgaacaccgcgaataattgcgagattacgtaggtgccactttcacatatattacgtgttatactactgtgagcctttacagagagagcgcgtgctcttctcgtgtctatgtggaaccctataatcccctttactctctacagatattctcacgaggagtgtcattactattgagcaacagagagactctcttttcccactctcctccatattttacatttacccatcaccttccctatcaatataaaatcaattcacaactacaactcgattcaactctatcaccatataaaatctatatcagagatacagcatcagactacagatccaacatctactcgtcggcctagcgcactacaatcttacaacttcccctaacctgtcaactatcgtcaaagttactctctacaaactcccccactacagagggcccccaaccattgtttatctattgaggcgacgcttctccaccaaaccgcgggagacaccacacgaaacacttatatacgacacaacagacattctgctactatgcaccctcttttgtgcgccatagacgcatcatataaaactcctttacacaataaccccctacccattatccctcactccaacacacgccttccactatattatcccatccacaatttaagattaacatctacgatccacactcccttcaaaatcacactacatttcaccgcatcacatttcccataccaatatcctgttccccctcacaattacttcatactttgagacggcaacaagcgtcgagacaaactcaaaatatagtagaactaagccaacaataacactcctggtaccatgcaccatgggcatttacaacgatgatttccaaaatccctattacaatgacacgatcaaacttcacgattcgggttcctactcgtctaaaatcacagtccgttatacaacatccgtacgtaataagccagtggattagtatactatccctaatccctcgctatacagacaaccgtgtacatcaacagctatcatttgagacattatctttgtgccgataatttatagtgagccccctttggtgattgaggaaatattagctcgctcaccccatattttttagccaagtga

SEQ ID NO: 657084 - DNA, 667 bp, Homo sapiens
ccactctgcatccagctagtgcccggcaatctgctcatctttgctggcgctcacttcatgaatgcacagtcagatggcagatttgccgggactagctgatgcagagtgccagggggaaagccctcaggtctcttgttcacacagtttctctcatcctgcaagtttatttctcatggaccaagggcattgggtcccacagcacggagagacaccatgccaggcaagaacctcatatcatctaggctgggaactgatgcactgttaccacctccaaccacaagatactgtggcaaagcaccgtcattaagttaaggccaggccccaccattttacaaaggtggcgcaactaacacctccaactttcttaagtggggagtccacacctgtaccgaaggtcctgaataatacggggaagagccaaccatcttattgggtgcacatcgttcaaaatcccacctcacacgggttacccatttcggaacggtctgtgtactaaaccaaccaatgatttcctgacaacgccctaaagtggttgtcacaccagccacctatcagcccatcggcaggatacgcattgaaagcacgataagcctacaagacacacactatgctcggccgcaccgtgtattcactgacacgacaagcgcttcctctggcgaccaccacg

SEQ ID NO: 657085 - DNA, 84 bp, Homo sapiens
actgaagacagtgccacttactactgtgcctttggacaagtcccttcctacataccgtactgtaagtgtagcgataaactcatc

SEQ ID NO: 657086 - DNA, 120 bp, Homo sapiens
gttgtattgatgcactctgatagttgttttttcttaagtgtaactatcagaggtggattatcttgcctcctcacttagaataccactagtccacggttggctccttggttggcatcgata

SEQ ID NO: 657087 - DNA, 414 bp, Homo sapiens
taataagcctttagttgagagaagatgtggttctgtttcaggtttcccaggctagttccctggtgtttatttattcaaaaaaatgagcaccgttgttggaatatgtctttgctagacattgatgatttgtaacttctcattctcaaagttgaagggagatctgctttttcatttggtgtctttatgtttctctgttgttttccagcacattatttggtgacatcccatgttatagattaaaatattgcaggcatcaagattgttctcactggcctctcagatatgattggtgttatctatgagataaccctctccggggattttctcctctggctacttagaccacatgttacccaagcaacatgagtaccatgttccccctacaaggttgttattattccaaacttccatttc

SEQ ID NO: 657088 - DNA, 725 bp, Homo sapiens
  misc_feature (725)..(725): n is a, c, g, or t
ttgttccgccggcacggtgaccgggacccggtgtctgctcctgtcgccttctgcctcctagatccctagccactatgcgatgagtgcatctcctatccaacgttgggccactgctgtggtgtccagcatttggcaactgcctgctgcgacgctctagctgcctggaacagcggcagtccaagcccgattggcctagatgccaagtgagcaacgaccacttcggggtgacgcgagagtgactccgttcaacacgcttctctccgtcgagacgtggctgcctagagcaatgcaaccgttgcccccaggagctagtacgtttagaaacgcacattaggaaacctcaacaagtgccataagatagaacggttactgcgactagggcatacctaagcagcccaggctactatccccacgccctaggaagaccaagtctcagtacatacacgtgccaaaaatggcaacgtaattgcattgctcacactaaatcctaatttgtcacgcagaagaggggccaacttaaccaaccactaacatattgagcaagaggtgggcactacactacaaattatcgcaggcacctctaggtaacttaggtgaatctccccgaaacatatacgggcaaataggctttaagtcgtggacaccccaaagatgtgcaacccatggataacgatatcaaagcagagctatatactcatgaggagttaaaccccacacaagagtcn

SEQ ID NO: 657089 - DNA, 1389 bp, Homo sapiens
  misc_feature (51)..(51): n is a, c, g, or t
  misc_feature (90)..(90): n is a, c, g, or t
  misc_feature (92)..(92): n is a, c, g, or t
  misc_feature (123)..(124): n is a, c, g, or t
  misc_feature (159)..(159): n is a, c, g, or t
  misc_feature (225)..(225): n is a, c, g, or t
  misc_feature (247)..(247): n is a, c, g, or t
  misc_feature (254)..(254): n is a, c, g, or t
  misc_feature (264)..(264): n is a, c, g, or t
  misc_feature (266)..(266): n is a, c, g, or t
  misc_feature (331)..(331): n is a, c, g, or t
  misc_feature (349)..(349): n is a, c, g, or t
  misc_feature (358)..(358): n is a, c, g, or t
  misc_feature (373)..(373): n is a, c, g, or t
  misc_feature (375)..(375): n is a, c, g, or t
  misc_feature (393)..(393): n is a, c, g, or t
  misc_feature (630)..(630): n is a, c, g, or t
  misc_feature (651)..(651): n is a, c, g, or t
  misc_feature (681)..(681): n is a, c, g, or t
  misc_feature (688)..(688): n is a, c, g, or t
  misc_feature (776)..(776): n is a, c, g, or t
gaagaagctggcaggggcacgagccgggggcgggtttgaagacgcgtcgtngggtttaggacgtgccgtgaaagacagcacgtattgagntntggtcgtgcgagtgtggagaacgttctgtcnngggggtcccgtgccaagtaaggtagggccacgtcntgttcatcggagttggtgtccatggagttttcaagcgcgaagccgccatatgaccgggttcctagnagcatgccgggtgcattgcggngtgcttngccaatggtncngcaccgggcacggaatcaatccatgggggagcctggctacagtgggtagctagaaccatatgtgnctgcgtgaactttatgcntggagctgncgagtacaggttgancntcgatcacacataccttncctagtgcacacggctagtgcgatactacttgcagttgattggaacgcttcgaatctgtgcttagagttaaactaactttgctctcctgggaggatggacactagggccctcgcatttatatcgccccctcggtagtttctccatatgtgtattggctcagttgcctacttgggtatgcgtttcagttgatttcttaattacactacgatgcttttcgagagtagacctggtgattntgagtggagcaagaccaagtntatactctgattcgacaagctgtggggttngggcatngaattattccaatttcgtgtcatggtgtatgcacgacacatttatattgagtgttcgtgtgccgtgcaagtctctggcacatgtggtnttgcctaatttaccgatttccatctccagggctaaattttgactcagacgtagattcagagacgtagaggtatttcttgaggagttcagcacctttacctgtgagagtttatttgccacctctactgagaaaagtgacattggaagcccattttctctggggtaccttctggggcaatgttcgcccaggtctagtcccctgcccctggatttctattccggtccgcgtttctgattgttataccttttgtggccctgttataatttcaatcaactttgtttgaatggacggttaaatccgtgaagattgtgaacgctggtcggtttctggaaaccctttgcgttagtgtaacatctttggaattcaaaaagttggaggccccgaaaaaacagggtagtctcggggaaggaaattccggccttggtgtgtgtaccccccgtggcgcactttttttgtagaaggcaagcctttccctgtcgagaggaaatctggttttatggggcaaaagcctttatttgtgagaattgccggccgtcggagaagatatttcgccctttcgaaatataaatgtaatgcggagcacaacctcttaactttgtcccttgtatccctt

SEQ ID NO: 657090 - DNA, 1151 bp, Homo sapiens
tgctctcgctgagtacggcgcgtcaggtgttcgagaacgaccccgagagcggattatttatagctcgcaagactagttagactgcagtcaacaagatatggtgtctccggtacaccaaaaactcaggcttcgccaccatgcggtgcaaaacctgcctgaccagtgcacgcccaaacccctgacgagtaggaaggggacccaagcctgccaggacctcatggctcaacttcttctgcctgtgtaaagctgcgctgccggcgggccggctctgctgacaaacgatgtcaacgaatcgcacgccaggagaacgtggggctgccatccagatctgccacaacaagccagggtagcttccactgattcctagccacagcgagcttcgagctctcctctgactgcgcaggacctgccaagcacctcgacgagtgccggcacactcggcaggcctgcggcggacggccgcgcctcgccaagaaccctgcccggcatcctactccctgcctctgcgcaccagcgcgccctcgccatcacagctccccaggaccacggctcgcccgcgcgcctcgtggcccgcgtcgtctgccctcgccgcctgctgcaccggcgtccgcgctgccctcccccaccggcagctcccaccccttgcccctgcccaccggcccctgcgccgcccctcccacgccctggtcccccacggcccctggccccccctcgtccgccgcaccctctctcgccctgcgcctcgccctccccggctgcccccccccactgctgccaccctccttgctccccctgccccggatctctcccccgccgcacccccccgcatcccgactgcgcctccacccgacgcctcgcccccccccccccgccctgctcccctcccccttcgaccctctcccgcgcccccttcgaacccccccggcgccccccccccctccttgcccgctaaaggccccccgaccacgcgaccccggcacctcctcaccgcccccgccaccaccgcgcccgccccccccctcccctcccccccacgcgcctcctcccccctcccccaccactcgcccctcccctccacccccccgctcctcccctaccccccgcctccgccccccccccgaccccctccaacgcccccccccccccccccc

SEQ ID NO: 657091 - DNA, 630 bp, Homo sapiens
ggcgcggtgttgcccgccccgcactcggagcccagagccgccgcccaggaaggggatgcaggaaacccctggctcggtggagcggagaggcaggcgggcaggagccgaggacggcatgtcccaggccccgggagcacagccgagacccacgcgcagccgtgtgaccagccgaagcggcgagcgccgtggcaggctgtcgtgcttgtccagcggcccgtctaacaagcgttctgcagcaggcaggtctttagcgcaggaggctgccgatgagatctgcaagaggcccctgtcccagtctgggccctggcccaggtactggggctgatcctgaagcctggcctcgcccgtgtcgctggggctgctgtcactgccgctgcgccggcggcactgggtggccctgcgccgaggtggacggtgtctactatcatacctggagtctcaagctgcgggcgcccgtaggccctgggtggatgaggacggagtcagggccttcctggcggctgcgctggcccaggcctgtgcgaggtgctgctggtagtgaccaaggaggtggaggagaagggcagatggtgcggtacagactgtacatggttcgacatcggcagccacaggcagtccctgcgcatcccc

SEQ ID NO: 657092 - DNA, 111 bp, Homo sapiens
atccgagatgtccaacagacgtgattcagtaccgagtaaactctgagtggttctcgtccaccatggccaaggcaagcagcgcgcgggcagcccgccgcatcatgtccacac

SEQ ID NO: 657093 - DNA, 269 bp, Homo sapiens
cagtctcaagtgttatactatccaagttttaaatggaaaggtaaactgtggagtaatgaaattttggttttcctgtcccttttgctatcaaaataatattcatgtttgaaatcttgtctttatttggaatttaggtcctgtccgcttttaccctttgctttcctaaaaaaagtttgagatccaaaaagttcaagggattggggaaaaaaaggcgtcaagtcatttcccctttgtccctgtaagttaggtaataaactattatcctcgta

SEQ ID NO: 657094 - DNA, 963 bp, Homo sapiens
atgtggtgtcgccgacagtttgaatgacaaacgaacgcacggtcgacagtacttactgcgttgtaatcaaacggtaaaacagtgtaatgccgttgactctaggcgtaactagacaattgtgtgggccaagttgggcgcgaccaggctggcgagcatagtggggcccgccccaatgatctttgtccgcgcgacaatagtggggccctctaccacgaagggtactagtcttcctcgcggagattgccccccggttgtacaggcgccttatttgtctagcatggtagaccaacgtttcaagagaggggttctgaacaaccacaatggaggctctgggtatgtcccgtcccccccgcgccggtactttttctgtggggagggggagcattttcttccggcacaggtgaaccacccccccctcccctcgccgcagggagattataaagtagtgtcttgtgggtgccctgccgagtagactctcacagtgccccgaagaggcgtcctgatgttcttggaccacagataatatctgtgcgcagaaccccaggggccacccaattaaaatctgggaagaatgatgatgattttgtcagccgcaccacaagaatcggtgccttttcgtgcttggcgaccagggtaaacttggcgggtcccccccccccgcctccgtgaatgcaggggtcacctcaaaatgggtgccaacctgtggtgttgagacgcgaggcgattggccctcaacagtccacatttctcgtagcagttttccagtggccgacctatagtctgtttcgacagtagagcgtggcatattccctccaattgattggcccacagcgccgacacgactctcttcaccctggaggacaacatgtggggcagtctgtccttcttgaatagttaccccagatatcagcatgttcttccgcaccccaaagggttccccccacaaaccactggccacaaaaa

SEQ ID NO: 657095 - DNA, 230 bp, Homo sapiens
tgaattttgaaatttccctgcgacggacatgtgccctgtcacattttccattggttaatcctgaagtttggggcaagtctctctgcccctattaaaaagtgatggaaaaacctccctcttattctggtgaggtggataaaaatgtcttttggatttaaccctttggaattttcccaaaattttttaatttaaataaataaacaccttttttccctcctgggaagtcatga

SEQ ID NO: 657096 - DNA, 351 bp, Homo sapiens
ccccccctttttcccttttattttcaggccctgatttgacttgtggtggggggaacatgtgaaatttgaaacttaaacctgctgcccccccagagcagctttgaccaagggcttcctcaaggggttttccacccaggttgggcccctctctgctgctggacccaagactttgaaccttccaagggacaggcagtttttctaagaagggcccccctgtgtttgggcaagaccccagctccccttttttctacagatgcatgggggttggaagagtctgggctttttttagaccttctggtccgctttttttttgtaacaacttttttaataaatagaaaaaccccctgccca

SEQ ID NO: 657097 - DNA, 142 bp, Homo sapiens
atactcctatgatataacacaactcttctctcttctgctcaagttgtagcttgatgtgagggtcgctcttctcccggaccccgttaactcggccgtcggggtggatacgcaagctgaagccctcgtacttgcagtacagccg

SEQ ID NO: 657098 - DNA, 879 bp, Homo sapiens
cttcatcagcccccgcaagtggacccaggggaggtggagcagctggagatggcccggaagcggctggaaaaggacctgcaggcagccgggacacccagagcaatggcgctgatcggagaggttaaagttaaacagtaagagtgaaccagcttgtgagagaactggaggaagcctagcgcggcaggtggcaactcgtgctactcccgagctgaaaagtctctcaagctagcatgcagtcccgtgtcctcaggccgagcagccccggatccctcacgtccagccggggctccctggtttgcagtccagccgtggactccctccacttcagccagcttcagttgaccttctactatgaccccttttgagcagctggatttcagagctgcgagagcaacggtggcacgttccttgctccttggaggggggccaccgcggttcctgtgccctcaggcttgcaatcaccaaccatccacgaggatgaggtgtccaaagacccagacaggcaagagggagtgttggccagcctgcagggctctgggttccctgtcttggcaaccccaaagtccatgactcccttatccccagggtcctctctccttcctccgcgtccccacccgtggttcgccgttctcaagtgtttgaccccccgctccgggcttggtcgattgccttcatcagcatccgtgggaggttccggaccgacgcccggaatctttagttgccactgtctttggcacgaggccttgtacctagcgcccggaatgcccgggtgggcacctggatcggggcgcccgtggggcatgacgtagacttgggccggggtgcctcaaacggctgtgttcaccgcggcttgtcaacaagaggggcagcgtgttagcc

SEQ ID NO: 657099 - DNA, 101 bp, Homo sapiens
attctgtctggtcgagtctaagagagatccccctggatctgaacttaggccctacgaggggttccgaaggaggggtcttgtgtggacacagagagtacttc

SEQ ID NO: 657100 - DNA, 413 bp, Homo sapiens
gtgagtgtgtccagtgtgtacgaacaccatgagagcacacctcttataggaggacagagaacaggtcttgagtccccaactgtgattgacttttctgatattactggcaactcttttactgtgcactggattggttctctgagccaccattactggctacaggatccggcattattccgagcacttcagtgggagacctctagaagaacgggtgccccactcttggaattccattacccttaccaaccttacttcaggcacagagtatgtggtcagcatcggtgcgtcttaatggcagagagggtgccttattgattggccaacaatcaacaggttctgaggttccgagggacctggaagttgttgctgtgaaccccaccagactactgatcagctggggcttctggtgtgac

SEQ ID NO: 657101 - DNA, 855 bp, Homo sapiens
gatctgaggatcccggtatacgagtaaatattgtccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgattttttttgtattatttgatcttagtgacagtgttctattttgcatcctgtatcttatgttgcttttggtgttttgtgttgtgtgtcaacgattaagccaactaattctctaccatatataacttctggacatttttgatacaacatcttaattctttgtagatatggagataggtacagaactatattctaatgccccaataaggtctctactccttttttagtttttccagtaacagctacacccactcttttcttcctcttcaccacataacgcgttattcactcgcccacaacctctcgctataacacac

SEQ ID NO: 657102 - DNA, 892 bp, Homo sapiens
ggtgtctgttctcctttttggttcagtgctcgcttggttcctcagtgtgctcttcatcatccgcttctgtgcgtcaggtgctagatcccctgggcttttgtgccctgggcgttgtgattcgctgctggtccctctgttgcttggtcccgtcctgccctttcctctcggccttggagttccgtgctttctccgtgcccttacccgtgtagacctccctgcctccctcttgggcctgccgcgctgccccagtttggagctgcctcgtaggggctgggccctttcggcctggtactcccttctcccggtacatccttcacaggttaccttgtccacgctcctccggatccacgctttggacttgctctactattttacttttaagagtccgacgcggggaaagacgggtacaaaaatccagaggagatccaagtcaattggaagatcaacatttcaaaagggtgtccacagtaggcgtaaattaagcccaggctctaccgaccttcaaactacaagcagagctttcaggagcaatgcggagagacggcttcccacccggacctcaccacgcaaccgcgcacaccccagccacattgctccctcattcagccagaaaggactccaactccacctaccaggaggccccccttcctggtgctggccatgttagcagaggcatgttgcatggcatcccacaggtggcgactgccccccaccctcctctctagcactttagagggtccctcatgtggcagacaccatggctaggtttctctttccaactcctgttggtctggcaagtgacagatcatcattcacgtacattaatcagtagtcacccgaacattcctatactgtcccccaattccttaacagccagcgggtgcctccccca

SEQ ID NO: 657103 - DNA, 1015 bp, Homo sapiens
gaacataatctagggcgtgcaggagctgtgtgtgtgtaactagctcgtacaaggatgggtgttccgaacagccgacaggtgtctctgtgcaaaactcatccagatagcaccgcggtgttccatgcatgtctgcaaagtgatgtgcaattcctagacggtgagagaagtcgtagtcgcttaagggaatcatcgaggaagaaaactctggaagatgcgaaagggaggaagcagatgtggtgaagacataagtcgtatgtggtattatagccttcaagggtgaatatgatggtcctggggtggtaaagaggccaccatggagttgcttgggactgtgagttaatgggaaaatgatcagtgcattcctaaatcatgataagcaaggctagacatgcacaatcacataaggtgtgagaatcagacttcctggcttcaatgaactggtgagaactggaatcctcagatgcggagcttacttgtgcaagagcaagatgtgactaagtcacctggctagaccagtggggtctacgcctagtgagaggttacggcagaatcgttcaccgttcacatcaggcaacggctaaggctctgaagacactcccttggctagctccgacaatccagatgagaatatcctaggatactatatccataagatttttgattgtcgaaaattaagactgagataccattgtggaatagcggtgggatagaatcgttccttactgggtgtgacaatcaggtgtgctagtgcacgggtgaatagagctgcggaatccacgttggggaatggataccatgggctaccacgtactatggcagtattgcaggggcattgagtcaaataaacaggccctcacatccacgcacagtacacacgtcggtgtccaaagctactcacgagcgaacaaaggtgtctggaacaagaacacgcctgcctagcgtgcctagaaaccaggcaagcagaccacgccaacacaaccaccaaacgggaaaaacaagcacgcaaccacactga

SEQ ID NO: 657104 - DNA, 2542 bp, Homo sapiens
gatctgaggatcccggtatacgagtaaatattgtccccagcacctaaaacagggtcacacaacattcactaaatgtttgttgaataaaagagttaacaaacataattgaaagctttttttcttcctatatttagcatgaagactgtcattgtttctctaggaaatgtatgaatctgaacttttttgacttgaagaaaaacattctttttttacagagatttggactttgatgataggttttaaaaatatatgataaatattttttgtacttgtttgatttttttttttaaagactttacttcagaaagggaaagactgtttagaaagaatgcatattttttccctatttatttctgtggttactgcttttgcagtttaacagtgtttgtatttgatatttgtatatgtttgattgctatctttaaagtgccttatcagatttatggctctgtgctattactttttgagctttgcaagttgtgtacataataattctaaagaagttactttgtttgcaatgcatcaaatttaaatgatgtgattttttttgtattatttgatcttagtgacagtgttctattttgcatcctgtatcttatgttgcttttggtgttttgtgttgtgtgtcaacgattaagccaactaattctctaccatatataacttctggacatttttgatacaacatcttaattctttgtagatatggagataggtacagaactatattctaatgccccacaatggggctatgagaggggacagatggatgggcaaagaatagttttgtttaacatattaggtcatagttcttgattagtttttttagttaaagataaacacatagggtgtgatttctataccaaagatatgcttatttcagtattagaaaaatattcttcttacatctcctgaaaattgcaatttttaaaatgtgtaaaaataaattattattaaaagcacattttatttccattcgtttggattcattaccttaaaactttattgacatatttcaaagatataggaaaggtaaatgatttcaagaaaatccgtgtatttctaccatgcagatgtaataaatgttagcatttggctatattttcttcagacacacatatgcatgtaattgcaaatgttagatacatttgaagtttgctttgttacctgtttgatcctgtcccgttcctccctccccagagtccccagaggtaaccactagagggggcataatatagcatgtgtttttatatttttaatacaaatatattttttaaaagcgctacaaaatattgttttatatatgtggtagccagcttccagatggccccagtgatccctggcctcctggtggtcatgccccagtatagccttctcctgcattttacagtgctgacttttgtaactaccaggatattgagcaaatgcagtgtgtgatttctgaggccatatcttttactcttttttttttttttaagagacaagatctcactctattgctcaggctggagtgtggtggcaggatcatagctcactgtaaccttagacttggactcaaacaatcctcccatctcgcctcctcctataaagcactgggattacaggcatttttgctcatttttctatgttgttttttttacttgtcagtttttagatattacatattttgaatactaatgatctgttatgtatgttccaattatcttttttagtctggtttgtcttcatattttggttatgaaatcttgaatttttaaaaacgtaattttaccaatctttcataatgatttgctttttctggtttttgtataggaaatgtcataaaaatagtcctattcagccttccaaaagttacaaaatttttgtttttaacatttagatgtttagtccaactgaaatttgttttcttttatggcatgattttggaatcttgttttaattatttttacatatttatagctgttcctccaagtatcaatttttcaagtgcaacatctgtcatgcagttactatgtaagggccagattctgacctttctgttctttttatctgaaggaaatttgaacatgccacccccaaatatgccgatttggcatactgattatttcgagctaaaggtgcttgactaacagtagttgcagaaatggctattttaactgtcctttcctacctgtagcaagccatacaaacttctttgataaagatgctttcctgataccaagatgagaagatggctctaatcagctgagacagcaccagaggaatctacaaacaagaaactattagtttcttaacatatatttaccttccacagtttctgcctctggaagcctaaaactgctttccttcgtcttgtcacacttctctgaaatgtattctttgtggaagatgctatatagtccagagttgtaagccactacttgtgtttaccttttcattgagttttctcctgtgtgatgtacgttgcatatattaataaaattacttgtttttctcttgttaaaaaaaaaaagtcgacgcggccgcgaatttagtagtagta

SEQ ID NO: 657105 - DNA, 2195 bp, Homo sapiens
gagtgtatgtggtgtgttgcgtggtgtgtgtggtatgtggatggatgtgtgtggtgtgtgtgtgctgtgtggtgtgtggatgggtgtgtgtgttgtgtggtgtgtggataggtgtgtgttgtgtggtgtgtgtcgtgtgtgtggtgtgtaggtgtgtggatgggcgtgtgtggtgtgtgttgtgtggtgtgtggatggatgtgtgtggtgtgtgtgtgtagtgtgtgtgtgtggatgggtgtgtgtgctgtcttgtgtagtagtgtggtgtgttgtgtgtcaacgattaagccaactaattctctaccatatataacttctggacatttttgatacaacatcttaattctttgtagatatggagataggtacagaactatattctaatgccccacaatggggctatgagaggggacagatggatgggcaaagaatagttttgtttaacatattaggtcatagttcttgattagtttttttagttaaagataaacacatagggtgtgatttctataccaaagatatgcttatttcagtattagaaaaatattcttcttacatctcctgaaaattgcaatttttaaaatgtgtaaaaataaattattattaaaagcacattttatttccattcgtttggattcattaccttaaaactttattgacatatttcaaagatataggaaaggtaaatgatttcaagaaaatccgtgtatttctaccatgcagatgtaataaatgttagcatttggctatattttcttcagacacacatatgcatgtaattgcaaatgttagatacatttgaagtttgctttgttacctgtttgatcctgtcccgttcctccctccccagagtccccagaggtaaccactagagggggcataatatagcatgtgtttttatatttttaatacaaatatattttttaaaagcgctacaaaatattgttttatatatgtggtagccagcttccagatggccccagtgatccctggcctcctggtggtcatgccccagtatagccttctcctgcattttacagtgctgacttttgtaactaccaggatattgagcaaatgcagtgtgtgatttctgaggccatatcttttactcttttttttttttttaagagacaagatctcactctattgctcaggctggagtgtggtggcaggatcatagctcactgtaaccttagacttggactcaaacaatcctcccatctcgcctcctcctataaagcactgggattacaggcatttttgctcatttttctatgttgttttttttacttgtcagtttttagatattacatattttgaatactaatgatctgttatgtatgttccaattatcttttttagtctggtttgtcttcatattttggttatgaaatcttgaatttttaaaaacgtaattttaccaatctttcataatgatttgctttttctggtttttgtataggaaatgtcataaaaatagtcctattcagccttccaaaagttacaaaatttttgtttttaacatttagatgtttagtccaactgaaatttgttttcttttatggcatgattttggaatcttgttttaattatttttacatatttatagctgttcctccaagtatcaatttttcaagtgcaacatctgtcatgcagttactatgtaagggccagattctgacctttctgttctttttatctgaaggaaatttgaacatgccacccccaaatatgccgatttggcatactgattatttcgagctaaaggtgcttgactaacagtagttgcagaaatggctattttaactgtcctttcctacctgtagcaagccatacaaacttctttgataaagatgctttcctgataccaagatgagaagatggctctaatcagctgagacagcaccagaggaatctacaaacaagaaactattagtttcttaacatatatttaccttccacagtttctgcctctggaagcctaaaactgctttccttcgtcttgtcacacttctctgaaatgtattctttgtggaagatgctatatagtccagagttgtaagccactacttgtgtttaccttttcattgagttttctcctgtgtgatgtacgttgcatatattaataaaattacttgtttttctcttgttaaaaaaaaaaagtcgacgcggccgcgaatttagtagtagta

SEQ ID NO: 657106 - DNA, 94 bp, Homo sapiens
gctcttggacaggatgtttaacagcatccctggactccaccagctagctgccagtagcaacctccacttcctccagttacggaaccagggaaaa

SEQ ID NO: 657107 - DNA, 406 bp, Homo sapiens
  misc_feature (277)..(277): n is a, c, g, or t
  misc_feature (375)..(375): n is a, c, g, or t
  misc_feature (397)..(397): n is a, c, g, or t
tgcaaactaatactacaatgagatatcactacatagctaccaaaattgctaaaataaaaaataatgataacaccaaacgctgacaaggatgcagataaaccgggtcagtcatacactagtggtgggaatagaaaatggaacagccactccgcaaaaccatttgccagtttctcataaaactaaacatacaactgccatactgaccctcaattgctccgggggcatttatacaagagaaatggaaaagagggttcacacaaaaacttgtggcatggantgtttcatatcagtttttatcccttaatgtttcaaaaacttgggggggaatcggtgggccttttaacggggtgggctggggtggaacagtggggtggngtgccctctttggccccgggantacttactt

SEQ ID NO: 657108 - DNA, 168 bp, Homo sapiens
  misc_feature (104)..(104): n is a, c, g, or t
cgatcgctatggggtgctttctccctactcttcacccaaggcagtcatgagactgtcatccctaagaaaacatattcattgaccaaggactcatcccaccaggnacgtcccagatggttgacttcgacacgaatggtgacagcgccattggtacaattggaggcctgg

SEQ ID NO: 657109 - DNA, 211 bp, Homo sapiens
gggagcaccgtgagtggcagatgcatatagcaagtgcactctataggtccaagtcccacatgattactggagctcagtacttgccagcccataagcttggtgagtagctgaacggcatgtaggtggtgctgtgacatctgagaccggagaatatcctgtagctcgtgctcctgataagacagggtaattacgcgatcccagctctagtgta

SEQ ID NO: 657110 - DNA, 467 bp, Homo sapiens
tctgctgtcctctggggagaatgcatttgaactcatctcaaaaagctggttttctaccctggaggtctccgatggctactgcgagaagaaagccatgtcccgaaagcagtgatacagattggcagccactgcagagatgcagaatgtcgaagagtgtgtgtgttggaattcctggacagacactgctctgaaagaaaaaccctctggttttggaagtctggctgggcaaggcaggcggaggtcatggaggggccggcgtgatggaatcctcggtgcagctgactgcgcagcccgacactggcgtggacactgggacgcgtcatgcaacatccaaccagagcatactcacgaggacaaacatgggcccacctatttaccatcagaaaaacaaaatcatgctctttcacttgaaagaagggggaaactggaaagttattatttgaaataaaatggaattttagaaaaaa

SEQ ID NO: 657111 - DNA, 108 bp, Homo sapiens
gaggatcgctcgaaccccaggaggcagagtgttgcagtgacgctgatggttgcaccactgccctccagcctgggccacagggcgagactccgagactccgtcttaaac

SEQ ID NO: 657112 - DNA, 364 bp, Homo sapiens
gggtaaaaacttcgggttttgggtgggttattcttcccgggcgggcacccccaacatgttccgggaataccggggcctgacccccgcaggggctgtcacccagtgcttccgagacatgggtgcccggccccgcggccgagccccctcccttcagttcattaaggtggaggagatcccggcccccaagtgcccccggccggctgtcaagcagttccccgactcccagatcaagtttcccctgcccccccgggtcctgggccgtcagcccaagccccgcttccccccccaggggcccccccccttttttttggggccgggccctcgtccgggtgggcccccaattaactccgggaccccccggtta

SEQ ID NO: 657113 - DNA, 626 bp, Homo sapiens
  misc_feature (228)..(228): n is a, c, g, or t
ccgatgcacgatgataaattcttaatgcataatgatttaaagagctttatgcgacagatctatttcaggacgcacctgtcccaggttagaagaggcatcgttatgcatagttgtttggtgaagagcatgcaatgaggcaatgaagacgatgcctatgtcttgctagccgtttctactacttcagacgggggaagagagagcttatatatcgtgtcctgctacaggtgnaaatcttctctttgatgttgacgccggaatatgctctcttgccgacattttcactgttgagaccttctctatcccacttttgggaggctactcctatcaggtggtcccgcgccccttctgtttgtgctcatgtcgtgaactctggtacagatactgaatgatgatcttggagactggatcatctctctgtggagccatcaaatgcactcttcatccagacctacttttgcactctctggggatataacgcatcacttggcaacaatgtcctgtatgctctcgtccgctgcctatgctggatgctccctatgcgaagcgttgaatttatccttgacgcggacaacccatggaatatgtggcaaaccacctggatgccctgaagttccgtgccgtgtcct

SEQ ID NO: 657114 - DNA, 220 bp, Homo sapiens
ccggggggacggagagcgaggatgagatcatagtagtagttccgagcccatagaacacgtgctcttctctctttcatcacttggtggtctttgtggtgatggcagcagcagactccaaggtgggtactgaggttgatggaatgcctctcttaggtggtaagggtggggacggttttgataacaatgtaccactgtttattgcttggccggtacatgcaag

SEQ ID NO: 657115 - DNA, 457 bp, Homo sapiens
  misc_feature (320)..(320): n is a, c, g, or t
cccttttaccccgggggaacccttcccccccccccttttggggggtgaaggggcggtttttaaaagggcccctcccattggggtttgggccgcgccgggggggggaaatttttaaaaggtttggggccaaccctttttaatttttttttttttttaaaccttggttggggggggggggcccccggcccccccctttgggggggaaacccttttccggcggggggggggggggttggtggttttttaaggttcccccccccccccggcccccttttttggggggggtttttagggggttttttggggggcccccccccccntttttgggttaaaaggggccccccctttttgggggttttttggggggggttgggggaaaaaaaaaacaaaaggggccctgttttttttttgaaattttcccgggggttttttttaaaaaaaaacccgccccccccca

SEQ ID NO: 657116 - DNA, 272 bp, Homo sapiens
agtatgatgtgcacgtggtttaactggtatgatgtgccatgtggtttaccatgtacctattgaaggatattttcgttgtttccagtgtggtactattacaaataaaactgttgttccttaatttcttaaaaaaaaaaaaaaaaaaacacaaacttgcacttgcaagaaaactgacagcaagataaaatgattcaatttttttccatttcttcaaattttatccgtaatatgtggttcccaaaatgtatgtcaccctttattgaatagtttta

SEQ ID NO: 657117 - DNA, 232 bp, Homo sapiens
aaacctccctgactgcatgtctggtcataggctatctgcagggggaagcacatatcacgctgttggctcaatctggcagtccaacctggcattgtctttacacaatcctgcatgcaacttagtattaacaataatcaggagcatatcatataatattccgtagcaatagtatcagggggtctgcctacaatgattattgtaagaattcaaataaaacaaaatttttatcata

SEQ ID NO: 657118 - DNA, 827 bp, Homo sapiens
tcaagaaaaaatcaaatcttgaaaaaaaagggagggaaagctgaagcttggtttcaaagctgggggctacccccaaatacccccctatggtccctcctccttatgtctccaacttccctccaaattcgttggtaagccacctccaagtgtgaagcgtggaacccaaaaactcgtggagaagtggcgccgggggaattcttaggacgcgtgcagtggggatacagactccatcagttctcttcagcttcactcagaatcccgattggggacgaggacctatataaactgggagtgggctaaaactcacgcaaagctcgactttctccctcctcgagaaatgtggctcacgttatctacaaggggaacacttcagaacctccagtttatggtgcctcaccccaaagaaagtagtgaagaggaagattgatgatggtggtggcctccttaaaacccaccttattttgacccgtgaagaagagaaaatctttaaggaaagatggggaaacttgatggtaaggcccccccttcagtgagcgtgccgtgaagaagaaaggcaccaattctggccctcgggggaaatcttaggtctcttggacccattctccaagaatgcgccgaaagagctcttctcggaggcagattaacctcctctttgcccctggtgggggggctcttccccattcaggtccctgacgggccccaccttgtcgcccaggtgcttatggcgggttggcacgtaaaaccgggtggccatctgggggagaacggcacgcacagcagggcacagacgccgaaggggtgtccgtgagtcccttacaaaccgcttg

SEQ ID NO: 657119 - DNA, 350 bp, Homo sapiens
gctgactagaggaccccgtcctgttgctactctgatacttctcttcggttttcctattttttaatcagtctttgctgtatgtttgttctctctgtagaagatttagtgttatgtggtttttttttggtagtgctccttattttctgtagtgtcccttttgggttttttccatttcactactcaccctaagccgtgtcacatttccactgtcttttaaaaccctgtcttctgaatccaaaactccagacctctctgctctaccattatttaataactgtttataaagcatcttctctgtgccaggcagtattcatacaaaatttcctgcccccatggagttaaaattctgg

SEQ ID NO: 657120 - DNA, 140 bp, Homo sapiens
tcggacccttagcaggaactactcccacctggacgctccgtacgactaaccatcttctccttacacctagcaggtgtctcctctagatcttgggagctttgatattcatgtcaggcatcttgaatttgggacctttcaag

SEQ ID NO: 657121 - DNA, 979 bp, Homo sapiens
  misc_feature (616)..(616): n is a, c, g, or t
gtccggcaggagggccaacgcccgctgttcggttagcgacacgcagacagggaggtgggcggcagcgtctgccgtgcttcccagacgaccgaactgggaatccccaagtggggcaagtcagatgcgtggtagctttctctagccttgcttaggccgttcgcactcagtgctgcgattgcgtgcttgaccgccccgagctgagacccgtgtgtcggcgcgggagcgtgagtggagcgaccctccagtttcgtcgtggtggggacgcgcgggcttcatatcttcatgctaaggccgcgcctgagccggtgctgacgccgcgtctgcagccaggtggcactccgttgacggaggtgctggttatccgcgagtcatgttgacctgggtccactccttggcagcacgtacttagtgcatacaccacgcagcacaaggtccggagaaggggaacgtgtcagagcccgtcccggagcgcgtgactatccgggagcatagcttgcgcccaggagtagcaccctgtggagcagagatacgtatccaactagtgactatccgtggcaaggcagttaccacaccgagcgccctgcgtcgaggtggcacatgcctgccccgtctctgncgtggcccgcggcgcgtgtggctccaccgtagcgtcggcctacacggatgctacgcatgggctgtgtcatgggtagggccctgaacgttctggctccgtcccctggatggggttctaatccatggccttgatcccccggggccacgggggagagctcgcggaccgagaagaattgcgacagggaaatgcagcgaaggtagcagcctaggtacgtgcccgcacaggacgggggaagccccggggaagcacccaatgcgcggctaggggcgcccaacctggggcgaggggactgatcagcgaacaaggttccatcgcccggaaatccactgcaggtccccacggtccccggggggggaatagccg

SEQ ID NO: 657122 - DNA, 806 bp, Homo sapiens
gaaaatcaggaagagccagcggggagtgtgtgttgccatgcgcgtctccgcctgcaggtatgtgtgtctcagtgacagtgcgtaggcgtgtgcctgggtgtgagccgcgcggcggcgtgtatccgaatgacagtgtgacgcacgtgcgcgcgcgagtgtgtgtgtgcgcgcgccggggtgagtctcccgccccactccttcctttccccatttctattcctctctcctctcccggccagtcggcttcgccatccgcatcatctccatccattattgaagaaacagccgcgtccctccaatcacatcaacaccccgcccctttccgttccgctcgcccagcggcctctgggtgctgacgagaggggaagccaaggcgcggtgggggcgccgggtgggaatgggcttatgacccttgcccaagcccggcaggagccgggacgccggggtccccggggagagcgctttgcataaacagatggcgcgggcggcttgtctcaatcgttcgctcaccggcagtcccggatccgttctgtctggctgatgctaatcatgatcatctcggtgacctcgggacaggcgcccttaataatggccagagggggggtcaggggcaccggggtcccgagacagatgctggccctgtgttattacctttccgggacgcccctccaagtcccacaagcgaaggggaagatcaaaagctgcgcggagttgaacgggcatgtggacggtgaccaggatgaggaccccggggaagaagccccagaggcgtatcgggatgaccagtagggtggataacaacacca

SEQ ID NO: 657123 - DNA, 774 bp, Homo sapiens
ttcttcgaacaggttccccgcctcctctcgaagtttttccctaaccctgcgccccgatacgggctttttgggacctggcagacccagcttatagaggactcccaccggagcttcatggttgtctttctgggaactcattgccatgagatcaggacctccttcgcaaaaagaagaaggtagatccttaaagccctatatagccaaaggagcgcttgaaaaggaagatccggcaactgggaaaggctactccagagcttattcctacttgaagattgtaactaccccctctaaaatttcttggagtaaagcaacgagagcggcctccggtggagctcacccttgaggagacttagaaggagatgctctgcttctgaagaaatggtcccttgtaccacgccacgccacgagccgtctagatggagagggacaccactcacgggctatgctagaagccccgcacgggagcttctggaggaactgcacaactgggagtccccgaagctccacagctgaggccactccaacgggagtccttaacccggttcccccttgagaaggaagggccacccttacataccccccgagtccctaactacccaaccccctgaaggcacggtacaaatgacatcaacccagggggtacacacaaatggagtttaagagatagactgcaggctgctatccttacaagcgcccctgagagtaggaatgacccgggttcaagtctgctttccacagatcaggcattctgttaataaatactggttttatcca

SEQ ID NO: 657124 - DNA, 317 bp, Homo sapiens
cgctgagcaagctgggtaacacaagtgcattatgtttgagtagtgggaccggctctgatcaggtcctgaggccatgatgagaaattgggcttgtttcttcaacttgctctttcctgttgaagtcaaaagatggcttctttcttattttgtgtcctgtactatattgggtaaataaagtgatgtgtactttgttaagtgatccatagatacttttttggttgatgaactcttccatcttctatcatcttaggctgcctggtgtggggttgtactaggtgtatccgatggttctcagtccccttcccagcttgctcaga

SEQ ID NO: 657125 - DNA, 971 bp, Homo sapiens
  misc_feature (971)..(971): n is a, c, g, or t
gctcattgtacccatgctaagtcgcaagggtattcctaatgcttaccgaacgagaaaattctagggctatatacaagctacgcaaaggaccccaacgttgtaggccccgtacggggctactgacgaacccttcgcttgaggccgatgataaactctgtcaccgaagaggagcccctaaaagacccgccacatctacgcgatcacccgtgctacgatcaccgcgcccgaccttgagctctcgaccatcgctcttcgtattatggaaccccctctccgccatacccaatcccctggtcaacctcaacctaggcctccgtatttattctagcctacctctagcctagccagtatactcaatcctctaatcagaggtgagcatcaacacgtcgaaactacgccctgtagtcggctgcactgcgagcggtagcccaaacaagctcatatgaagtcacgctagccatcatgctactatcaacattactaataagtggctcctttaagcctctgccacccttatcacaatagaagaaaacctctgtattactcctgacatcatgagccttgggcataatatgatttatctccacactagcagagacaacgaacccctttcgacttccgaagggagtcggactagtctcagggctcaacatcgaagacgccggagcccattggcctattgctaatgcgagtagaacgtatgataataggcgttacagaagattcctggaacatttggattccctagtaccacaattgtccgacatattaccccttgtaatcagaagagcctcgtgaggctatcctaaagtgcaccccatatagggcgagcagctcacaaaaaacttgatcgtgttctctctcttgcttcctcacactatctcaccagagacgaagaggagacagaggacagcacaagaaatgaaaaagagaaaagaagaaacagaggagagggaagaagagaacaacgn

SEQ ID NO: 657126 - DNA, 83 bp, Homo sapiens
ttaaaaacccccccctttttttgggaggggggcttttccaaaaaaagctgggctcaaaaccaaaaaaagttttttgaaggcca

SEQ ID NO: 657127 - DNA, 83 bp, Homo sapiens
gcggccgcctactactactactactgctcgaattcaagcttctaacgatgtacggggacatgaaataaaagctttgcaaaggc

SEQ ID NO: 657128 - DNA, 333 bp, Homo sapiens
ggcttttccccgtcccagtggagggtggggtggggggggtcggccagcccttaagcctctgggagcacatggagcccaggagggcggcgccggggtgcctgctggggtctcgggaggccgcggtgtcggcatcggccgcggagctgtgtgtaccaatctagccgtgggccctggggcactttgggaagctttgcagggggggcaatttccttgtgggggccgggccggccgtttcggggcccggagggggtgccgggcttgtgccgggtagtgttgcgggcgctgaagctctgggacacaggttgcggtgggccccgccctgacttcggtgga

SEQ ID NO: 657129 - DNA, 320 bp, Homo sapiens
agggctagagctaagattggtcatggaggcagacaactgtgcccaaggtatactctgaatatcagagattgggtgagcttccctgtttggaaatattctgtatatattgttacttgttgataacaggacagtaatgctgtcctgactccactgtgatagacatttgaagctctacgttcaggcttctggcttgcctaaatctctctctgtgattatctgtatcatgtagtatatgaccatacatgatatacagcttcagtgcatctgtgagctgagcatatttgacacaactaatgtcagctagcacagtgcttctactt

SEQ ID NO: 657130 - DNA, 82 bp, Homo sapiens
gctttctggatttattttttcaatattattctaaatcattgatgattactttattaattttcatcccttctgtcgtcttctc

SEQ ID NO: 657131 - DNA, 268 bp, Homo sapiens
ctttgggaggccgaggcgggaggatcacttgaggccaggagtttgagactaccctgggcaacacagcaagacctgtctctacaaaaataaataagtaaataaatagccagatgtggtggcacacgatttgcggtcccattactaggggcggggaggggcgctgaggcaggaggtttacttgagcccgggagttcaaggctgtattgtagtgaactaagatcatgccactgcactccagcctgggctacagagcttagaccctgtcttt

SEQ ID NO: 657132 - DNA, 302 bp, Homo sapiens
ctgcttggcttccgggggggtgcctcgggaaacttcccatcatggcagaaggcaaagggggagccggcccttcccatggctggcggtggtggtgggggcaatatggggggccttcccgcccccttttaagtgaccagatttcatgagaccaacaccaagagggagctctgcccccatgatccagtcccctccccccaagcccccccgccagcattggggatgccaattcaacatgagacctgggtggagacccagatccaggcggagacccagatccaaattatgcatttttcccctaatta

SEQ ID NO: 657133 - DNA, 135 bp, Homo sapiens
ttgaggatcctgaaacctaataatgctttgatgtgcacatggtgctggtggtttaaaaaaaaaaatacactacatttagagatcgttgtaggttatagtagaattgagatcagattctttatcttgcattataca

SEQ ID NO: 657134 - DNA, 230 bp, Homo sapiens
tgccgaatgctttacctaggaggtggaggttgcagtgagccaagatcatgccactgcactccagcctgagtgacagagtgagaccctgtctccataaataaatagaatgaatgaatgaatgaagaattcagtggttattagtatgttcacagtgttttgcaaccatctccactgtctaattccaaaacatttctgtccccccaaaaagaaactccccacagagagagcgt

SEQ ID NO: 657135 - DNA, 898 bp, Homo sapiens
caaatataggctaggtacgagtgctggttgtaatttgtggacgaggcttggctgcaacggttccatggacacaagtcagtacgtgttcagaagctgcagtgcccttgaacagtgagcagagtgcagatagattggcgggcgtgctgaggtggagatgcagctgagtgagcctcatggagtcagtgtgccaacaagctgcaggaggagtgtgctgatccagtgagtggttcaccctggtcaacaagaagaacgctctcatcctggagtgcaggaccagctgcatgctgctcatgtgagtgatgcaggactatggagctgaagtgttcgatgctgctgagccgctgagctgccgggccatgctggccatcgaagactggcagaaaacgtcctgctcagcagcacctgagagcagctcctactggagtgagctggtgtcgcttggtgaaccagctgctgatgagctagtcctgggacctggaccacaagtagcgtgatcgccctggaggatgtgacgagctgcctggagctgctggctggaacagtgtctgccgacaagctgagccgtgtagttgagcctggagggagcgctgcgtgcttagctgatggacgcggcccgggttgcccataacttctctgcgtcccggagatacgtcgtcgaccccggtggccatgctgcatgcggtacgtatcctgtgccgtcccggagggaccaatgccgcgtttttcgctatgggtccggcgggctccctttccccgaaatagggcagggtgagatccctgaaccccagggtatgggatgcagcgatttacttatgtaacggaggatatttagagcactggtgggagtggggtacatccggaggtgttggcttgtcgtgatcatagggggaggatcagg

SEQ ID NO: 657136 - DNA, 270 bp, Homo sapiens
gcgggaggggtcctttaaaatgggtgtggggaccagtgggtcagaaagtgggagcccaaggttttactccctttggtttattttttcgggcccacacacaggtcaaagccaagggcttataaaggtttagtggggtttcaggatgtgacaggcagtccagcctgccctttttgccccctccagacaaacttcccagacaagctcctttgggcctttacgtggagaggggggggaaagttttccccttaaaaaatgggggatttgttttga

SEQ ID NO: 657137 - DNA, 493 bp, Homo sapiens
gtgtgaacactactaatgctaggtacagctgcgtgttaaatcaggccgagggcgagcagagagagaactagtctcgaggtatttgtctgtcaattttttaccctgaacacaccgtggcttaattattaacggatgccaaaagcacatttcccaaaaccgcgctaaaggcgggcccccaaaggcggaggacactacagctccttcctctggggcaaaaaggagggtccctgggaatttcgagggctgcaggtgggcgagcgcagagggtcccaggcaacctgtttgctccacaattgtgcacggcagctggcatgagacggcgcgcgagcggcgttgggccgagcccattgagtccagctgaggcggccgcgacctccaccttgtgaggagcgggtaggaggaacctttgcccgcttgcttgcggattgcttgggatctccgccgcgccctgcgatcccattgaaggctttgcagcaccccttttgttggtgtg

SEQ ID NO: 657138 - DNA, 719 bp, Homo sapiens
atggacgctgaaggcctggctgctgctgctgcctgccctgtcacccttgcagccctggtggacagcgtggctccgagaggactgcccagtggctcaactacgcagccttggtcagcggggcaggcccctccgcagtgcggcgcgttgtggggcaagatcccctgggtgtactggcagtggcagccgtttcgttcgatgccgatatttacccagactcaacttgccaaggtctccttggttccgtcccctgagggcgatcgaagcttggttgcctggttgggccagagttggcctgagtgtcctgtgtggccgctgccgcacttgccttgcttggctggggggaacggggttggccgcgtcaagcactgcttgtgccctggctgcatgttgtgcatttgcccatgtgcttgcctggcctgcttgcatgttgtgagtgcctgcccagtgtggtgcctgtgctgtgagctggtgcacgtgtgtgcagtggcgactgagggaatgacccactgcccgaggggcttcctggcctgtgttggacgcaacgtattggggcgtcctgtgtgggcgggggcgcgcgctctgcaccggcttacggaccctgggtgagggctgcgtgcatgcgtgaaggggattaacgcatgttgttttggcccgcctggtggcgctgtgtgacagtgcggtgctggcctgtgccaacatggcgtgctgacgttcgggtc

SEQ ID NO: 657139 - DNA, 367 bp, Homo sapiens
acacacagagcgttcacccagataggttaatagtggggggtaaggcgaggttcgcgaggcttgctagaagtcatcaacacgctattagtgggagtagcagttagcaagtccttcacagcaggattatgcatgcgcactgtgagtgcgttcagtagttagcagttagcataggcagcaatagtcaatgaggcatgtaagcccagtgggcgcattatgcagcaatgagtgcgccggtgaagcttcagggggttaggatgcagccaatggctgttcctacgagggctcatgtggctgattgaagagtatgcaatgagcgattttaggtctgtttgtcgtaggcagatggagcttgttataaattatgcct

SEQ ID NO: 657140 - DNA, 701 bp, Homo sapiens
gtctttttccaactcctttttgttagtaaaggggggtccaatgtgccctaaggggttcttgcgcccttaaaattttttaaattttgggttcttgcgggggactttagtccataatgtttgttaaagttttcccatttcttgccccctttacaatagtgccaaaatttccaagttgttttgacatgtatcttctttattctcccattcctgaaaggtatatagaccaaaaattaagttttacttttaccaaaagaggaaccacacacactttgattggctcctaggttatatagctaactggtaacaaaccaatttttattaaaattaattttaaaaatttaacttttaaagtttatcttaaatgatgaacatcgcttgtgtttttcttgcatgtagtttctattttaggagaatttgcctaggggtagttcttcaaccaactagtagaaattggtgtattaaggtcttctaccttaaactagctgtcaactttaaactcaaccatttaataattaaatttaaactttacatttgtttattaaagtagtgatgtttctcctcaatcaacttttcttcttaggaaagtaattaatgacaaaaatggaagaacatttattaaagatagaaaaaatgtttaatggtcgtgtacatataaatggtggtaatgttttgacttccttctaattaagctattatttaat

SEQ ID NO: 657141 - DNA, 416 bp, Homo sapiens
ccaaatgtccaacaacgatagactggattaagaaaatgtggcacatatacaccatggaatattatgcagccataaaaaatgaagagttcatgtcctttgtagggacatggattaaactggaaaccatcattctcagcaaactatcacaaggagaaaaaaccaaacaccgcatgttctcactcataggtgggaattgaacaatcagaacagatggacacaggaaggggaacatcacactccagggactgttgtggggtgggggtagtggggagggatagctgaacaagatttaccgtaagctaaatgactcgctgctgggtcctaacatggtgactgatagacatgcctgctccaacaagaattctccacagcgaacatgttttggtcaccgtaacagctatccagcggaccgatac

SEQ ID NO: 657142 - DNA, 178 bp, Homo sapiens
cttagatccgggtaaactagtgcgagtgtaatcgatatggtgtctcagtatgatggagcactgatcacctagtagcagaacctaaacctagaaagacacaaactctcttacactcagagtcaatacactcttctcagtattatctgggtttagatgcatctgtaggaagtaggtaaag

SEQ ID NO: 657143 - DNA, 602 bp, Homo sapiens
  misc_feature (474)..(474): n is a, c, g, or t
  misc_feature (486)..(486): n is a, c, g, or t
  misc_feature (494)..(494): n is a, c, g, or t
  misc_feature (509)..(509): n is a, c, g, or t
  misc_feature (536)..(536): n is a, c, g, or t
  misc_feature (558)..(558): n is a, c, g, or t
  misc_feature (602)..(602): n is a, c, g, or t
agaaatagatgaagaccggatccccaactcacttctcaagtccaccttgtcaatgtctccacggcaacggaagaagatgacaaggaccacacccaccatgaaagagctccagacgatggttgaacatcacctagggcaacagaagcaaggggaagaacctgagggagccactgagagcacagggaaccaggagtcctgcccacctgggatcccagacacaggctcggcgtcaaggccagatacccccgggacagcacaaaagtctgcagaatccaaccccaagactcaggagcagtgtggtgtggagcccagaacagaggattcttcagcccacattgctaccactgggattcccagggagcccagctttgggtctgacagaagttggtatccgggggattcaccactgcagtgtgggaaattcatggacactgggatgtttctttaatctcttgttttttaaaaagtgataanttttggtgtttnggtccttnggagctttttcttcntttccagcccggggatcccttcctccnttaagctcttgtttgaacccantgtccccacccttaaggaccggttaaggaagggaaattgcaaan

SEQ ID NO: 657144 - DNA, 319 bp, Homo sapiens
tagctttctgactcggggctggggccttcaaaatttcaaaaggatttctgctccccgataggaaagcacgcttggaatcctgtgtcacgaacacattttagcacacaagtggaaccaccactaaggcccgtggtgacagtgttcacttggctatggggacaactcctcactacagacagcctttacgctcgtacaccagcacggaacgccctccgaagtctgcgcgtgggcaccacaacaacaacacttgtcagatttgggcgcgtgaccccagcgcctgtatggggcacacaaagggtacaccacatctactgaccat

SEQ ID NO: 657145 - DNA, 262 bp, Homo sapiens
cccccccttttttttcccccggcgtctgtgggggggccccccccccctttttttttccttctttgaaaaaggggggggcccccccccccccttttttttttggggggggggggggggggtttttttttttccccggcccacttttttttcttccccttctttgtggccccccccccccagttttttttttaaacaagggggggggggggggggggttttttgtttttttttttcccccccgcccccccccccctgcccctta

SEQ ID NO: 657146 - DNA, 279 bp, Homo sapiens
  misc_feature (85)..(85): n is a, c, g, or t
ctttggcattttcccgggacaaacccaaaaccctaaattgttccaagaacccctggggtttggttactcccctccatgtggccgnccacattcatgttggaatggaacccccttcccccgttttacaaaatgaagcccccaaatctggctgaatgaaataaattggtgataagtggaaaaaaaagaaaaccccatgtttcatacccatgtatgtgaaagtgtaaaataaaatgttcctttggaatgcctataaccattaaaaaaagcctggaagcttta

SEQ ID NO: 657147 - DNA, 426 bp, Homo sapiens
  misc_feature (86)..(87): n is a, c, g, or t
gatcacggagatttcatgaacctgacgctgaatccgtcgcgttaagcgacgcagaggtccgataaaagcccgccgatatttgccgnnggggctttttttcacggccggcgtttctgcctctgcgattgcgcctacttgcgtgtcgccacgatgaacaggcgcggaaacggcagcagcaccgtgccatcgtcgagtgccggataggcctgggcaatcatgtcgcgatagcgcgtgaggaatacggggcgctcgtcctcgctcagcgctgcgaggaagagccgcagcgcgctcccgttgaaccattcgaccaccgcatcggtactgccttgcagcgggtgcatgtacgtggtgcgccacacgtcgacgcgcgagcacagcggcgcgagcagcgcgtaatagcgacgcgcatcgaagcgctccgtccgt

SEQ ID NO: 657148 - DNA, 266 bp, Homo sapiens
caatgtatcagtagaaatatagtttcatggttagagctttagactgtccttggatgttctggtaggctacagcaatacgtttcacatatggatagtctcctgtacttcaacgtgaaagaagacacccttcagagtcaaatggacaggaaccatcttcagcagtttatccatagcattcattcctagagtaggggtaaaaagaacataggcaaagtttacaaacattttttcaagtagagatgtcttgtcaactggctgtacatctt

SEQ ID NO: 657149 - DNA, 628 bp, Homo sapiens
  misc_feature (166)..(166): n is a, c, g, or t
  misc_feature (172)..(172): n is a, c, g, or t
  misc_feature (193)..(193): n is a, c, g, or t
  misc_feature (309)..(309): n is a, c, g, or t
gcgatagggctgaatcgctcaagtactgcaagggtgtgggttgacctatgtacctctgtgacgatggagtacctacgtccaagggagaggtcagactcacactgcatggattagtgcagaaattgacacctgcagagggatcagtcatatcaatacagcagacttntgaatnctgaacgatgtccgaaatgtnccaacgtgttttgccggtgctttttacctgaacgaagtcgatgtatccatcagatacaatgtcgatatcgtctgtgacctcgcagcgcacactgcggatagtcttgtcacgaagcnttcgggtgacatggtacagcggcatacgcaagacctgaaataagaaacacgtgcttggaggtaaatccggctgaatcgtgacgacatccccactcaagcaaagtcccgtggaacaacaaaaggcaccaaaattaaaagagagacggtaagatgacaacaagagcccagtacggaatacacatgaaatcaaaacacccaagatgatctaccaatacctaacaacaagaccagaaccagaaacggcagagcaagcaagccaatacagaaaaacccacaaagaatggaaaccagacagtcaaaaaagagataataacgactg

SEQ ID NO: 657150 - DNA, 623 bp, Homo sapiens
  misc_feature (465)..(465): n is a, c, g, or t
ggggtcaaattgggctgcatgcaatggctcatgcctgtaatcccagcactttgggaggccgaggcgggtggattacttgaggtcgcagttcgagacaagcctgatcaacatggtgaatccccgtctctactaaaaatacaaaaaaattatccggtcgtggtggcgtacgcctgtaatcccagctacttgggaggctaaggcaggagaactgcttgaacctggaaggtggttgcatgagccaaggtggtgtcattgctttccagcctggacaacaagaacaaaactctgtctcagaaaaaaaaaaaaaaaggaaaaagttgtgcgggggaggttcaattggtagggctcttttctctatttacccattattttctcaaattcccttcttttctcctcttatcaccttgggttccctcttttaaactcgggagttacctcctataatacttctctccgggaacccangtgttgtgttgttgttgttgggaatagcggaagtgggagaagatatatatgtcgtgttaccttgtgaaaaaattttaattggcggtgaaaaaaattctccagttttttaaaagctttaattgtggggttgtgggtaaaatattttgggcaggggaaac

SEQ ID NO: 657151 - DNA, 202 bp, Homo sapiens
catctatcagatggagtctgtcatgctgatggctaggctatgtctgggcctcccacgcagacgatgcacgagggtgacgaggggcctggccaccagcataagccaggcctcggggagggcaccccctaagaccacagtgtgcaagatcacagtggccacggacacggacacagtcatggtggccacggccacagccactaat

SEQ ID NO: 657152 - DNA, 531 bp, Homo sapiens
  misc_feature (197)..(198): n is a, c, g, or t
  misc_feature (377)..(377): n is a, c, g, or t
  misc_feature (392)..(392): n is a, c, g, or t
  misc_feature (404)..(405): n is a, c, g, or t
  misc_feature (428)..(428): n is a, c, g, or t
  misc_feature (434)..(434): n is a, c, g, or t
  misc_feature (442)..(442): n is a, c, g, or t
gtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtatatttggagtaaatttgttccacgtcaagttctggccttctgnngcaatgcaaagaactagtcgttagaacccagttgagacagaccagtcctgtggaataagatcccttaactcttagccatcgtgacatcaaccctagaccgtctgcctggcattgcgtcaacactgcgggctagtaggcagttaatcctccacttctcagtggtgaaccatgtgtttttnggtggtgatgtagangatagttcctgnnccctgccccgtccctgctctttnccaatncctcctangcggactttaaagctaaaaaaaaccgatggccaattcatcctggggaaggtgcttccccggatccctgggcgggtcgggctgcacgggt

SEQ ID NO: 657153 - DNA, 103 bp, Homo sapiens
attagtcttctctaaatgacgagaagatactctgcatgtgtcggtgtggtacatacgacattggaaaatgcagactagtgacatcttacctggcagctcagca

SEQ ID NO: 657154 - DNA, 415 bp, Homo sapiens
tcggctcattagttcatatcattgcagtcgagctactcagtataatcctgatatgaacgagaacacgagcgtgaatataataaactgaaggaacgctctacatcaaccttgtcatgaacaagaaagataagaaaactagctatggacattttgaattatgtcgggagagctgatggaaaagagtcggagatggtaaacgagcaggtaaagccagtttaaattgataaatgtaatcagacttccttctatcctgcattttcatactgacagtttctttctcaggaatgaagagaaatgtataaaatgctctgaatgattatgaatatcgtcagaaacaaatcctaatggaaaatgcagaacttaagaaggttcttcaacaaagtgaaaaaggaaatgatttctcttctttctcccc

SEQ ID NO: 657155 - DNA, 128 bp, Homo sapiens
  misc_feature (103)..(103): n is a, c, g, or t
  misc_feature (121)..(121): n is a, c, g, or t
ctggcatcgccatgaaggtgctgggcgcgtggccctcttctggatcatcttcatcctgggctacctcacaggctactatgtgacaagtgcaaataaatgcgtnacgcatgcacgcgggggntggccgc

SEQ ID NO: 657156 - DNA, 355 bp, Homo sapiens
  misc_feature (6)..(6): n is a, c, g, or t
  misc_feature (24)..(24): n is a, c, g, or t
  misc_feature (50)..(50): n is a, c, g, or t
  misc_feature (86)..(86): n is a, c, g, or t
  misc_feature (95)..(95): n is a, c, g, or t
  misc_feature (118)..(118): n is a, c, g, or t
  misc_feature (154)..(154): n is a, c, g, or t
  misc_feature (215)..(215): n is a, c, g, or t
  misc_feature (246)..(246): n is a, c, g, or t
  misc_feature (280)..(280): n is a, c, g, or t
  misc_feature (292)..(292): n is a, c, g, or t
aggtcnaacatgacgtggtgatgnaaagcccagcagcagcctgccccaanaagctggcactgctgaaggcccccagcccaagaagnaaggggcantgccgcccacctcctcccaaganaccttcctgaggacgctggccccagtgcaggccaanatcccaccccctacctccatatggggccttgcaagtcatcccacaggctgcactgtcaggnagaggaccctgtcccccagcactgggcttcncctagaacttcagtgggggccaagggtgctgagnacccagcaatgnccagggagatacagtcactaacttcatctgtccccgtgccccctcccaggtcctgcctccaca

SEQ ID NO: 657157 - DNA, 612 bp, Homo sapiens
cagataactgattacttctgggctgaaatatgaggattctataaggacgcctggaacccaaggttttaattggggttgggccaagcccattcaccccctctttgggttttttcccccccgggccaattataaacccttggggggggagggggggtggggactcccccagaggggggggggaattttctcttttgcaaaacaataaacaagggggggggggggggcctctttttccccaaaaaacaacacacaagggggagaagggggttttttttccccccccctctttttgggggcccccccccccccggggggggggggggagacgcgccccccccccgagaggggagaaaacccccctttttttttttgggggggggtaaaaaaaaaaaaatttttttttttttttttttttattgggggggcccccccccccgagaaaaaaaaaaaaaaaaaaaacagaggggggtgggggtggtgaaaaaaaaaaaaaaaaaaaaaaaaacccccccccccgcgggcgggggggggtttttttcactttttaaagaaaaggggtttttaaaaaaaaggggggggcgggggggcccccccccccccgggggggggggg

SEQ ID NO: 657158 - DNA, 216 bp, Homo sapiens
tgtagcgcctttctggctctcctcacagattctttcccctcccctccacctgaacagaaggcctccaagtccttttggtgccttgtgaggacttttagaaggggcgtgcagctttaaaaagccggtcctatattacggctcggacgcagtgagcttacgcactgtatatcccatgcagtttgtggaggtcgaggtagtgcagatacacctgcaggt

SEQ ID NO: 657159 - DNA, 189 bp, Homo sapiens
cttgcttgtacgggggacggaaccttgggtggggtcacaccggggacagcgtgtatttccgcgtgacgcccgggagatgtagccatgctcgtctgccgctcctcgtgcttgccgggtgatctccaccacgccatccttggtcttgaccgtcagctcgcccggtcccggtacatgcaaggttacgagctc

SEQ ID NO: 657160 - DNA, 377 bp, Homo sapiens
  misc_feature (12)..(12): n is a, c, g, or t
  misc_feature (40)..(40): n is a, c, g, or t
  misc_feature (95)..(95): n is a, c, g, or t
  misc_feature (106)..(106): n is a, c, g, or t
  misc_feature (337)..(337): n is a, c, g, or t
  misc_feature (355)..(356): n is a, c, g, or t
aaaccttcctgnaaaaaaaacctccccttcccccccgtcnaagtcatttggtgacctttaatggggggatttctggttatgtcaaggctctgganacaggaaaagnctttggccgccttgggtagttgacctgccttttctgactccgggacgagccagtcctaggctgctccgggagcacttgaggtatcccgcaggccatgaggacccactgggcagctcctggacagcctcttggctccagcccccacccgaaagtggacaactgtccgccctggccacctggggactggactgtggtgcacagtggcccaatgtggccaacggaagttttatnaaagacaaaatgtatatnnataaaaaattttataacttgc

SEQ ID NO: 657161 - DNA, 836 bp, Homo sapiens
  misc_feature (329)..(329): n is a, c, g, or t
  misc_feature (513)..(513): n is a, c, g, or t
tacttggactctttcagaaacctgttgaaagttttgaaccaccacttcagaagaatgcttaagaattttggttttctgtactccagagttcctttaaagctctagtgttttagaaacatgagttactacatttaatgtaaattagagtgaggaaatgaaatgaggtaaaatatgtcacttaatcaggaaagagaggtgggagagaaatacagagtagcctccagaaagttgagagcttggatttcaaaagtagaattttcgagcttcttaaatggctggggaaacagaaacatacaattatgtttgccttgagtcccagaagtcctccnacccccaacccccaactgtgaatgtagagggtgggacatcaagaagtggaaatacaacaaaagagacaatttggagaagggatggattgatacagcaccagataagtaggtttgcttaagcataagagaaggaataggcagaaaagtgaagaaaaaaataaaggagattaggagcctgaaatgngctaaagagccctgtcaaaactgaaggtaaggattcttacatgtaaaggccataggaaatctttacagggtattgaacaagaggagctgggatttcgaaggtgacagattagcatataaccagttgtggtggttatagagacttgggtaacaaattggggagggcagagagaaagagaacaagcttggatgcagtttcacctttccatatctgttaatattctgttttcaagtatggatgaagggcttttaaaattttattatttttaaatcttctaaatggcagaatggttttactattaagtattggtgagaaaagaaatg

SEQ ID NO: 657162 - DNA, 1138 bp, Homo sapiens
cggacgcgtggtgaaaacatactttgtgagagaatgaactatggtgcatggcagccagtgattcatttattgtttgcccacgtgtatgcgcatgttatttctctggagttctcaagagttggtgactgtggaaggccgcttcttgcaatggcaagtctcaggaacccagtgcaggtacatctgcttgcaaaccttgttttttagctatatttaatgacgggctttggggaacgagctgcccgcatactgagagacagcttcttataaaccaatggagagtttttggtgtgtgcgagatctctaagccagcgtgggacgggagcgcctcaggataacgttattatattcatttcgtagggtatctctcctgcccaattcttggcacaggcattatgttggaagaaaccaggataaggtacactgcttcggtctgtttaattttttacagttggtttcccttcactttcagtccttccacacacaaaaaatacctcacagagcttcaccgaaatcacagattcaggaggaattgggctttcacactggactcagataccttcttcagtgtgttggaaatcactggcttcacacaggcccaactccagctggtcagggcagagtgatcgtaactaaaggtcagtggggcaatagatccgattcagtgcttttgcttatgcatacagcatcctggctcccagtgtgtgctggagctgatggagtgccacaactgggcacactttcaggacaattcttctggactgagtggtaaatttggctgcaattcaatacttgaggccaaggcaagacccttggattcgataaagaactgcaaagcacggcagccacttatccattgcagccaggccgggaacagacaccgcgatgtgtcaaagtggctacaacttgacccagaaataggcaaggggcagacagcaaaaaccaagtaaagagccccaacactgtaaccagactaacaaggcacggtacaacataacacaccggataccgctgcactagctatacagcaaaacgaaaaaaataaaactgaaaaagctagcagtcacaaaaaacaagcaacagtgacaagcatacacgagtggaaatcactcatgtgtcgtctgctgttcgtgtcttcacc

SEQ ID NO: 657163 - DNA, 371 bp, Homo sapiens
accttcatctcctcccactcgccaaacaggcgtatcggtgcgttctgacagtgtctgtcgggagtcgggagtctccacgccgggtgacctacatgctaagaggtgaggagcttgcctagagtcagtccaggagaggtgcacgcagcctcccatcccaggattcatgttttcatggtaatcagtggtaagaaatctaattgcatctggaaagaatcctcttgaggttaacaataatattctaatttcagactgtacaacacagaaccaaatgagaaacagttccaacatgacttaaataaatacactgactgggctgggtgtggtggctcacacctgtaatcccagcactttgggaggtgggaggagaggaa

SEQ ID NO: 657164 - DNA, 329 bp, Homo sapiens
agacaaccttaggccaaaccatttacccaaattaaggtataggccgatagaaattgaaacctcgcgcaatagatatagtacccgcaaggaaaagatgaaaaattattaccaagcattatatagcaagggctacccctatacctctgcatatgattaactagaatactttgcaagagagcaaagctaagaccccgaaccagcgggctacttagacactaaaggcaaccgctttttgcaaatagtggagttatagtagagcacaacctccggctgtatactgtgccagtagatttagtcacttaattcccaagccctttaaccctttaatt

SEQ ID NO: 657165 - DNA, 133 bp, Homo sapiens
  misc_feature (42)..(42): n is a, c, g, or t
agaggaccttagtactggtctcgtgatccgccgcgtggctcncaagtgcaattctgactctacttaaacatcacctgtatcagggagctcattattccttgaggtcttacatttctttcagcacattttgttc

SEQ ID NO: 657166 - DNA, 936 bp, Homo sapiens
gcaggtgagtaaaaaagtaattaacaaaaacaaataacacaaacaacaatactagaaaaaaaggtcgttacgttatttaaccgtaatttaaagccgcctgctcccggttgacaccctaccgggtggacccccttgtgtttgttcctatgggaagacccttgttctttccctggaacctctttaactgggggtccccctccttccattaatccctgccctcccgtttcccccaggtcaactgagtggctctcccctggctatcccgccagtttcagcaaatgatccaccaaccggacgggttctccacttcccgtttcacaggggggtgtcccccgccccccgtgggcagctgtaaccaagaatttggctgctgtgctccccgccaaaaagtggcgggtgacgcatgtcgccttaccttcagttagtcagaaccattcacccctcctgtcacgggtagtgcactaaccatcactgcaagcccatgtcctcattgaggtttatacaacctgtgttccagtataaacaaacgacgcggggcccaccccccttgctggaagaactcgcgtcctgcttctttccccaagccggagcagccatcacttttgttttaattcccccaccagggtgcacaaacattgatcccaatagcttcccagggcactacttcaactttgtttaatccacgccgaccattctgcaattttatataagtggttcctggcacctccactatcttcgagacatgtttctcctccacccccccctccttctccttgtattggaagaccaattgtaagaacacatgagaaaaataacaacgggaagacctctttctccccgggaagatatttataccaacacaaacagacatacaaacagaataaccagatgataatatagaaaaaacaagaaacaaaaaacagcccacatgacaca

SEQ ID NO: 657167 - DNA, 149 bp, Homo sapiens
  misc_feature (3)..(3): n is a, c, g, or t
  misc_feature (13)..(13): n is a, c, g, or t
  misc_feature (128)..(129): n is a, c, g, or t
gcnagcgtgcgcnccgaccgtatcactccaggcaggccttgtacgttggttcttgttcggcaggagacagcaccatggtgggttctctctgagtctgtggcggccgcgaattccgccgatacttgacnngctccaggagtcgtcgccac

SEQ ID NO: 657168 - DNA, 227 bp, Homo sapiens
gggccgtcatatattggtcttgatgtaaaagactgcaagtacatccctgcattttatatttcccagggtggttcttccggcttaatcagggtagcgttggttggtgaataatgtgcaaagttacaagtcataggttttcaggttatttatgggatttatttctaaattggcctatgtaatttgcatattaggggtctctggtgtgtgcacacatctcgggtttgacc

SEQ ID NO: 657169 - DNA, 439 bp, Homo sapiens
tgttacgcctacccttcttgatgacccttgaaacttcctgcctgatattgccgttgaacccggagcaagccagggctggatcctcgggccggaaactccttgaggacgatgccgtacttcttcctacgagcctcctcccgaagcttgcggttgaactcactgcccgagccgattcgggcatctcctcctcttggtagattatcttgttgctcaagtcccgctccagccgagcctgattccacgtagcaaagttgactttgtcggctgcattacaagccatgatgttatattttttggttgtattcttaggaactcgaacgacgtattcagtgacattctggctgcaagagcctaggaccgccatgggcaatggtcagtggttccgatctggtccgaacccggattcctttagtctcctctggcgtagcgcgtccactcg

SEQ ID NO: 657170 - DNA, 133 bp, Homo sapiens
gcacgaggggtgtccagtggcagtgggagcactcggaacaccacgcaggctgtgtgccatgaatcttgaagtgttcatgtgcatcatgaccaggggttccagactctggtgggaaatcctggatgaccctcgt

SEQ ID NO: 657171 - DNA, 244 bp, Homo sapiens
  misc_feature (57)..(57): n is a, c, g, or t
  misc_feature (61)..(61): n is a, c, g, or t
  misc_feature (98)..(98): n is a, c, g, or t
  misc_feature (124)..(124): n is a, c, g, or t
  misc_feature (228)..(228): n is a, c, g, or t
gaaataatgttatttgcttgcttaatatagtacagtatcgtgtaaacctaattttgntatncactgggaaaccaaaaagttggtgagacttgccttcntgtgatactggctttattgtggtggnctggaactgaacccataatatcttccaggatggcctgtcttgaccgtgggctttctctattgtatctgtgtagttgatccacgaggagactcttttgtttttcntgttgtgcgaccgggt

SEQ ID NO: 657172 - DNA, 385 bp, Homo sapiens
aggacgaggatgaggatgaagatgaaattgaaccagcagcgatgaaagcagcagctgctgcccctgcctcagaggatgaggacgaagaagaagaagaagaagaagaagaagaagaagaagaagaagaagaagaagaagaagaagaagaagaagaagaagaagaagaagaagaagagaagaagaagagaagaagaagaagaagaagaagacgaagaagaagaagaagaacgaagacgaagacgaacgaagacgacgaagaagaacgaagaagaagaagaaggaagaagaaggatggcgaggacgtaaacgcagaagaacggcacgcgacacgcggaggacgagagacagagggagaacctccatagagaccgaggacacgcgctcc

SEQ ID NO: 657173 - DNA, 1128 bp, Homo sapiens
gttataccgagcgtctttaagtggacgcgtgctagttccgccctggggaacccccactcaccccgtgtttggaccctcccatttgaagacccccggggcccgaatctccaagccttctcggactttttatacccttaggccccccgggggccggggatcaccacagtgtgtcaccacccggggaaaccacgcgttaattggccccctttagggcccttaattttagggtgcaccgctgtaattaggggaccaaagtgttgggcagccccaaaaaaagcaagggccttgggtaccccggtcccccggaaatttccccccggggaataatctggtctggaccccccacaagcggttcacgcccacaaacagccggttctcggaggcccccccgggggaggactctcgcacggccacatggatcccttgagggccctggaaatggtggaaaagccccccaagggcccctaatgccccctcgtgggcgcgaagtggcccccccccttgcacgccccacgaagagggctatctggggagaccctctcggtgttcacagccccagtgcaaatggtgagagcttattataaggcacgccctcttcggcgagataagggagagccccacaattgagggcccccccccaaaccgccctctccacacacagggggcaatatcttctctgaggtgttcacatcgtggatatgggctcgcacgaaccgccgaggcgccactctggagggatacccttttctgggcaccctctgcccgcttggcttgttgtgtgaaagacccagaaatgttgcccctaacgtgttttgtgcgctccccaagcacggccctcggggaggaaccctcgtggggttctcccacggcctcgttcactcgccctcgtgttctcgtgcacccactccacaaagaaaggcttcgcacgctgagaacacgcacgagtcccatccacttcacgcacgtccacttgaaaggcttcttagtctaaaacccgtggcctctgccacacgtgctccctgccacgcttcccccctcgagggttgtgtaatcacataattaattctgtgttagccagtagtattttcagctactctctattgttataaaatgtagtactaaatctga

SEQ ID NO: 657174 - DNA, 126 bp, Homo sapiens
aaaaaagcctgaacccccacccccagctggttgagagccccctgcattttgcctcatggtgcagttagcgatcccaggccttcaaaagtacaacatcagctcagcaggaacgccggctccccgagg

SEQ ID NO: 657175 - DNA, 394 bp, Homo sapiens
aagtcttacatctggtgagagatagtccaggcatagcaaccctgactccataaactttaatttaggaagttggtttggcctgctccactggcatgaacatagctgaagggggagtcatcgaccgtggaaatgagatttccctcagtgccaattttaaatccagcctccaggtcatcgtatttttctggatgcttctcacagtcacattttttgtttgtttgttttacatgaaagagcacattccctttccccaagtcaggtttaccattttccattgctcttattaaacgtatcttattctaatggaatgttctcagagtttccgccctccgctggcctgggtaatagaggtctggagttggacgccctaggacggacagtcactcagatgccg

SEQ ID NO: 657176 - DNA, 123 bp, Homo sapiens
gagggctgtagagcagtgtcaaaaggacccggtgggccagacggggtggacatcgtgaataatcatagtgggcttctaaatactggtagcagagatgacttctgattcgtaatcgttagagtc

SEQ ID NO: 657177 - DNA, 455 bp, Homo sapiens
ccgagcgcgcctttcaactgtcttcctcatcctctgtggcgatcgtggcgtatgcccatcgacttcttgcgttctgggtttggattactccccctcaacggcctgctatcatggcataagcattcgacgagagtgaggcgaaggcttacgtttacgtgcgggagagatttggtgtatgattgccatgggggccagtttttgtcgtgtgagaagacgcaggccggatgtcatctctgtccctctgtgtgacatctgggactcagaagtgaaagggggctattcctagttttattgctatagccattatgattattaatgatgagtattgattggtagtattggttatggttcattgtccggagagtatattgttgaagaggatagctattagaaggattatggatgcggttgcttgcgtgaggaaatacttgatggcagtttaccatgcagcgcta

SEQ ID NO: 657178 - DNA, 1469 bp, Homo sapiens
gagggtacatgcaggcgcgagtaggtctagaggcaggctaaatagcaccgcactatcataagaagagcttatcagccgtgtatgcatgagtcgagcggatctgcatgaatgcatgatgccctggatctcgcgtgtacctgacgtccggtgtatcgtcgatgtttcccataactagtcaggagacataaaagtaagctgaaagtactgacacagcgtcaggaccaggctcgaggcaatagtgatggaagacacgggactcgataggtgactcggctagcatggcgcatgaatccattgcccatagtttgccgtaccaattcggcttcgcgtgccacgagtacctccttagcaggcaattcccaggatgaactagttagactcgacgaatcgggcaggcctctaaaggcggaagtcctcctgggccacgtattaagtccaattctagaaaattgcaaccctatggaccgccaggtcgacgaatgtgcttaatctcgggaaaacacttggagcaggcaggtttgaacacatctcgggaaccataaccgggggcaggggaggcggtaagactgcattctacaagaggcatcccgcctataagcaaggtaatcgtgtatacacaccgataacaaagttatacatttcggcccctaaaaggggaaaaaggccctaaggggggacgggacatcgcgctttggggtggaacccttttttccccctctttggcgaaaagcttggctagttcagccagaccagaaatcccggtaaggggattaacgagtccacaacttaaaccccgctgcaacactctggcataacggaaacccgcacagcgaattggaaccgggagcatgaacacaagtaagaatctgcaacccacattggcaaattcccacaatgtggaatcaggttaacctcataggagcgcagatacacttcccctagggttgggacaagggcccatgtggtataccacccacctccaagataccaaactcttcctacagcagcgggtacccttgtttatatgaaaacctacccaacgccaaacgagcaactgttgtagtacccaacacaggctgtattctcccacacgcggggttgggaacagctcgtgcctaaccgttaaaacagccagcgcccaaaagagaagcggccccaacacctatatatcatacacagagaccccgggctgtataaaacgcaccacgacaacaacccgtgagcgagcgagtactaacctaacacagctaatacaagggcggccgtctgcactaggtggcgccggcctcagcggtacagagaagcttccacatagggctgtgtgcaaaagaggactagaaactacaccgctacacccgaacaacatgcgctatccgacattggagaaccaacacccaagaaggctagcgaggatcgacccgttgtaaacggcgccacagagcgatatgagaggagagcaagcaagctcc

SEQ ID NO: 657179 - DNA, 829 bp, Homo sapiens
gagaggacagaaaatgacgcagtgtgcatcatgtgtattctcagcaggtcttcttgaaatttacctaaaaatatgatgctctctcttcagaagaactgctcttgtcagtaccagttacgtcaaacaagaccagcccctagatgttaactatctgctattcttgatcatacttgggacaatcattattaaatatccttacactaggaatgagaagaaaaaacacctgtccacaatttatggaatatttccgcatttcactagcattcgtgatcttttacttttggtaaacacatttccatccatatgtcttgcagggatttgtcacttttaagcacttaggtgcactaaataccacatctggctattatactcaaattatttccttacttatggcttttgtgcattatccagttttcctgacagctgtatagattattgcctgaatttctctaaaacaaccaagctttcatttaagtgtcaacacattatcttatctcttaacagtactttactttggattcagtccttgcttatgtttgggagaccagcatctacaaagctgaaggccagaatgcttatctcgtcatgccttctatgctagcattcagagtactgcctggcattcatgcgcgatcaattggagcttcaaacttgtggaagagtctactgcaaggaaaagatactccattgaggaaattatttccttcacccccctatcggcacccaaaatttccagcagggtgcaccggctgcaacgccggccaaccaccattgaaaccggccgaaataaaaagagaaaaagccggggagacccgagaagtacaacaac

SEQ ID NO: 657180 - DNA, 116 bp, Homo sapiens
actctaaccatcccttatctggaaaaggggaacaggcgggagaataggtaaaggaaggaggagcagtgagaggatttctagagccaaactttcctcagctgctttctggtaatttg

SEQ ID NO: 657181 - DNA, 872 bp, Homo sapiens
  misc_feature (657)..(657): n is a, c, g, or t
gcctagcagtcaacatgaaggctctgatggtctggggcttgtcctcctttctgttacgtgtccagtggcataggtcttatgcaacaggtgtgcagttggcgcagaacgtctgccagcagagatttgggaatggatggtctacagggcgaatcaatgcctaccaaactggtatgtgctcttggcctcaaattgggcagacgctgatgtacaacaacgacgatgcatacataacgctactaatgtctggaagacatgcacatcattcgtgactctcatgggcatatcttcgagcatcaatagcgcgttacttggtcgtaatgatgcgccaacagcccagggagctacgttcaatgcctggtcatctgtatccttgcagtgctttgctagccaagatatacatcgctggatgctggtatgctatgtgcacaagagaggttgtccgttggatcctaccaatggcgattccagcagctatagaggtggcaattggcaagcacagtcggttagtcattaacaccagaagattgtcgctgtcgaagtacattgtctcaaacaggctctcgtagcgcagatggtcacacgttctcgcatgaatatctaatcgctctgcctttcaagtcctcgtatatatagagctcggtccgtcgatccaccgantttcaaacgtggggaagatcacgggacgctctagagagcttgcaccgagggggttcaacgaaggtgatcgcaagctctaattattctcggctcgtctccaaatacctaacacagattagagtgagtttcattgtacccattcgaacccggccaagtggaccgcataacccttggcctcgccgtcggcgtatcccatttgcgtaaagggacgaagg

SEQ ID NO: 657182 - DNA, 888 bp, Homo sapiens
agcggggtttgccccagagatctaaattcaagaaggagggcaccacacctaggaaggtaaatccagtatcagaaggttgctaaaagattaaagatcaagaagcttggaaacatcccatgggtacaatgtcttagaaagtctttaagtcacataccatgaatttttgcttcattactgaccatatatgaccttggaggaactctttttttttttttcccttcctaactcctatttcctggtttcccacctaaccctggatctcaccgtatattcccagttctttcaacccccgcagttatatcctaagtcccagcaaagtccatttcctttccaaaagagactatcatgtgtctggaaaatatatattaactggtgtaatgtctaaattatgagacgccagatgttaaacagctcctctatgggtcatatggaactattgttccagggaacgcagatcaccttggatgcgtcttagaaccccaaccccaagaacgaggggaccatattcctaatctttggaatattatcccggggaatattatttacacctgggggggtatcccatatttaaatcttcctttctcttccttctaagctctttaatatttacaacaatctttgagacactctggacgcccggggatttcttcttaaccaaagagaacacatatgggcgggccctctggacagggaaacgaagatgtgattcctctttatctccaaaacccttggcgaggagaaattcaaggccatattttaaccgggcgcagggggcgaaccacgggggtaccttttcccaaatgtgacatgggggtacaccgggactcccgggccacattttatccacacactttccccaaagttcaatcctccacaccttttcccctg

SEQ ID NO: 657183 - DNA, 220 bp, Homo sapiens
tctgtaggctagatataagttgtatctaaacaagtgatttaaaaaaaaaaaaactaacgaattgccacgatgataacactgaacttgttcccctcttgaaggacatgggaaattgtaccgaggttcatttcccccaccactgaatcatctccctccatgtagacggggatgagaagtcaaaggtggggatgagcacacaggtggaacacacaggtgggga

SEQ ID NO: 657184 - DNA, 1243 bp, Homo sapiens
  misc_feature (10)..(10): n is a, c, g, or t
  misc_feature (833)..(833): n is a, c, g, or t
  misc_feature (860)..(860): n is a, c, g, or t
  misc_feature (877)..(877): n is a, c, g, or t
  misc_feature (913)..(913): n is a, c, g, or t
  misc_feature (1067)..(1067): n is a, c, g, or t
ggttttccgncagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagcttgcccttagccctctgggcattgaagttgatatcgatgtggagcacggagggaaacgaagccgcctganccccgtctctccagagagttccagcancagaggagaagagcagntcacagccaagcagcttgctgcttctgatcccagtnaagccgggtggggaatgttgagggcgccacgcagtctctggcggagcagatgaggaagatcgccttggagtccgaggggcgccctgagtgaaccacatggaggtcgggataactgttcaggaggagatgatgactggacccaatctgtcttcanaagcgaaagtggtgacccgggcctcaacagcgtgaaattccaagtccctaccagatgccgaaatccgaaggtgccacagcctcctggaacccctccccacgagggaccccaaggcctcgacgcaagctgcctggtcccaatttcccgcaatgtgaaccaggctgactgagtccttc

SEQ ID NO: 657185 - DNA, 1297 bp, Homo sapiens
  misc_feature (459)..(459): n is a, c, g, or t
gcttacgctagtcggggacggtaaccgggacccggatgtctgctcctgtcgcctatcggactactctaatccctagactcgactatgcgtgagtgcgatctccatcgcagcggtcggccaggctggtgtccatgattgggacaattggccgtgcgtgtggagctactgacgtgctctggaacacgggtcgatccgagccctgatggccagatgcctagagttgacgatagaccatcgggggaggagatgactaccttcaacgaccattcgtacagttgagacagggcgctggcaaagcacagtgcccctcgggacatgtgtatctgtaagagcatatggaaaacccaacaggtcaattgactggaaggttcgacactctggacacccataccgcgcaggcgtcgttccactacctcaggcagcatcattgcagcagtgcgaagggaatggaatgcatgnctcaattgtaacctagtgtcccgatgggggcaacataacagccaattggtgcatacggcacggaatcaattggagacgctatgatggtgcgggacgcgaaaatgtacagtcgaaggctcgagtcatgaagcgcaagggtgcccaaaccgaggttgcttctgcagggggaacctttcgtaaaggggttcatacccgaaccagggcgtatacgaagttggaggacgagaaccgtaggagctctcctcgggtgtttcaaacccattcgctcctagacaactccaattggtgcgatgaccaggtccgtccgtcccagctttcgggtatctaaatttgggcgcaaaggaaaagtcacaatagaggccctcggcacgctaggcgtcgcgaaaatctttaaagcgccgagcaagctcccaagggagtggtaccccagccatggcttaggtgaccgctttgaggaaggtctccgcttcacccagaagtgttcctcgattaaggctaacgaaaccgctaagccgccaaagaaggcccgaatcctcttgggggaagggccaacttaccttggcaacttgcgttcggctccctttcgccactgtgggctgacgaacctacaattggggcacggtgcgcccaatgcgtcaagtggaatcgactttcttgggtccgcgtaaacgacagaaccctttcgcgattagtcctggaatgcccggcccctcatatgccgctaatcagaccgtgaaaaggccgtataaaagccagctccttttcaatcctaggcgccaaggaattgtggttgttacccttcacgaagttcaccacttggtctttccgtcttgggaag

SEQ ID NO: 657186 - DNA, 1374 bp, Homo sapiens
taaagaagtaagccttaatttcctggtttggcgaaataaaacggggctaagtgggtgtggcgtttggggggattagtcaaagagaccaaatcccatatcctcgtcccgactcctccgactcttcctgggcttcaaccttagctgggggctgcagcacgcagcagggagcacgctggtgggtgggcagcagccacagggggcagaaggccaacaaagggcaagatgggatacagccaaagaagggcctggacccttttcaagcaagggggagaacggtggtacacccggtgctccaccagacaagggccagagactcggttgggacacccggttggatgagataagaatgggggccctggctggcaaacagtgggggtacgccaatctggcaaacaagacaacgggccacacatggcggagaaacccctccagggaagcagaagaatggcgagagatatctccacctgggggcaatcaagggcaccattcagggtcggtacaactagctggccaattggcgcgagaaccacccggcgagggattagccccagacccacacgggcagaagagggggggacacaatgctgtgacgcacgtggttcaagccacggcggtggcactctcgcgtggcaccaccaactgagggacacacagacacgtggacacaagctgtgcaccatcacacacacggcactccacaacagggcgtgcacccatggggggaacacacatacaacaagcgtcgcgtcgaaatacccacataaaagagcccgtagggaccacccacaaggggacggggacataccacatcggaggagcaccacgaaacacccaagacgagtacgtgagcgacatgacgaaccaagggaggacacttcccccactggcgggacaccagaggggacccccagcacgcagagcaagcaacacaagatcgggaaccactatagtggggcggcccagcgaaaacaagtgactcccacggaacaccacaggggacgggggcccactcctagggtgggaacacaccacaaaaggacccaacaataatccccaagcgggaacataagagggccacacagagatcaccacacgacagcgaggaggcatgcaccacgaagtagacactcataatgcagcgaagaccgaacggaagcagagatagcgacgaaacaagcaaaacaaacgagccacaccgcggaaagagagccatgagcaatacccgcaaacaactgttcaagccaccccacaagtcggtgcccacccacaaaaacaaagtgcaccagcaaacacacacacgcgggcagtcacatccagaataaagagaagcaggacgaaccaccgacatagaacaatcgaacacagcgaccagca

SEQ ID NO: 657187 - DNA, 1245 bp, Homo sapiens
  misc_feature (835)..(835): n is a, c, g, or t
  misc_feature (862)..(862): n is a, c, g, or t
  misc_feature (879)..(879): n is a, c, g, or t
  misc_feature (915)..(915): n is a, c, g, or t
  misc_feature (1069)..(1069): n is a, c, g, or t
ggcagaatcgaccgaatcggctcatgggcgtggtgtcatctctagcaacggctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagcttgcccttagccctctgggcattgaagttgatatcgatgtggagcacggagggaaacgaagccgcctganccccgtctctccagagagttccagcancagaggagaagagcagntcacagccaagcagcttgctgcttctgatcccagtnaagccgggtggggaatgttgagggcgccacgcagtctctggcggagcagatgaggaagatcgccttggagtccgaggggcgccctgagtgaaccacatggaggtcgggataactgttcaggaggagatgatgactggacccaatctgtcttcanaagcgaaagtggtgacccgggcctcaacagcgtgaaattccaagtccctaccagatgccgaaatccgaaggtgccacagcctcctggaacccctccccacgagggaccccaaggcctcgacgcaagctgcctggtcccaatttcccgcaatgtgaaccaggctgactgagtccttc

SEQ ID NO: 657188 - DNA, 113 bp, Homo sapiens
cagccggcgcgcgcgggtatcgcggctctgctcttcctgacgatttgtcgcagcttcgctgcggtggctgtccgccgtcagcgtgaccgcgcctttgttggcttgatattgcg

SEQ ID NO: 657189 - DNA, 133 bp, Homo sapiens
tggagttgggcggtgtgcagcaactcaaggacggcctcccagggccatacctgtaccttggtccacattaatactgcagttttgctttttatgtgtcagaatggttttatgccaaataatggtgatttcctta

SEQ ID NO: 657190 - DNA, 330 bp, Homo sapiens
cacagtcttagcaactggcgcaccaggggattccatcccatgcctggctcggtgggtcccacacccaaggagccttgctcactgctagcacagcagtctgagatcaacctgtgaagctgcagcctggtggggggaggggcatctgcaatgctgaggcttgagtaggtaaacaaacctgctgggaagctcaaactgggtggaccccacttgcagctcagcacagcctgctctctagattataccactgtgggcagggcatagcttgaataaaaggcagcagacaacctctgcggacttaaacatccctgtctgattagctctgaagagagt

SEQ ID NO: 657191 - DNA, 1383 bp, Homo sapiens
  misc_feature (10)..(10): n is a, c, g, or t
  misc_feature (494)..(494): n is a, c, g, or t
  misc_feature (973)..(973): n is a, c, g, or t
  misc_feature (1000)..(1000): n is a, c, g, or t
  misc_feature (1017)..(1017): n is a, c, g, or t
  misc_feature (1053)..(1053): n is a, c, g, or t
  misc_feature (1207)..(1207): n is a, c, g, or t
ggttttccgncagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgcctttttccgatgtgagctgacggagattgacataattggctcgatggtccatagctgtcgaagggcatgacgatcgttgccggagatcgtaccagttgaagccgatgacatagaataggaggttgcctgggcgtggactcacccggtccacactgtggtgtctcacgtgaagagcgccctcgaaaataatgggtgcacctctcaaaattgtgagtcttgcgataggcttgctaaatggggnctgatgggtatggaaaccggcatataatgtgcagtcaggtctgtgcctaggattacgactgtgtggtagcggtgtgccgagggaacagggcgttgcgaccggtgggggcgacaccaaaagacgtcaggcattatcccactagtcccctttcgagtgcagaccgtgtctgagggggcgttcgtcggcaacacgtcggttgcgagtcccggaaagggtgaactacgaggggagcacatgtcgggggtggggcaggactgggaaacaatggggtccaacgcaagtgaaactggagcccacgtcctcctcgtgcaggggaggcccgccctggccccacggcagaatcagcttctggtccatcggaggatccgagtgtgaatttcctgaagaacgttggggagagtgtggcagcttgcccttagccctctgggcattgaagttgatatcgatgtggagcacggagggaaacgaagccgcctganccccgtctctccagagagttccagcancagaggagaagagcagntcacagccaagcagcttgctgcttctgatcccagtnaagccgggtggggaatgttgagggcgccacgcagtctctggcggagcagatgaggaagatcgccttggagtccgaggggcgccctgagtgaaccacatggaggtcgggataactgttcaggaggagatgatgactggacccaatctgtcttcanaagcgaaagtggtgacccgggcctcaacagcgtgaaattccaagtccctaccagatgccgaaatccgaaggtgccacagcctcctggaacccctccccacgagggaccccaaggcctcgacgcaagctgcctggtcccaatttcccgcaatgtgaaccaggctgactgagtccttc

SEQ ID NO: 657192 - DNA, 285 bp, Homo sapiens
ctgcttaatgagaataataggagacctcctaatatcaataacaaaaccgctcaaaacttagtcattgtgactcatgcaaataccttgtaaggtcaacttaatattacaaatactagcatcagcatcggtgcctcttatatccctatttcataacaaaagaaattctcacaccactccagcaagccagcaaacagctctggaggaattacctgtacaaccaagtgctacggtcactctggaattttaatatacacacacacacacccttactacatgtcatacata

SEQ ID NO: 657193 - DNA, 242 bp, Homo sapiens
tataccctgccagaataggttcaccgctgggtggagttgactcagcgtatcagccttaagaggagcttttttttgtcgcgagatatcattctaaataaaatgaaataatcacaaggaggaaggcaaccagctgttaggggaaaaataaggcagattaaggagcggggagagaaattctttgccaacctacgaggagttgggctgtatttttcaacaggtggggagagtggagcacacacctt

SEQ ID NO: 657194 - DNA, 153 bp, Homo sapiens
actcaccactcactcaactagaacaacctctataagtggtcctataagctgcattcaggtgtagcaccttattttcttttgagaccgcgtttcgctgtgcccaggctggagtgcagtggcccaatcacagctcactgcagctttgacctccca

SEQ ID NO: 657195 - DNA, 182 bp, Homo sapiens
aactggagcaacaccagtctatagatatagcaagttgagaagatgaagctcagaaaaataaaagcgaaatgaaaatggttgtggaacttatggagccacaaaaagaaaatatggagcatcttaaacgtgtgaaaatagaagcagacaaataagtatgatgcaatttaattcaaaattaatcc

SEQ ID NO: 657196 - DNA, 265 bp, Homo sapiens
  misc_feature (78)..(78): n is a, c, g, or t
  misc_feature (101)..(101): n is a, c, g, or t
  misc_feature (111)..(111): n is a, c, g, or t
  misc_feature (113)..(113): n is a, c, g, or t
  misc_feature (118)..(118): n is a, c, g, or t
  misc_feature (141)..(141): n is a, c, g, or t
  misc_feature (149)..(149): n is a, c, g, or t
ctcggtcgtctctgaggatccccccttcccccacagtgctgcattttattaaattgaaacaagttgttgattcgatanttacaagacttgtacaaaaattnacagcgcctntnaggancctttggtggaactggtgacacntgtgcctntccggacagaggaaggaagtcccgatcacgtcttacggcaagcagcgagcctagtagtctgagcattccctgttccgatgctgccaccctcactgtgtggaaagggggaaccagag

SEQ ID NO: 657197 - DNA, 112 bp, Homo sapiens
ttcacgctcttttttcgctgcaacatcatctcaaaatctaacataaagagaggaaaacatatggactttctgtcagattttgagatgatgttgcagcgaaaaaagagcatga

SEQ ID NO: 657198 - DNA, 335 bp, Homo sapiens
ctcttccttataaagagggtgtttgaatttcagccatgtgtccttgctttgagtctcatatttgtgggattcccatgtccatgtgcatatgaaatttgtgtgccttttctcctgttaatctgtcatagctcatttcagcaaaccttcagagaggaaagaaggaaagctttacttccatctctgcaatctgtagattacttataatacctaatacagccaggcatagtggctcacacctgcaaccccagtgctttgggaggctgaggcaggaggattgttggagtccaggagcttgagactagcctaggcaatgtaatgagacaccatctctagaa

SEQ ID NO: 657199 - DNA, 1086 bp, Homo sapiens
tagtggagtgggagtcaggcctccccgctttgtgctacctgtggaccggctctcctccgggcctcgtcatcgcgctgcgatgacgcgctcactgttcaagggaaactttcggagtgcagaccatcctcagcaccatcggctatgacaacattatccaacatctgaacaattggccgcaagaactgcaaagcagtttgacagactttctaacacagaacagggccgcccattcgacacgagaggtatggcacaagatctgctcaacctctctaggaaggacagccgtgtggacacgtctgcaatattcaatgagccttgaagcgggtcccttgcaccagtcttcacagcagccaagtacgacaatgtgcgcccacatgtcccattcagcttgccacaagagatataagcaagaacgagcgccagtgacagattggcaacgcactctcacgcggtacaaacgccaaaaaacttacaaccgactatacacgcacagaggcctcatacctggcttgctatcccactacaccccaccaggacgctttaccacattcacgcaacccatggcattgccacgacagaaacttattgacagccagaaacattgccccgggaacaacaggactcgccgccgtactccgcgcccgttcagtccgggaagtgccctaactgggggactccgcgcaggcgccccacgcaacagtcccttttgctgacaccctgggcactttgccaggaccgcagctcaaggcacctccagacacaagccttccctgccttggacgcattcgtgcaccccatgcatcaagggtcccaacaaacaaggtggccgcaggtgtgcacaattcaattccctgcaacggccactctgcaggccacggacaagttacacggcacttaccagcatccctcccggcacttgcatatgtgtaatacattgtacatacccgcccagccacccactctgagtacccacagtacagccacgtccccaacctaccccgacaccgcctccacacctgccacctgacacctaggccaccgtgacccacgcaatacaccgccgcctgtcccccccccaactcccct

SEQ ID NO: 657200 - DNA, 888 bp, Homo sapiens
gctgagaagcggggccggggcaggcctgcgcatagccagcctccgtgtgagtcccgggacagcgctggtagggagtcagaaggagcccagcgaagtgccaactacctaagagacctcggggccgacctaaaggtgataggcataatacaaggtgtgctgccaagacccggaaaaccatcacaacgtcctaggaaggaagaccgataggggcgagacccagaaaaagctggagcaaggagcgaagagcgagggcatcttcgcaggagtcctcggaggaggagcatgtggactccatgcgattgcccgatctgcttaccatcatctggatgggatgccagcattacctatcttgggagctggagagcagcttttgcttcctgtatctcaagggggctgttgcgtctatttcggagagtcccataaactatcatatcggtggtcttggggccacagtgcagcgcgcaccgaatctattcctaactcatgtttgccacgcatcgagaatacgcaatcattgtgaacgactatacattaccgcagttgggcattgagccgctgacgagtgccacattgtggggcccttgccacatgtgagtgctgccaacgtggggtgcacacggcactttgtggtccccttctaggagtgacagcacgagggaccttacttcacccatcgcaaggatgcaactacgttggcgaaacgtcgcttttaacatcgcgcaagtggctgtacgtcctcaatcttaattgggggacccccaatgtcggttttaaggccgccttttcccacaagggttataaaggggccttgttaggcccacgttgggggcaacacttttggcttgcagcggtatctcgccctaaactacctcacttagggggattggg

SEQ ID NO: 657201 - DNA, 1258 bp, Homo sapiens
  misc_feature (792)..(792): n is a, c, g, or t
cccgttcaccactactcacgagggtgcagtcggcgtgagaaactggcagcatgcacttgtcccctctgagaagaagctagccacttctcggcaagcacagccttgacctgtccccactctgaactaaagaaggaactgccgcccagggaagtgagccctctggaggtagttggagccaggagtgtgctgtctggcaatgggggcccgtgccagtgcaagggggtgctgcacgtctgctccctctactgggccctatgcaccctccggcaggatcgagcctgaacgatcgggagtctgctgctgaagcaagaagccattcgtgaggtggactcctcagaggactgactagcctgagggaagggcctgtagaacatgccagggtgcacagtgacgctgatcttggcacctcacccagaagtgacgccagagtgtggcccctaaatggagcaggcagagagtgtcggaaagacggatcctttcactgtccatacgaccttagtgagcctggtgcctcaatggtcccgagagcttatttgacatggcatcaacagctggagcgcctctcgcatagagcgggcataaagtcccagtgttctcctcaccaaggaagactccggggagtccctactaagcacagtatgatcgcagggttgctcaagcctcgcatctcctcaaggagggtgctcctataactttagggtaccagtacgttcgtagtcctattagaccctcaatcccctcccttgtaacttgttacgctgtgaacgtcgcatgtaactccataagtcgaangggcacctaaaccacgcacctatgtttccgcaagtaagctctcggggtaactctaccccatccgaccggagccaccgtttagcatcttgcgtacctgaggtttccgagccttctaggcgcctatgcattcgacgtcattggtgggctcctttgtgaatagtcccccttcttttaggcctgggccccaaggacgcatgcggcatagtcctccgcaataatctattaaacagtgcctacactccattgagagaccagtttgggggacataaggcccataccttccgaagagcattgctcggcggacaaacccctataacgctttcagatagccccatggccttacgagaaaccccttgtttttccccaatgggtcagcacaggggctgaacagaccaacacgtcatacctgtatgatttgccccgcagtggagttgtggcccccaatcccactattataaagggactc

SEQ ID NO: 657202 - DNA, 780 bp, Homo sapiens
cggactgagccccccacccgcgtgcggcgctctcctcctcctcgcagcagtcctgccgctccgaggcgcgcttgtttttctcctgctctcccccactggcgtccccttcccaatctcgccgctctgaccggtccggattcccggatcttcaccacctactacggacgcacctgcgcatcaacgacatctgcaggctaccaagtcatctctttcggccccaatacgaagcagagactacgatctacaacgcagaagctgcctatacgatcatatccacagcacacaaaacaacacatagaaaaatacacataccaaccaggatagcagagacccaaacatagaacaacagtaaaacaacgacaccactaaacaacgggcgagcccgaaacacacacacaaccgacacacgccagcaacaaacaacccaacaccaacacaaacacaaccaaacaccctacgacagcaaacagccaaagataactcccacaacacaaccaaaacagggtcaagctaatacagtaccaccacacagcgaaaatccccaccccataccacgcacgatcgacacccaacatgccacaacaccaacgacacacaccacacaatgcacagccaaacaacacaaggatcgcaaaaatacacacagcaaccacacagaacccgaagcacgccgaggaacgcctaccctgagaccaaagagacccaccgaacacaaacaatcatcccatcacgcgaaaaaacccatgaatccacaaccagaccaacaacgacaccagacga

SEQ ID NO: 657203 - DNA, 189 bp, Homo sapiens
ttttggggaaaatttttttgggccctttggccggaggcctggtttatgggttggggccccatccctgttttttggtcctggtcatcccctttgccttttccgttttggacctgggcctaacccccccccccttttttttaagtgagggggtggggtggtcaataaaaccccatgtgcctttggccccca

SEQ ID NO: 657204 - DNA, 126 bp, Homo sapiens
ctgtggcattcgggaaccactgggctccagcctgggagacaaagtgagatcctgtcaaacacactaaacccttttaacaaaggaacatctactatgtgctaattgtgcgtgtcggggataacatca

SEQ ID NO: 657205 - DNA, 1183 bp, Homo sapiens
ccagagagccctgagcagacccaccgcctgccgacggccctagttaccatcacaccccgtggaggagccagcagctgcctgcagccggccccagtcaccatcaccgcaaccatgagcaagcgaggccgagacccagcagacgaaagaatggacacacaggaacagcgagcgcgacacaaagacagacgcgcgcacaccacagagccgccgctagcaccatacacaggaacgacgcgacacctacagaaaaacacagaacacgaacacagaccagcacgacacccacaaaccgtgacctcaccggaggccaaacacgtgacaccaccaacgagacagacagcaccagcgacaacacagaaaacaagaggcgaaaaacgatcaacgacacaccgacaaatgcgcaaacaaccacacccagccgcaaaaccaccaagggtagacagcaccacagcaaatacgccgggcccgacgcggcgacggagacagaacgcgcacgcgcggcggagacacagcgagcccacaccgccgacgaggcgacagcgacagaagaagagggcgagaagaggagggagggagagcacagagaagggagcaccagacgagagacaggaggccagaagaagaacgaacacagagagcaggggcaacgagggagaagaataaggagaacgatagaaaacaaaggcaagaaaaaaaggagcgaagacagggcaaagagacacgcgaaaaagcgcgagagaaagaaacaaagaaaagaacgagagaagagaaagaatggaaaagaaaggggaggcgagggaaagaggagaaaagagaggaagcaaggaaaggtgagagacggacgacgatagcgagacgcaagcaacaaggagcgcggacaggaagaggagaggagaaggaaagcgcaaacgagaccagacagaaacagaaaaaagacacaaaggacacatgccacgcgcaccaaagagagccaccgaacaagatacggacaagcagagcaggacaaacgcatgagagccaagagaggcaaaagaggaggaggggcgagctgggcggaacagcgcggccaaaacaccgaaaaaaaaaggagaaccagagcggcaggggaaggaggaggcacaaaaacgcgaggggcaaacagaggagggagagaaaggaaggaacagacgtgaaggtaggagag

SEQ ID NO: 657206 - DNA, 368 bp, Homo sapiens
atgaataatttccttaaattgttatcatctcaagttgatatcactttcaggaaattatgtcatatctactaaccattatgcaaaacccctttcttttctgccttaattggatcaacctgaactgaaaatgctgctactttcttgccataaataactgattattgttaagtgcctattatatgcaaaacaagtaatatttaaagaaatatatctgattagttggcatcaaaaggcaaagatagaacaaggaagcatttgtgtgctgagcaagtggtaggcacaggaagtacttagctcagaggataaaagcattctgatgtgactgggataagacaaacattcagtgagtaagcaaaaacatgatttac

SEQ ID NO: 657207 - DNA, 561 bp, Homo sapiens
  misc_feature (222)..(222): n is a, c, g, or t
gtgtgctgggtcgatctacagacctgtgaaggtgagttactgttgagttctttatgagtgtataagggtgacattcctgtgccagtctccagttacaaaccagtatgcccagaatttccttactatcaaggaaatggggctaatcctttctcactggtgttctggtccttctgaatagaccgaactaggtctttactgaagtctgacagagctgagctttgnatattgagactctatactccctttcagctaagaaattaaggagagtcttagcatcttcctgagccttccttgattggggcatagaggaaagtgttatctacatactgcaagaccctgacctgaggacgggaaaacttagaggggtcctttgacagtgcttgtccaaatgagtgagggctgttttgaaatccctgaggcagcaccatccatgttaactgtgtggtctggccggagggatccttacaggcaaacaggtattgagagtcaggatgtaacggtatgcagaaaaaggcatctttaaatctaggactatataacatttagttccttcaggtattg

SEQ ID NO: 657208 - DNA, 247 bp, Homo sapiens
ggccccaaaaaaaaccaaaccctgttgaccccttgattttgggcttttagcccctagaactttgaaaaaattattttttgttgttaaaaaccatccagtttgtgatattttgttatgggagccctaaaaatttagtcatggaaaaacatagtaatccttttatccagacaggaaatgcaaaaaggacattttttttttttgaaatgggggtatgtatgggggggtagccagtaattaaaatgaaata

SEQ ID NO: 657209 - DNA, 100 bp, Homo sapiens
cctatctttatggcccctgggataaacccggtgaggtgatgcgcgccattgaagttatcggttttatctcctgcgttctgttaggggcgtatccgaatgg

SEQ ID NO: 657210 - DNA, 172 bp, Homo sapiens
tggtacataaactccaacccttcacaatcatggcagccaacgccacttatccaggtgaaccactatcacgaaaaaaactctacctctgctatactaatctccctacaaactctccttaattataagcattcagcagccacagtaactaatcatatttttatactctttcttc

SEQ ID NO: 657211 - DNA, 547 bp, Homo sapiens
ggtggtgtctagaggtcccctacatgctcgaaattgaagagacagaaaaaacccctcacccccagcaggatgtgtgacctctggtgcaatggtgagttcatgaagtgacttcttcagtgttcagaattctcatctgagtaaagggagtgggggtggagtgggtcatctctgaggtttttttttttgggctctgatttgggtttcggtcggcccaggattcaggattggagagaagggtaagggttttacctcttatggtggaaaccggttgagatcacagagaatatacggagggcttaaaggggcagaaccatagcagggtgcggtaagtgggggaagagttttgggagagggtgaatttggcatgggacctgacagaatggtgtatggggaaggggagcggtaattcgggtcggctcacatctctcatactcaacctcatttctcctaattctgaaatctggagatcctctatcactaagagggaaaactacggtccaacggggacactttatggctcaccccatatgtgaaagttggtcgagca

SEQ ID NO: 657212 - DNA, 391 bp, Homo sapiens
cgaatcagctctgtaccgtgaacatcgtgtctttcattgtaccaacagaagagtctgtctccatgcgctccttgatcacgtggcccagcgcgggcactgctgccagtgtggcacactgcacggttatttccgttctacaaaatcagtgtgctttccagctctcgtttgtctttttctttttctcaatcacagtggtctcctcattattttaaagtggatttcccatatttatttcttagttctgtaattgaatttaatagggttacaagcagggttacttaaaaatgttcagacaagctagcactgttgtagcactggaactgaggttattctaactaggtgtttaggttatccggttatatactcactgagctttggacacgaatgttca

SEQ ID NO: 657213 - DNA, 353 bp, Homo sapiens
atacacatgagaactgaagtgcagcatccttgcttggccacagcattgtgattaaggacagtctgggccctgtggaactaacaccgcttttaccggctcgactgccatgcaccctgcatgtactgggtacctcgtggacaagttagcagatcgggagcgcaaggtcgccctcacggccatgatcataacgtatgtggtgtcaagctcccttctgcctttgctcttcccatccttccgcctcgaactgcccctcagatcagatcctggccgtaggccaccgcgagcccacaacccttgtcctggtccttgtttccctatcatcttactgcattcagtcctcccctctatagttc

SEQ ID NO: 657214 - DNA, 554 bp, Homo sapiens
accttgccataccagcccatcagtcctctgagacaggcaagcccaagaaagtcaggggcctatgtgagccaaagaggagagaaggtgatgcctcagcccagtgtttctgccccacctcgcttgtggccttcggaacttgatttgcaccacaggaaaatgggcaatgaaaacccctccctaactggcttctcagtccactctgaccagcccagtgcacagcgcccaccctgcagctccagatgaggcctcactctgtcacccaggttggggtggagtggcacagtcacagctcactataacctcaagctcctgggctcaagtgatcctgccacctcagcctcctaagtagctggaactacagatgtgcaccgccatgccaggcttgtctaacatttttatgtgttgcttcatccagtttgctagagtttttggagatttctgtcttcattcatgagagataatagtctgcacttttattttcttgtgatacttttgtctgatttgttatctgggtacatacccgccttgaaaatgaattgatgttttcctgcaaa

SEQ ID NO: 657215 - DNA, 1351 bp, Homo sapiens
tggggtttaaaatttttttatccttaaagaatattaccactaacaaatgcaaacaggctaggacatggtacgggggtggaggacggctatagctctctttgggaaagttgaaaggttgtgggtgtggcgtgtgggccttcatgtgccacacgtgattgtggctcagttaaacagggggcacatgtgccaaacaccacagggcattcaaagtgctgcctctgtgggtgtgcctcacaagtgtgttctcccgtgtgtctatattcttgggcctttcgaagggagcacacccaaaagcagagcaattgtgaagcaaaggggctttccctaaggtgtgcccctttccagggctttgatctcgtgaagagttcccagaaaaacagcgtggtttttaaagccagatatgtgtttataagtgtgggatttatttctccaccaaacttattccagagaaagtgtttctcttaacccattcaccaattttcccgtgtgaaagttacaaaaccaccgtggagttaacgagagccgtggggcgcaagaaacagaggcgagccaccaagtgggtggcccaccctttcataaatacgtgggtggggtccctagggggcagggacaacaggggcaaaagggcccattatagtgtaaaacgaccaagaccccccttcaaatttgccaaagtggagttaccaataaaagagatttatcacgtcgtgaaatcggaattatttttaaactccggtattgggaaaagaccaaagtgggcgagcttaaaagagccaagagtcctaacagtcctagtgatggggggggtggacaacgtgtgcggagcggaaacaccaagggcagtcccatagccggaaacacagaagaaaagggaaacaactaagccaggggacaaacaagggtcccgtgcgcgccaggatgaacccattggagggggacaacaacacacacgagtctggaccccacacaatcaaaccacaagagggaagaggccccacggaaaaggcgctcccgaaacagcgccgacactcattacatcacccgaacggaataggggagcgcaaagtctagcaccagacgggccaacacagaacaacactcgcaacatacccgacaaggttacaggcgaacacccatcccccggaagggcgataacctagcaaccaaacacacgatatgccccataggcgaggacacgaaaggactccataggagcgagaacagaccgctagaaatgcacagccgaaaaagacacgaggaggcgaaatacgcggtcgaagcagacagcgaacccccaaatagagagaaagcactgaaaaactagagagaacaagagagcgacactcacgag

SEQ ID NO: 657216 - DNA, 601 bp, Homo sapiens
gcctgttcgcagctgcggcagtgagtatgtgtgtgacggacccccggccgccgcggtcgggaccctggctaccctccttcttgcccgcgggctgtggaatagcgcgtgccccctcgccggtgctcgacgtcgtcccgatccgcaccctcgactccgtggtcgagggcgcagtctcctggagaatctgagcatggggaagtaaacgtcaggaacggatcgcaagtgaggattatattaatatgataattagcacgcggttcacggttactgactttttatgaggttggtggctatgagactatagaagcatacgaaggatgatctttatcgagatgagtcatctagtgaactgagtgtgatagtgaggtggaatttcaactctatagccaaattcattatgcccaagatcttgatgatgtcgtcagggaggaagagcatgagagaacagaactctgggaattcggaatctccgagtagtgaaccaaatgagaagaagctaatcgtcctttccagatagtgaggtcgtccaggtgtcagatgggtcagaggtcatcactttgtctgatgaagacagtattcatagatgttcgcgacagaatgg

SEQ ID NO: 657217 - DNA, 428 bp, Homo sapiens
gacacagacactgggatactcacatattccagcaccaacacggggacgctcactattccagcaccgacaaggggcaccgacacgggacgctcactattccagcactgacaaggggtaccgacatggggacgctcactattccagcaccgacaaggtggcaccgtcacgggtacactcactattccagcatcgacaaggcgcaccgacacgggtatgctcactataccagcaccgacgcggtggacgctcactattcccgcaccgacaaggggcaccgacatggggaggctcactattccagcaccgacacggggacgctcactattccagcaccgacatggggacgctcactaataccagcactgacacgggtacgcttactattgcaagcaccaacaaggggcaccgacataggcccttagaggtgt

SEQ ID NO: 657218 - DNA, 164 bp, Homo sapiens
ttgttggtgaccacgtttatgctcacgtgccacacgtggtgcccattttctgagcttccttatttagactgtgctcctctgtggtccacgttctgattctaactgtcggctagtatcactgtcacaaggctggacacttggaagggctggggtatgtgaactac

SEQ ID NO: 657219 - DNA, 953 bp, Homo sapiens
tattgatataaaaattaatcttaggttacaatcatagtttttttttctcccctctgctccccagtgcataatttctcgcttgggaagtttctagagttggttaaggtatatggttttggtatattttggagaccaagtctcgctctgttgtccaggctgggagtacagtgggcgtgctctggggtcatttgcaacctctgcctcccgggtcaccaagcaatttcttctggctttcaggcattcccagagtagcttgggctgtaacaaggcatgctgccaccaaaggccagacaattttcggtatttagtggttggaggaccttgatttcacctattgtgtggccaggatgggtctcaatctcttagacgctaattggatccgccctcctgtggcctcccaaatgttgctgggataataggcgtgaaccattgcaccttggactgaaaaccttgtctcttacaaattacataattaactcaaacacaactaactacgtaacacatgttcactggctgtcccaatattcgaccggttggtgcaccatggtctaacaattatttgacatcacccggaacattaaaccgtgtgaaaattagggtgtttgttacgttatgtgttaaaccagctggggtcgatatttgatggttgccgcgccacacacactgacacgttatccctgttgcaaaccgggattaagaagtaatccgtctaaataggtggtacaaccccgcaggtaccggaaactgggcgataaaatacaccgggtggccccctgtggcgaagggaatcggcactgggtgtacgaccggacggtacggaagataccaagggcaatccgggacaggacggaggcaacatccatgctatcaagcgaagaggagtaatcgaaaaatgggagtgctagaaattcacagcagggctcataaaccccgaagaatctagaaacggcgga

SEQ ID NO: 657220 - DNA, 314 bp, Homo sapiens
tcagagtactattaaacactggtgatacaaagatataaatatatacatgttcttatcctcaaggagactctaggttttgtgagagaagcagacatgagacaaattggcaggcaattatccttctggtattaaatagttgatgagaaacagaccaacttgtaaaatagtctctcaatcataaatgaaaggcatattttaaatcattaacaatataataagacttacttaggtctttcctctgttcttgaaccagggtggagatctacattatcaagtttcctgtaactcacagggaacagatcgttgagaagctt

SEQ ID NO: 657221 - DNA, 325 bp, Homo sapiens
  misc_feature (36)..(36): n is a, c, g, or t
  misc_feature (42)..(42): n is a, c, g, or t
  misc_feature (47)..(48): n is a, c, g, or t
  misc_feature (60)..(60): n is a, c, g, or t
  misc_feature (72)..(72): n is a, c, g, or t
  misc_feature (94)..(94): n is a, c, g, or t
  misc_feature (100)..(100): n is a, c, g, or t
  misc_feature (120)..(120): n is a, c, g, or t
  misc_feature (127)..(128): n is a, c, g, or t
  misc_feature (130)..(131): n is a, c, g, or t
  misc_feature (158)..(158): n is a, c, g, or t
  misc_feature (190)..(190): n is a, c, g, or t
  misc_feature (276)..(276): n is a, c, g, or t
  misc_feature (283)..(283): n is a, c, g, or t
  misc_feature (285)..(285): n is a, c, g, or t
  misc_feature (289)..(289): n is a, c, g, or t
  misc_feature (321)..(321): n is a, c, g, or t
ctcatatcctcattatcctccaaagggccaagaatngctcanctganncccctcaggacnaggccagtgccngaaacgcatccgctaccatggnagaggncgctttgggatcatgggggnggggggnngnnattattttgtgaagttggtggaagggnccccacctccacctgagccaccaaagacgggngttgcccatgccaaagagtatattcagcagcttcgcagccggaccatcgttcacactctatgatgaggagattcagactccacagnggggggntnttgncatttattttctaaaaataaacaaaaattganggcg

SEQ ID NO: 657222 - DNA, 102 bp, Homo sapiens
actctagaggacctccagaggcacaaggaggaatggcacggagcgcggcgtagctggttggcagctgcacaggatgaccccactggccagagctcggcaggt

SEQ ID NO: 657223 - DNA, 1008 bp, Homo sapiens
aagatgggaggaattatgcaatggccgaagctaacacgtgccggcgagcatctcacgtacaaagaataggttgctgatcgggagaactactgtggaccgaccgtacgcgtctcggcgtgtcatagatgcgacacaatcgaggtgtggccattcgacgattacgctgagggacgagtctatctcgatggcgcaacgtatcatctctggatcgatcgcaccgtggccgcattaagggtggtacatagtgtgaaccatgcaacgggcaagggactccatcatctggtccgcttgtgtggaacggatgactgagccagtgtgcagcgatcctagtggttgagtccgcctcaaacctatgctgcacatagatccgtgagattcgatcctgcgttagactgatgcgctaaagaaggaatgactcctttggattgggactcgtggttatccgacttgactttgcataggaaccgttcacagcacgcgggtcgtagcaatctgtccacacgcctggggccgaaagtgtccgggccactggtgcagctatgtagaatgtcggccgtcttttctaaacgatgcctaccaagggttacactgaagcgctgggacggtctgcgaaggagaagcacgtggccctgaacgctttagtgaatgcctggatcattcgaggtctcgcttgcaccacccatcgatcatagaacgttaattttacgtacgatttcccgagcaggcagggacttcaggctccaagcctggttggctaccatatcattaggcggttttttgtatacccatggaagaaaattattcggttgaactccaatgcgcggaaggagaacggggggcccccattagtataaagcgaacacctgtgtgtcacgggttttgtccccaaagaaaaaccgggggctaacacaatgggtttggaggtccccggcccataaagattccgcggggggatacccaggtgttccccaagtcccagcggggttccaagggcattgggggcccaaa

SEQ ID NO: 657224 - DNA, 189 bp, Homo sapiens
gctcgaccattccattcaattccattcctttccattccattccattcctttccattccattacggatgattccattccaatccattcgatgccattccattcctttctgttccatctgattccattcatttccattccattcaatgccatttctttctattctattcctttagtttccatgtcgacgcg

SEQ ID NO: 657225 - DNA, 214 bp, Homo sapiens
  misc_feature (1)..(1): n is a, c, g, or t
ntctagagatccggtgagtaattaaaatctcatctgatgggactattctgcttagtcagtttcatagtattaagtcattctggattaaataaatatatcacttatgatatgagtatagtgtctcctgatagaacttttggtactatgaagaatccacattactgatacaaaatttttctggtgccatctattttacctgatattaatatagtca

SEQ ID NO: 657226 - DNA, 846 bp, Homo sapiens
cgacaaacaacagcaccgactcaaggcttagtatatagccggtgcttcatcggccgagggaataacgaatgcatttagctgctgaagactgctattgggacatgctggcatacactgataatatgtggtcatcggcatggacgtagctggactccgagttcttcagtgtctgggaatgtatgaccatggactatcaagtctacccgatgaccccagcaggtacatctcagcctgaccatgctggctgacctgtacaagtccttcatcaatggactacccagatggtgtctatctgaagatccctttgaccatgtgatgacttggtggagcttggcagaagttcacagccagtgcaggaatccagtgtagttggtggtgatgatctcacatgtgaccaacccaaacgagtgatcgccaatggcctgtgaactgagaatgtcctgcaacttgcactcctgctcaaagtcaaccagatctggctccagtgacctgagtctcttcagtgctgtgcaatgctggcccagtgccaatggtatggtggcgtcatgtgtgtactacatcgtcctggtggtgagacttgaagataccttacatcgctgacctggtctgtgtgagtgcttgtgcaacttgggctagaatcaacgactggtgcccctatcactgatattgagcagcttggacaatgttacaaccagactcctcagaatttgaaattgagctgtggcagaaattggctacagtctgccggcaggcacttcagaaagccctttggacaataagctattcgcagtgcacccttcggacacttgtgggacaagacctacctcgttaactaagcagtcagcc

SEQ ID NO: 657227 - DNA, 890 bp, Homo sapiens
tatttcactcgggaatcaaaaagggggggttccgggaaaaggggtctctttgtgtgccctctccccacttcttctccctgtggtgtgtgggcccccgtggtggccttattagcccttttacccgtgagcacccaccccaaagagagtgtggggacaagcccccttcgcgtgccgtgtgtgttttttccccaaaccccttttaatgtgggagaggggaaaagggaggagaaaggggagaggggagcactgtgcgcccctctctctctaggcgcatctctgtggagaggggccctgtgccccacagctgtgggctttaccctttccctgtgggggtctttctctccccgcggaaaaattgggggaaacaaacccaaaccccgtggagactaaacaccccacgagaggtgtcacaatagtagaaaaaaaaaaacaaaaacaaaacaaaagaggggcgcgggcagaacaagaagaaaatccccgcggagggggcgccaccaaagataatagacgaggcaaaccgcgcagcaaattcggtgataacaaagagggggcccccacaaccagaggagaaatgcaatataataaaaaacaagagagacaggcggccccgacacttcaaaacacggcgccagagaaggcgggaaaaaacacgcaaacaaatggagagaccaattgtgaaagaaaaaacacaccctaacaggaaggaggggagtgagaacaaattggcgggcacaaaatatcccctcaagcaggtcttaaaacgctctaaggggaacaataaaaaaatttctaccggtgctttaatcgtgtgtaaccaacgagccgaatttccatggtcgtaaaaaaacatttgtgatcagggcacaatgaatggaaaaactatttacggc

SEQ ID NO: 657228 - DNA, 349 bp, Homo sapiens
cttgttatttagtgtttccatggaatacagtgggattggagggagctagaaaaattcaggatctggtccaatctgccagtcttccttaaatatcgaaaatacaccaggtgtgctatttcagagccaccctggccagacactccaatcgttatgcctgaaggttcggccatcggctgataggaccggagcacttccagatactgtgatcatcgtgactttgctcctcttgagggccagtggctgaattatgggcttggcacatataggatccgctattattcacagtgatgttggggatcaagagctcttgtgtggattgctggaacgtcccattgataaaccaagagta

SEQ ID NO: 657229 - DNA, 436 bp, Homo sapiens
cagcagcagcaggagaagaaggcagggataggcctcatgttgcctccaccccctgcactcgaggatgacatggagtcccagctggccggctccctcatctcacggcgggcagtttatgtgtgacctggacacagacagagacagagccagggccggcccttccgcccccgacctgtccacgccggcctagggttccagactggttggccttgtttgtttgggcggccctggagtggacccctgcctccccctttcttggggcttggagggaggtggcacagccccctggacttctcccgtctctagggctgcatggggagcccggggagctgagtagtgggggtccagagaggacccccgcccccaaagaattggttttggctccagccttcccctggccccgtgacactcaggagttaataaatgccttggagga

SEQ ID NO: 657230 - DNA, 827 bp, Homo sapiens
caaacacgaacaggtagcagaccacctataattctcacattgtcctccgcgtgttaacgtgctcttctcgcaataccggctccctctgcggcccgcccctttgaatcctgtgctatatctaaactccgccaccccctctatagctggtcgggtccctattagggcctcagaatatgaaaaaatctgcgttttacagtcccccccagacccctgctcttcgagaaccttattgccgctcctctataatgcaaaacacctccgggcttctccctctaaccaaacagcgacaatcacaatgtccggccccccctcccccgtatccccttttccccttaaattccaacacctcttcccactcctctgggaaacccccccctccgcgaatattggacccctctgccatgaccccgcccatatactgtttaaaaaaccccccgccccctcaattttttagaaaaaaaatcgccatcacccttttatataatacctcacgagcactcacggttcaaaaaacaacagggaacttgttccccacccacatatttttaaacagtttctcccgcagcgactcactaataacgcgagaccaacaatctggctccaactaaaacatctgccccgagtttgtgtaccccctatagtagctcaccccaacataaaacctttagcgtctttaatactgtccaaagagaacgggccattctttcagactgcccagtttcagagaacgacccgttattcctctgcaaatatttctcgcgcccccagagagcacccctcaccctttcttttcaaaaaaaaaacccgggagtttttcaaaacaaaac

SEQ ID NO: 657231 - DNA, 152 bp, Homo sapiens
  misc_feature (1)..(1): n is a, c, g, or t
  misc_feature (23)..(23): n is a, c, g, or t
  misc_feature (78)..(78): n is a, c, g, or t
  misc_feature (104)..(104): n is a, c, g, or t
ngcattggttcccttcatttcantggatttgacagagttgattacttttttgggaaacacttctttctctgcttccgntacaccaaactctcctattttttttnggttggttggttggcctctcactggttactctctctgttccacctctc

SEQ ID NO: 657232 - DNA, 325 bp, Homo sapiens
cgacatgataccctgcgttatgtacccggaatggtacgctgttactgtatgaaagcagagagaaggcagtaatagggactttagggggaagagactcctgaagagcacacgtggtggtactttggaggcaggactggctaataaggcaagcgaggtgaaggcactttatgagcagtcaccgaataagaaaaggctccacaagggcttttcactcccaagtagcaagcagcttgccatggcaggctgggaacccagatttgacaatgcttctaagatcagagagggaagtcttgggaaggagtgtaggcatctgtcgttgtgatta

SEQ ID NO: 657233 - DNA, 1161 bp, Homo sapiens
  misc_feature (111)..(111): n is a, c, g, or t
ggagaagctggccacaatgctcaatctgggcccgggcaccggactgggcgctccctctgatcgagtgagtgtggtgagtcccagtagcccggagtcgccctctaatcacgntcgtgacttctcgtgactgtgtctacgctgttacatgcgcagcagataaccctggagccacgagggagtgtagacatgcgccatcgtgccgtgccccaggccgttcctgacgagcccaggcgcccccgtgacccccagtgcttccccagtggcctggtcagcgagtgcgaggagactacagatgcatccactatggagcgaaagtcctgttagaccacttggacttctaacgtcccccttaggggaaccggtggtactgaatagcagccggggactgactgagcccgtgagcagccacgtgctcctaccatgtgggatgaccctcgtggcaccgagtgaacaaggtagacggaccggtcaggggcccgtggccgtttgcaggatcgggggcctttgtgccccctgtggcttgtcgtaaagggagtgcctgtggccttgggagctcttcggtggacatggtcgggcacggccgtagaacctcgtgggctgtcccaagacggggggccgggcggggcctcgcattgccttagcagttcctctgggcgaagctttggcttggggtggcggtatccccttggggggccccccctacgctgtattgccgccccttccggagttggttcctccggcacactaaagcgcgctcggggggtctcgccgctaagtgcttgggaatcgacgcctgagagtcccccgaatcccgtgggtgaagccccaagcgtccgaattggaaaagccgccattcgaactaactttcgccggaccgctagggggggccccccacattacgccgtggaaaggccccgccccccttttggcccttttggcttgggggccttaagggcggccctagggccccgttaaggcggaacttggttggggcggtttaccaaggataggggaactgcgcaaggaaagggcgccggggcgcaataaacatcggggggggaacagcgaatatgaagaggaggacaaataccatcacattccccacaatattaggccctgcccttcgtccacacttacatatagcacctctcctggggcgcc

SEQ ID NO: 657234 - DNA, 179 bp, Homo sapiens
tgttgtaacacatccgcatgatcaacagatgaataagcaagaacgtggtatatacactcgagtggtagtattattcaaccattaagaaggaaggaaattctcgatacatactacaacatgaactgaacagccatttaaaaattcaatgggtgacaacttcttggggtgtgctttcaggt

SEQ ID NO: 657235 - DNA, 261 bp, Homo sapiens
agctggataatctgcgacatgatgcatcactgggtggatggcgttgtataagaaaaagtgcagaaggatgagttccgctatcgaatgtaccagactcaggtctcagacgcagggttataccgttgcatagagacagcctggtcacctgtcagtggcagcctttgtagagaagcagcaaccagtctctccgatcctattgagatagacttccaaagctcaggtcctatatttgatgcttctgtgccttcagacacaccatca

SEQ ID NO: 657236 - DNA, 877 bp, Homo sapiens
  misc_feature (8)..(8): n is a, c, g, or t
  misc_feature (83)..(83): n is a, c, g, or t
  misc_feature (100)..(100): n is a, c, g, or t
  misc_feature (196)..(196): n is a, c, g, or t
  misc_feature (202)..(202): n is a, c, g, or t
  misc_feature (208)..(209): n is a, c, g, or t
  misc_feature (221)..(221): n is a, c, g, or t
  misc_feature (251)..(251): n is a, c, g, or t
  misc_feature (257)..(257): n is a, c, g, or t
  misc_feature (259)..(259): n is a, c, g, or t
  misc_feature (279)..(279): n is a, c, g, or t
  misc_feature (290)..(290): n is a, c, g, or t
  misc_feature (296)..(296): n is a, c, g, or t
  misc_feature (298)..(298): n is a, c, g, or t
  misc_feature (322)..(322): n is a, c, g, or t
  misc_feature (350)..(350): n is a, c, g, or t
  misc_feature (382)..(382): n is a, c, g, or t
  misc_feature (384)..(385): n is a, c, g, or t
  misc_feature (391)..(391): n is a, c, g, or t
  misc_feature (400)..(400): n is a, c, g, or t
  misc_feature (402)..(402): n is a, c, g, or t
  misc_feature (407)..(408): n is a, c, g, or t
  misc_feature (412)..(412): n is a, c, g, or t
  misc_feature (424)..(424): n is a, c, g, or t
  misc_feature (429)..(429): n is a, c, g, or t
  misc_feature (436)..(437): n is a, c, g, or t
  misc_feature (457)..(457): n is a, c, g, or t
  misc_feature (468)..(468): n is a, c, g, or t
  misc_feature (475)..(475): n is a, c, g, or t
  misc_feature (518)..(518): n is a, c, g, or t
  misc_feature (524)..(524): n is a, c, g, or t
  misc_feature (526)..(526): n is a, c, g, or t
  misc_feature (567)..(567): n is a, c, g, or t
  misc_feature (775)..(775): n is a, c, g, or t
  misc_feature (865)..(865): n is a, c, g, or t
tttttgtntatcttagccgcaaactacttctgagattctctttcttttttgttcttctagtttttttaaagaaagcataaacnatgtatattagtatggnatgtcagcaaatcccctcttagtcctttattctgtgatttgggccttctacaaaatactttgtgattctcactaatgaatattaagaacatacccnattttnactaannagtagtgaaacngtggttggtagaatctttctcactatatcncggtcncncattatatttgagaataacnaatgagccccntataancnggtaattgtgtgtgtgtaaactcnatttttaaggtgtaatagtagccccctngataacttagccctgtgactatccctttttcncnntttggngatataccncnttttnncccnatccgataaacncttcnccccccnnttgcttgtccctttcccccntccttaatagncattctntatatcacctgacaaactgcctacacacatatgtgtatatatncacacnanagtatatgtctatctacctctttcgctttgcctaactttcncaactgagatgaggcccaccctctcatttatatcttctagaatacaatatcaccaactgaaagtttctaataagagtttcaacttagttaatcagaaatactggctactgaaaattctgaggccaaagagctgttattcagcttagtatattctaggcttacaaatcagtcaaagactgaaattatcaaatgcccatgaaagaaaganatttttctctttgtatttccttctaataacaaaaagaaaatatctttacaacaagctttcactttttaaagaattaaaattattacaganatctccctagtc

SEQ ID NO: 657237 - DNA, 333 bp, Homo sapiens
ctcattgtggggcactccgaggctgaggactgcaaaacctgtggctacaattacaaacaacttccgtgctgggagactgtcctgggccaggaaatgtacaacacttctgctcttatgatctgctgactagtcttggacagtcgcgctagctcatccagttttcctacgaaagctcctctggtggcctactgtcctaggggcgctagggtcgtctagagcgggcgacccaggcagttccagtgtgcccgactgaggtgctggggcgtcatcttacgcgcagacggtggtctgggtggggagttttttctgccctttactgcccctgcttaacac

SEQ ID NO: 657238 - DNA, 1103 bp, Homo sapiens
  misc_feature (152)..(152): n is a, c, g, or t
ccgatttctctgtgggggggacctcgccacgagggacttattattgggcccctctccactaattttgcgtctcatagtggttgtatcctcccacacggggggtccaaatggaccacaatctccgtgcttgggtcttctaaatggggacacancacttcatgcaattgtctgtgctagtaccgccaaatttgtcgcaccgccaaacccgtgggtttgggtgaatattcgtccccatatttcctccaattgggggaatttgtcttcttacacaagattgtctgatgcgtttttggcgacacgagcgcagtgggcgcccttccaatagtgttttttatggggacaaattctccccctatcggcgttgtggcgaccctcccctcgggcttttttttggtggggccgccctaacgcaatcgctgcggtctcagggccccccctccacacccttggggatggcccttctagttcgcgtgggggacccgtcgtctctcccccaaaatggggcaaatggccccccccccgcgaaggagccgctcaccaaatgtccggagtcgtttccccccaataggtgtcaaacacccaggtgctctatagatggccgtccccgcacgtgggtatatgccctggacacctgccgctcgcacgcgtagagatgcccccccccaccgtggaaacacacgtggcgcacatccaccagacaccccccacacccttattggcgtacaccaaacagggggccacatcttctcacatcgccacacccatgacacccacatccaccacggcgcaacaccaaggttctcacccctctgaggcgcccacacttcgaaggcccatcttctcctccatgtaaagttctacaatttgtccttctctctctgttacaaatttcgcccaaaatctttttcttaattccttggagcccaatcaagaagaattctgtagctcccttggggccaaaggtactaaatctccctttcagcacccccactcccttcccctttttaaagtaactttttccacacacggaggtatttctctttttatgttggtcctgagtattttgccaaagcacaccgagaaaataaactaaactcccttgt

SEQ ID NO: 657239 - DNA, 1662 bp, Homo sapiens
gtctcttcaccctgccgtcatgtctaagtcagagtctccatcaagagcccgaacagctgaggacagctcttcattggcagggttagagctttgacaacaagctgcatgcagcagcctgcaggagcccattttgcagccaatggggcacacgctctacggcactgctgtggctaatgcagcagcatcccaaacacccaagcgctcctaggggcatttgggtttgtcacatcatgccactgtgcgcaggcaggtggcatgccagcctcatgccaatgccaaggccaaccccaaggcgcgcatggcacagcagctagtaggcaccccaacagcagcagcatgtcatcccagcagcaagcattcatcaaaagcacccaggctgccccacatttcacctgttgcaccaacaagcatcatatcagcatagcgtgcgcccatctacacaagccaagcaccactgcaaagcatacatccaaccctcaagcagcattcatattcgtcacaccagctcatgcgcccccaccttagcaaagttgccacggcaccttctatgtaccctggaaaccagacggcgccagatggcgcaaagacaacaaaggacggagccaaacaggcccaaaaacgactaacccacaaacagaaccgaaaacacatgaaatatacactgaaagagcacctaaaagacaaactagaccacataagaagacaaacaaatcacacaacaccactcggctcgcacacatagggccccacacaacacctcgacatcacaccgcgaaccgcaccaccaccgccccgccctcgcgcgcagcacacaacccaacacaactcactgacgcactatgttggactatcacacacacacacggaccacacgaagacgcgatctcgacaagcaatggacaaccacagcaacacacaccaccagggaccaacggacgggaacccagctatgctacaacaccgggagacacctcaggcactagactacacaccacacaaactaactcagctaaaatctagacagcagccacccaagcaaacaaaacagacaaacgacagcgaacacacacccaaccaagaggagcacgcatacccaccacgtcagcaaccatacgccacagcactctaaacgcacaccacaccactcgacggtacaacaacgacgaatacaatcaacacagccagacacagcagaactcacaaggaacaagagaaacactcagcacacaagcgacacacaaccacaacaagatacaccacaatagacaccactcaacgcaaacccaaacagcgcaaaaacttcaacttacctatcagatcacaccacactacatctcactctaactccagcacctactactcacactactcactgctactaattgaaagaccatttactacagatacatactatctcaaactgtcgacactaactcacatcacatacacatctctgccatcgatcctatgtaaatacacatttacatcatacaaactaaatacaaactcaacacaatcaaaaagactacattatcaatctactcgttacactccacctcatcattcaacatctataacgtaatcattataccacagcagtctacaacacacacaccaacaaatataccacatgcatatcttccaacaaatcaacccaactaa

SEQ ID NO: 657240 - DNA, 372 bp, Homo sapiens
aagctcgcccgaattaagagagagagagaaagaaagaaacaagaaataagaaagagaaagaaagaaaggaaggaaggaaggaagaaggagggaggacatgaaggagagcgaaggagacgaggtgaagaagacaagaaagaaacgataatagtaaagaatgcttcagacacctgtctacattactgtcttccttgctaattctatacaaggtctcaccactaatcttcccatgtgctctctccttcattccttcctttccttccattcctttccttccttctttccttctcttttctcgtggccctctctcttccattccgtccctgtcttgccttccctacgcttcgttccttgccttgcctgtccttacct

SEQ ID NO: 657241 - DNA, 105 bp, Homo sapiens
ccatagagtgatcctgagacacactgctatttatgtcttagtgctgtattgccttgtatttccttctcagttacatggacacagaacggtatgaacaacagtgca

SEQ ID NO: 657242 - DNA, 101 bp, Homo sapiens
gcctactactactaaattcgcggccggtcgaccgctttgtgattccatggattgattcatcttctggatttttttttctttatattttgggtactggagct

SEQ ID NO: 657243 - DNA, 160 bp, Homo sapiens
gctggacccagcttaaatggtcgtctgcccacaggacatgggacaagccaagctccctgcctgttcttggtagaatccaacaggacaatggaatgcattcctcatcttgtggaatagcttccttcaggacacttaacgcatcccagtccgtcctgactgg

SEQ ID NO: 657244 - DNA, 526 bp, Homo sapiens
  misc_feature (4)..(4): n is a, c, g, or t
  misc_feature (36)..(36): n is a, c, g, or t
  misc_feature (98)..(99): n is a, c, g, or t
  misc_feature (103)..(103): n is a, c, g, or t
  misc_feature (113)..(114): n is a, c, g, or t
  misc_feature (157)..(157): n is a, c, g, or t
  misc_feature (167)..(167): n is a, c, g, or t
  misc_feature (174)..(174): n is a, c, g, or t
  misc_feature (205)..(205): n is a, c, g, or t
cacngagtagacctgttgctagcccattgaagttanctgtccccctggtattggtttaaatccctgtccaatcttgagtcaccctttagtacgtgtgnnttgngtccttcgtnnctaaggtaagaacgtgcttgtggaagacaagtctgtggcttgntgagtctttntggccancagcctctgatctgtgcagggtattaacgtntcagggctgagtgttctgggatttctctagaggctggcaagaaccagttgttttgtcttgcgggtctgtcagggttggaaagtccaagccgtaggacccagtttcctttcttagctgatgtctttggccagaacaccgtgggctgttacttgctttgagttggaagcggtttgcatttacgcctgtaaatgtattcattcttaatttatgtaaggttttttttgtacgcaattctcgattctttgaagagatgacaacaaattttggttttctactgttatgtgagaacattaggccccagcaacacgtcattgtgtaagg

SEQ ID NO: 657245 - DNA, 1607 bp, Homo sapiens
  misc_feature (88)..(88): n is a, c, g, or t
  misc_feature (374)..(374): n is a, c, g, or t
  misc_feature (538)..(538): n is a, c, g, or t
ggggcggctgaggattaaacgctatcctgactggcattgccacaggcttcagtctgaccgatgctactggtcagacgcgctcatcccntggcgtcgtcccacgtactgtgaatggcgagtctgctgtgcgcactggtttgtcaggcgttcgatgcagacgggcagcagaacctcacgccgtctggagtcctgacttgacgcctgacgtcgttgccgtgtgttgcttgctccagtcggtgactctgcccggctggcggcggggcctgtgctgcgaagcttcggtgggagagcgttgagtgatccgcagtctgtgttgctgcgtgcacgagccaggtgacagtcacgctgcagtctgtcggcttgagactccatgntgtgcgcagccatccgactccctgcctgactgctggcgctggcacgctctggttgacggctgaagactctgagtgacttcgactgtgtcattggactttggccttgtagcggttgacgtccggcttagagcactgtaaggtgggccctatgtcccgttcgacgngttactcgctaacctcgcgtagaccgcttgttggtgacttccgtggccctttgcgtgctttggcttagccccgtgcggcgccccgaccgtgatgagcgggcttagagctcgagcgttagacactgggcacgccttcgccgtgcgggacctgtgggcctagttcgtgtgtctcgtgtgcgtgtggtcatatccgcctttattgttagcacgagtcgccggccctgcgcctagccggcggcctttacgcctaagcgttggcgccatgtgtctgccctaggacccaatgctttcacccagtgtgcacatattgtgcccttacagtgcgaaagtttcaggggaaggcgacaatgaacctctggcacatgcctggcccaggggacaaaaggtcggtcgacgacggagtggctccccggtgtccagttcattccactagcgactcggagaacgcaggaggtgggttccttaggatacgcactaagggtttggcaaaccacccgccttctcgagtttgtcgaggcggcattaacattgactgccactccaagggcaaatacggcgggtcagttgcgtcaactccgacactagtaccagggtcggctttaccacaaacggtttagagttaaccggaaggtcttcaaggaagcaacaaagaaatatccccaaggaaaaccatttcttcccttaccggaacgatcccaaacgccgaggggacgaaccacggacctttttgggtcacctgaacggtagtagaacgaaaatgggaagaacacaccgcggcaaattacgccttgaagcattcctcaaaacgttgctggaggtcccagggggggtgttccaccattttccccatgcgtggcacccggacggggccgtttatatagcaaaaagcaagggttgcccttcccaaggcacggaaacaggagcgaacttgcggggatcgaacaacaacttcggcgaccccctacagctacaaccaagggaagaaggcaacatgaacatcggagacagacacgacccgatgactagcacaacacccactaacaccgcagcaacactgatatacacgttt

SEQ ID NO: 657246 - DNA, 135 bp, Homo sapiens
acgcacgcgaccaaacgaggtgccgggtggtgaggcaagagcgttttgcttacttttgcgcttttcaaaagtgagccgccgtcagggcggaaccctaagtggccgttacctaaataacggatatgtacgcggcgt

SEQ ID NO: 657247 - DNA, 870 bp, Homo sapiens
  misc_feature (38)..(38): n is a, c, g, or t
  misc_feature (90)..(90): n is a, c, g, or t
  misc_feature (94)..(94): n is a, c, g, or t
  misc_feature (126)..(126): n is a, c, g, or t
  misc_feature (149)..(149): n is a, c, g, or t
  misc_feature (154)..(154): n is a, c, g, or t
  misc_feature (162)..(162): n is a, c, g, or t
  misc_feature (210)..(210): n is a, c, g, or t
  misc_feature (216)..(216): n is a, c, g, or t
  misc_feature (226)..(226): n is a, c, g, or t
  misc_feature (230)..(230): n is a, c, g, or t
  misc_feature (269)..(269): n is a, c, g, or t
  misc_feature (274)..(274): n is a, c, g, or t
  misc_feature (296)..(296): n is a, c, g, or t
  misc_feature (308)..(308): n is a, c, g, or t
  misc_feature (324)..(324): n is a, c, g, or t
  misc_feature (328)..(328): n is a, c, g, or t
  misc_feature (330)..(331): n is a, c, g, or t
  misc_feature (335)..(337): n is a, c, g, or t
  misc_feature (342)..(342): n is a, c, g, or t
  misc_feature (352)..(352): n is a, c, g, or t
  misc_feature (355)..(355): n is a, c, g, or t
  misc_feature (368)..(368): n is a, c, g, or t
  misc_feature (391)..(391): n is a, c, g, or t
  misc_feature (425)..(426): n is a, c, g, or t
  misc_feature (429)..(430): n is a, c, g, or t
  misc_feature (442)..(442): n is a, c, g, or t
  misc_feature (574)..(574): n is a, c, g, or t
  misc_feature (577)..(577): n is a, c, g, or t
  misc_feature (588)..(588): n is a, c, g, or t
  misc_feature (611)..(611): n is a, c, g, or t
  misc_feature (622)..(622): n is a, c, g, or t
  misc_feature (624)..(624): n is a, c, g, or t
  misc_feature (689)..(689): n is a, c, g, or t
  misc_feature (694)..(694): n is a, c, g, or t
  misc_feature (698)..(698): n is a, c, g, or t
  misc_feature (722)..(722): n is a, c, g, or t
  misc_feature (744)..(744): n is a, c, g, or t
  misc_feature (750)..(750): n is a, c, g, or t
  misc_feature (859)..(859): n is a, c, g, or t
ttacactgatttgtgatacaacggacattaaacttccntttaaaaagaaaaaaacaatttggtagctctcccttttctgtccagaaaaantcantctttcataatcaaattaccctaaaatttggnggcgttaagaggcaacaaaagtnaagcntccaacgnatccctcctctcaaccggaaatgtcttctatttccaatcaggataaanccttgncttacttgcnaggnctatcacggttagcccttcagtgattcctgacaccagtnctgtnaaaaagaaaatttcctgcgggngaagctcatgtnttcattttggagatcngttntnntttnnnttttnttcctttatnacngtggcttcttggnttgtgggacaaagggggccaacnttccctttccaaaccatccatcaccatgggtggnnggnngcgccacctgcnggccatcatattatggctcacatacccataatttccttgcggtgctgaattccaagtggggattattagagacccctcagagccaaaaggggaccttagaggtcttctagatgagtcccctcatttgtaggnggnggtttctgganaactcagagtggcagggacacanacgagcctttngnaaggtatactgctttaagattgaaaagaaaaccatttggcgccctaattttgcctggatggtgcnctgtnagtnaaagaaagggaacaggtctggggngggggtaagggcaccctgagtncctgtnccatcacttcccaggcagtagaaggctgttcaggaacagctcccatccgcagctgggcatgttttggctcttacacaagaaaatttaattttacttgaagaactaaganctaaatcttgt

SEQ ID NO: 657248 - DNA, 746 bp, Homo sapiens
  misc_feature (76)..(76): n is a, c, g, or t
ctcgatttaaagcaagagcttctaactgatcttgccccactacataataatctcactccagctttcttgctgcttnttagacacactaggcatatattttcctgtcttagggcctttgtgattgctttatcttctgtctggggccctttgtccccagagcttgtaatgccaggtgcctttttgtcattcagctctcagcccaaatgccatcctctcagagatagcctccctaaccaccagtttaaatgggctctgcacctccttcttagtcattatttgttactgttttatttcttacaagcagttttaactatttaaaatgcttttgtttgggagcttgtttattgtcattacttgccctgcttctccaaacaaatttattgaagatatgggtttagctgccataacagggtggctaaaacaaaatagaaacttatttccctatttaataaacgtttaggtgggtgatataacatcagcctgggcgacagagcgagactccatgtcaaaaaagaaaataaataaataaaacttgttagaataaaaagtttagggattccccccgtcaatcctgtctgtacatatgagtgaattgagaggtctggaaacatacccacccactgttaacactgttgatttttttaaatggtgggattatgagtgactgtactcttctgtatctatcaaatataatgaatgttgtatcatttttataaaataaagtctttcttttttaaaaaaaaaaa

SEQ ID NO: 657249 - DNA, 559 bp, Homo sapiens
tggcattcaaataaagttaaatttaaaacttgtttgctggccgggcacagtgagtcacgcctgtaatcccagcactttgggagcccgaggtgagtggatcacttgaggtcaggagtttgagaccagcctggccaatatggtgaaaccccatctctaataaaaatacataaattagccgggcgcagtagcatgcacctgtaatcccagctacctgggaggctgaggcaggagaattgcttaaacccgggaggcgaaggttgcagtgaaccgaggccacgccattgcactccagcctgggcgacagagcgagactccatgtcaaaaaagaaaataaataaataaaacttgttagaataaaaagtttagggattccccccgtcaatcctgtctgtacatatgagtgaattgagaggtctggaaacatacccacccactgttaacactgttgatttttttaaatggtgggattatgagtgactgtactcttctgtatctatcaaatataatgaatgttgtatcatttttataaaataaagtctttcttttttaaaaaaaaaaa

SEQ ID NO: 657250 - DNA, 729 bp, Homo sapiens
tgttacaaatagctatatttttaccaccttagagaacctaaccttaggattaattttatgcattttacacttagcaggaaagctagaaacacaggaaaagccaatctctccagagataggcctatgtacaagaggttcacaagtagtattcaagtggttccaggaagcttttaaaataatcctgggaattagaggctactttgcaacccaattaaacccaaaagtttaccattctgtttaatcctaaactgaaaagagatacataacttaaataatcagcattaactcttcctaccaaacttttttttttttaaacggagtctcgctctgttgcccaggctcgcgtgcagtggcacgatcttggctcactgcaacctctgcctcccaggctgaggcaggagaattgcttaaacccgggaggcgaaggttgcagtgaaccgaggccacgccattgcactccagcctgggcgacagagcgagactccatgtcaaaaaagaaaataaataaataaaacttgttagaataaaaagtttagggattccccccgtcaatcctgtctgtacatatgagtgaattgagaggtctggaaacatacccacccactgttaacactgttgatttttttaaatggtgggattatgagtgactgtactcttctgtatctatcaaatataatgaatgttgtatcatttttataaaataaagtctttcttttttaaaaaaaaaaa

SEQ ID NO: 657251 - DNA, 981 bp, Homo sapiens
gtttgtgattttgtatgaatatgctgtctgtctacaaagtcagttaaaggtacgtttaatatttaagttcattctcatcttggcagcatccaacatctgtcatgtgcaattccaccggtcattcaccagtttcattcatgtcaaacgacagcagcattatggcacatgcaccatgtacctgtcatgtcatccagggcacacacaatgtctttacatgcctttaccacagcaactcaaccaccagttcattcctcatcactggcattttaggtcgtcatgaagcaactgctggagttataggaatcaagcaatgtgcatgaaagccgtaaacataccaagcaaagcgtatcatactgcaattacagcaagagaaatacaaggagaaaagagaagaatctgcaacattgggagaaggcaatacagcattccccaataccaacaccaccaaccacccaacctcaggaagcgtaacacataagacccgggacgccccaagtaccacacacacaaacgttacaacacacacggggcagccacaatacagccaccacgcacgcgacacatccaaatgcacacaacatgcacaggccacaggactaaaacccccgcacacacaaaaccgacaccagacgccaccgcgtcacaccatccgctacacaacgacgaaggcgggcgaacacctaaaacaaaccgagaccctaaccgacgcaggaacacgtccaccagaaaagacatgaaaaagagcaaagaagccacagccacagcaaacaatacaacacaatgacaccgcacggacacaagagcgaaacataagaaaaacgtgaacgagagacagggcgaacataatccgacaacaaaggacagatcccaccaagacagcagaacaacaaacaaaacaacacaagcagcaccagggaaaaagagacgcaaaaaacacacactgcgaccaacaagagcaagagaaagacgcaggcagcagca

SEQ ID NO: 657252 - DNA, 274 bp, Homo sapiens
tgagtttagctttgttcagtcacagagactgcccgaacgatactgtgcctaaatagaggctggctgtacagtgccagcatcagagaccatggacacagtcgttgggcctaagcactagcccaccctactcaccattgccaatgcccaagtacactgccaatgcccaagtacattgccaatgcccaagtggcctgagatacccacccattgtatcctgtcacctagctcggccacagctggcaccaaacatgctgaccagggacccaagaaactg

SEQ ID NO: 657253 - DNA, 407 bp, Homo sapiens
ccaaattcccaggatttttcgccccttttcaggggttaaaattgggcaaaccttccccattttctttccggtcccggccaactgggtgcttttaaaggaaccccccctgttgcttttaaaaacccccggagcccgggggttttactaaagattttaaggggttaccggatagggggggaagggtaaaaacccccaaaaaattttgggccccggggttttcggcccccttttaaaacccggtttttgggccgtttttttcccttgggggttttttgcccttagccccccttttttaaatggttgcccccccccccaaaaaaaggatggggaaggggtttaaagtgggtatttttttttaaaaggtggtgggctttttaaaacctttttttcaaaaaaaaatttagcca

SEQ ID NO: 657254 - DNA, 352 bp, Homo sapiens
aataatgagcttaggagtaaatagcacctgaccaaaaggtttgtttgtttatttatttatgagacggagtctcgctccgtcacccaggctggaatgcagtggcgtgatctcggctcgctgcggcctccgcctcccggattcaagtgattcttttgcctcagtctcccgagtagctgggactgcaggtgcgtgccaccacgcctggctaattttttgtatttttagtggaaacaaggttttaccatgttggccaggatggtctctatctcctgacctcgtgatcgtcctgcctcggcctcccaaagtgctgggattacaggcgtgagctactgcacccagccatttattttct

SEQ ID NO: 657255 - DNA, 442 bp, Homo sapiens
ttgctccctctcgtgtggtccggcggcccgcgcccctcgcctcccccccctcgctgtcggcgtctgtgtctgtgctgcgtcctgctcctctctctccgcccccgtcccgctctcccccctcgccgccggccgttcgggctcgccgcctcgccccgcctcgcgcgctggctaggcctgatgcctctttctcttagagagatgggcggagacgagtcgggtgctcccgcccgcccggcgccgcccgccgcgctggctcctgcgggtcgcccgccccgctccctgcctccgcgcctgtgggtcgcttagctgggcgcgggagtggtgcagtgtaattcctgttaccgttctgctcgtcgttcatgaccgaagtgtccgcggagccgatggaatatctgggcctagcacacaagaaaaagaaaagaaatagaaaaagagacaaaga

SEQ ID NO: 657256 - DNA, 285 bp, Homo sapiens
tcctagtacctgcctgtgggggtggggaggattgtaatcctttttaaaaagtacaggttaaaattatagattgatataccctgcgattttcttcttcattcaacaacacagagattggccgggcgcagtggctcacgcctgtaatcccagcactttgggaggccgaggcgggcggatcacgaggtccgtagatcgagaccatcctggccaacatggtgaaaccccgtctctactaaaaatacaaaaaaattagctgggcttggtggcagacacctgtgatcccag

SEQ ID NO: 657257 - DNA, 140 bp, Homo sapiens
gggtgtagaagagaagaagaaggaggttactgctgtgccagaaacccttaagaaaaaggcgaaggaatttcgcagagctgaaggtcaagcgacttagaaaggaggtttcccacatggtgcttcggaaggcaaggagggag

SEQ ID NO: 657258 - DNA, 152 bp, Homo sapiens
ggacccgaagcctaaattcaggaggggtgagcgagtgctgtgctttcatgggtctcttctatatgaagcaaagtgtgtaaaggttgccataaaggacacacacgtgacatacttcatacattacagtggttggattaaaaattgggtgactc

SEQ ID NO: 657259 - DNA, 130 bp, Homo sapiens
actcgacggtttctcttcagaaagtgctacgacgcccggttatcagctgaatatgagaaagttgagctgccctcagaggagcactgtcagtggctcacagggaccttctgaagagaaacctgctcctgtt

SEQ ID NO: 657260 - DNA, 737 bp, Homo sapiens
  misc_feature (90)..(90): n is a, c, g, or t
  misc_feature (150)..(150): n is a, c, g, or t
  misc_feature (206)..(206): n is a, c, g, or t
  misc_feature (415)..(415): n is a, c, g, or t
accagccctcttcccttgcaaaataagtttcgggacttccagaaacaggccttcaacggaatgggggagcagttttcctacagcaccaanttggccagcttctttttccccggcattggaagggggggctcaccctccctggttatggtntttattttcacctatgggctgcagggcactggggtaaagagcttccctcttcctantgcagcatgaaatgcaagctcccctcagcccatcttggtcccttttcaggccggtgaggagctttattggggtgcccccatctcttcccacaaggtggacatattttgcgtaaatggttaacccaccagctttccaaggtttgttcctgttaggggtaaaggacaataaattttaggggttcccctttcccttatttatttttgtgggnacatcatccccggctgtggaaaggggttttgtgtaacaaaagctccccccctaaggttatagggcccccttagtttgggagtgtggaaggactacttaactgtttgtcccgcttggccgtcggtatcgttttttggggatgttgggctaacaataaaaaggacccgggtttttttttttggccttaaaaagaaggggccccccccccaggtggggtgggggcgattcccggctgtttggcatgtttcccccgggagggccgggcaggagcatggggggcttggttgtttccttcctaataaaaaaaacccggggcgccctga

SEQ ID NO: 657261 - DNA, 981 bp, Homo sapiens
taaaacgggaaacaaagaaatcggagcaatttattattatttttttatttatggaaacagagtctcacggtcacccaggcgggagtgcaggggcgtggggtcagctcacagcaacctccacctcccaggttcaagtgaatctcgggcctcagcctagggaacagcgtggggacaacgaggcttcccgccaccagtgccgtgggctactttttttttttttgtgggtgccgggaaatttcatttgtgtggtcccccggggggtggaattgtgcgggggccaccaatcatagttctcagcgggcagcccttggaacagtggggcttatagccctcccaagttagcttgggaactgtgcgagggcgcctcacccaattctttgcccaagccaaaatggaaagaactttagggggcctagggtgggggagtacacgttcacgagcttgcaagaaggaacactcgagggaagtgtggacggggaaccacgctgtgtagaagagttataacccagggggggcagcacaggccctgggtccaggtggtggagggtaggccgacccgaggagcgggagggcggcacaataaagagggcctaacggaggcatcggaagaagatcccagcaggggaaggggccaggaagagggagagggctaaacttttcccagaaatgggtgaaactccggggcccggggaaagctcaggggggcacacagcgaggtttgtccagggtgtcctggaagagctcagaagttcggggggggggcacgaccttgttgtggacagagctccactctaaggagggcaagggggcagggaaaaagcccaaaagttcggggggcgcgaccttgttggggaccaaggcctcccccggggggggaaagggcttggcgcggcaacacaaaaagaattccgggagaaaggagcctaatacgaaggggaccgggttagtgaaaacaccgtgtcaccacgggaagccgctgta

SEQ ID NO: 657262 - DNA, 219 bp, Homo sapiens
cctgcgaggactgatcatgctatttccccctctattgatccccacctccaaatatctcatcaagaaccgagtaatcagcacgcaacactgactaatcaaactaacctcaaaacgaaatgataaccatacacaacactataggacgaacctgatctcttatactagtatccttgatcattgtaattgccacaactaacctcctcggcagggacccactcg

SEQ ID NO: 657263 - DNA, 137 bp, Homo sapiens
gagagaagctttctggcttgaaagaagatataacccaagagtttccgggaaaagccaagctttgttccaggtgactcagtggctaacctcgttagaaactcctgaagaggaggagtcagaggaggacgctcactaaa

SEQ ID NO: 657264 - DNA, 81 bp, Homo sapiens
tgctggtgcaatacaactaggcttaatagggactcgaattcgagattcaagcttctaacgttagaagctctgaattcgagc

SEQ ID NO: 657265 - DNA, 950 bp, Homo sapiens
acagaacctgtgttagtttcacctataatggccgtgcgggtaatgacaatgtctgcgtaactggaagtacttgcactcgtgcatgctcagggctttgatgacagatatacgaaggatgccacggcttctatttgcctaatgacatccgcctcatgcgaagggacgccatttgccatctatgtctcctaatattgtcatctttgcttggtgtctctgcacttggtggtatatattgcctggtattggtagtattctgtcttaattaatctgaccgcgtgaggcctagcgaaatcatcgggagatttataccccccagaaatctattaattcactatatggtcatcttgttctcactaacttgtggcagtatatgtttatgatgattactcacctagcctgactatgtcaaaatggtggagtctaccgattttggaagtagtatggctgtcagaactgttgtgttgtagacatgccatttcttgacagagccatatagtatcttacggagcactgtatgcaggtcactgccttttctggggtcgtcggtgatccctggaatctactgatatgaccgtgctcattgactggaccacaccacatatacgaccactaataaatctattgttgctattggaccgttagttgatcagtagctggaggatctacgcaatactaaaacacctcttattttgccctttgatggatgtgggatgcattatggaagctccctacgatgaccatgatcggcggattagctagcacttgaataggtatttactccctttctcattgttggttagactggcgtacatgaagtgcaatacggggatgatttaacacaactcaactcttgctgatttagaacctaatcactttttgaagccgaaatgtctctcggggacacgcacttcggctttgttttgcaccccctccgttatttggtgtcacac

SEQ ID NO: 657266 - DNA, 410 bp, Homo sapiens
taattactagtcccaatttgagctcaatattaccaacaattgctttatagttacttatgagtcaggttcaacattttatgctgattttacttgcacttaaacaaatagaaagtatattttctgggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaa

SEQ ID NO: 657267 - DNA, 513 bp, Homo sapiens
actccacagtttaactcaaggtatcttgtaaaattaaaatattatcagaaaaaaagaggagtgttccttaaagcaccagatcattatgatttctgaaggatcatctaacacaaagcgctgtattaatgatgcggaaaattctgctttaaatgccaggaatatttttaaaaataattttaacgcacattcaataaaatgataaaagagttttaaattaagtcagtaaatgcagccttggtgagcagaatagacttcttttaaaccatttaaagccttatcgatcccaaatccttttaatggtagtgtagactgtaaggaagttgaagccagaggctatggactgtcaatagcatttcaatctttgtaagatattactttttaatccaagttttcaatatttgcaaataaaaatgcaaaataaaatgcattttcttttgtaaatgttatttaatgatgtatttttctgtctataatctaatgtctgtacaacaataaaacatttcataagaccca

SEQ ID NO: 657268 - DNA, 324 bp, Homo sapiens
cagcacaaatatacaactgggtactgccagagaatgatcaatttccaagacaatatttcatatcacaaggatagctacaaaatgtgttatttactacctctacttttaacatactttgtgcacttctaaacatctagaaagactagatgtttcaaataaggacttaagtttgtccgctatatacacagtagggttgaataaactacacacatgtaacaatggttatatctgatagtgtcttctaattacgaacattctggtctagaacccttcattccttccaactcctctccaccaccaacctgatggcgtgaggtaggaggt

SEQ ID NO: 657269 - DNA, 491 bp, Homo sapiens
  misc_feature (293)..(293): n is a, c, g, or t
  misc_feature (301)..(301): n is a, c, g, or t
aagtttcaaagaaaaagctactactcagcaataaaaatacatgaaaccacacagatgacttgcagaaacatcatactgagtaaaagaacccagacagataaactggaatagtgtgtgattccatttacatgaagttcttttttaaaaatgcaaaattattatatactgacgacaaacaatgtatcaattgctgggtctggagtggagaggattgcctgtcaagggagtgaaaaatgttccctattcgactgtggtggcagttacacaggggcggacatgtgttaaaagtcatngacttacncacttaacatgggtgaattttactgtaggtaaattatatctcaattcaacaaggaccttctgagaaaaaagaaaaaatataagctaccctaaaaatacatctaacacaaaatctctgagatgtgtatggagaaaacttaaaactctacacaccattaaagaagatataaataaagtgaaaggaggtctta

SEQ ID NO: 657270 - DNA, 682 bp, Homo sapiens
ggtttttttgtatgtattccttgttttcatattgatagcatctaattcttttgacaatcttaatatgtagattcatttaaattttaagacagttcagtgcatatataggtagaagccttaagaaaaaaaaaaatgagcaagcaaaatatttgaagaaatgtaataaaaccatagatttctttcagaaaaaaaaaacgggcattaggaacagttttctctctcatatatttatgattactgacataataggaaagtgggtattaattcagtatccgtcattatgcagtattttaatacctacataagtctatcccattattatatttgggcgctgggcaatatttatccctttatggcttttaatcactaacattttttaccttaagagtttaaaaactatgctaaataaatggtactggtatattggaatatgtttgccattttttgaagaacaagctgcgttatcccattttattccaggttacataaaattcctgaaattcctattaagtttttcaacacacttggtgtacaattcccacgtttaaatgtgacagtgttatggatattttaaggctggaccattattttcttatagaccctaaaattaaggttgtgttaattttccagggtgcatcttttcaacacgcttttgtaattggcattgggttttccaatgctt

SEQ ID NO: 657271 - DNA, 455 bp, Homo sapiens
aacctgtctcattaccttgagtcacaggaatgagatgtgtgagatttccgtatgattgtggaacgctactggctttttagaagacgcctcaggcgactgactatcatttcttgaaaatcttaaatttaggccaggcagccaggcccggtggttcacgcctggaatcccagcactgtgggaggcttgcgccggcggatcacttggggtcaggagtcccagactacctgggtaacagtgtgaaaccctgacttactgaaaagacaaaatttgctgactgtgctgcaacacgcctgtgatcccagctactgaggaggctgatgccggagaatggcttgcacccaggaggcagaggttgtcgtgaacccgcattgaccactgcacttcatcctgggtgacataccgagactctgtctcaaaaaaatgattgccggcctactcacagtagtctctccctc

SEQ ID NO: 657272 - DNA, 103 bp, Homo sapiens
cgcaaggatctgtgggctccgtcttcacacaggctggagtgcatcccagaggttagggtttgggtgcacagtcttcatacaggtctgtagtgcacccctagga

SEQ ID NO: 657273 - DNA, 224 bp, Homo sapiens
ccgtgttgtactgccaccgcgatgccgaaggcgcccagcagcagccgccggagcccgagtggatcggggacggagagagcacgagcccatcagacacagtggtgaagaaagggacagaaggacagaagatcaagaagacgttcttggaagagctggcagtagaacataaacaggctggggaagaagagaaagtgctcaaggagaaggagcagcagcagcagcga

SEQ ID NO: 657274 - DNA, 260 bp, Homo sapiens
agatgtatgacatgagcagcctcaactcacacagatgcttcacctcctagcaccgcaacagcccctgttgacgaatctacaacctaccaccgcagcccaggctcgactccaacaacacacttccctgccagactccacaacttgcgggccacagtagagaaatcaacaatattccacacgcagcccagtatgcaagatggaacaacacccatcatctgcccacatccacaaccatcagcgtcgtggaagaatccacaaca

SEQ ID NO: 657275 - DNA, 935 bp, Homo sapiens
  misc_feature (222)..(222): n is a, c, g, or t
gctgtatgctgacagcgtgtctcccctgtttgcggcctctgtcccgttctggcgtatctccctctctgggcccccccctgtccatggataccactgccgagtaattcggggcagccgcaaacttttgggaaaacatggtgcaccgcttaggtgtggaactggcaatccccatggacgggcttcacaagcctaccaatcctgggcccctgcagactctggttncccaccgcgtgcagccggtgtcttaattttcccaatccgggcccacaataaagtcggccacaccagaaatttgccttcgtttggccgggaatgtggtctccgcccgcttccccaagcggcaatggggttcgtccggctggcccacccccgagggttttccccgcggcggtccttctcccctgcaaaagaacaatggggcccacccgaacacccacgggcggacatttaaatgttttcccactcataaaatgggaaaaatatcacaaagggaggggcagaccaatgtgtgtgtgcgcgcaaaaaggcccaaccatgatgggtgtcgcgtccacaggtgtgcatgcctcttttttccaggagcagagtgcaagatccgtgagacatctcttgtccacaacaagaaacgaccagccccacatatgtgtacacccccatgcttcttcctaaaaaaaagacattaaatacaataaataaatcaaacatggggatctctataaagcatttaatgtttactatatcggcacccactatatcatacctattctcttaattgaagatccacttttaaataacattaatctttgaagaactactagttcaaacaaacactctgtggggttttcttatacaccccaataccaccacgcttactctggcccccaaaaaatacaaactctttccaattcgtcccttaacccaacaaaccacaaaac

SEQ ID NO: 657276 - DNA, 919 bp, Homo sapiens
  misc_feature (23)..(23): n is a, c, g, or t
  misc_feature (589)..(590): n is a, c, g, or t
  misc_feature (645)..(645): n is a, c, g, or t
  misc_feature (650)..(650): n is a, c, g, or t
  misc_feature (709)..(709): n is a, c, g, or t
  misc_feature (821)..(821): n is a, c, g, or t
cctccatggacactagatctttntcttcagactacacccacctcccagaatgccaaaacccctgggactcagagcctccgatgtaccacaccattgagcgttccaaaagtagccgctacctagccaccacaccctttcttctagaagaggctcccattgtgaaatctcatagctttatgttttccccctcaaggagctattatgccaactttggggtgcctgtaaaaacagcagaatacacaagtattacagactgtattgacacaaggtgtgtcaatgcccctcaagcaattgcggacagagctgccttccctggaggtcttggagacaaagtggaggacttaacttgctgccatccagagcgagaagcagaactgagtcaccccagctctgacagtgaggagaatgaggccaaaggccgcagagccaccattgcaatatcctcccaggagggtgataactcagagagaaccctgtccaacaacatcactgggtccaagatagagcgcgcaacagctactcggagaggagccagtgcgcatatgacacaccagaagagcctctcatcagtgccaaatcgcgcgcgagnngacacagcaggcctgcaaaatcctttcagagaagcaagtcctccaagcctgaggnccgangggacaggcctgtcatgaagagactgtcacgacaatggcctttcaaagctttgaagcangcccacctaaccttctaatatcggccaggaaggctcagattcaggccttaaatctctcaactccagtctttcctcttctgaacaatctgctaatctaactagcaaaaagcangcctggaaggtaactcaagggcttttggccacataagagccttgtgtgaccgggccaaccagggataagcggttcacttgcttgcaggagggagggct

SEQ ID NO: 657277 - DNA, 127 bp, Homo sapiens
aagaatatacatgaacggacggtctcagtgactgagcatgcatacatcacccggatgctggaccacagatagggatgggagcgttgtcagaagcggaagttcaggccctcctcagtgagcgacgagt

SEQ ID NO: 657278 - DNA, 925 bp, Homo sapiens
gctacggatgcaaatagtgtgggggatgccggtggctctgcccccagtatcctggacactcgtgatgccttgcagctggtgaatgagatcatcgataaggctggttacgcgtcattcatatcgttgctctggtatggcatgttgctgcctcatatgtcatatcgtgatggcaagattatgacgttgagacttcaatgtctcgccacatgctccttcccgcatgacatcactggggcagcagatgggggataatctatactaggactatgccagagagactatctctgtggtctcgcattgactggcaacccctttgaccaggatgattgagctgcttggctccaagttcagaggccattggtagggcatccaggatctggtgggctgcagtgacctgcccacggttgaccgatcccaatcatgtattgactcgggcatggtcgggaatcagggccgttgacttaacctgtctgtctgctcaagggtaggcctagattcggattcggtcagatgaagccattaccatagagtgcaggttgttccaggagaatggtgtggggtatggcgagttatcggtctggaaagactgaggattctttttgcatgacctgaggtgtgtatgggtccaggtcatatgtagacatgagggtccgggagtcggtgattgtgggataatttccgtctcattggctagtttcatgccgccactggagtgattcactttgccgtcgaagaactcacttttgggtcagccgcgggggctgagattggcatgtgcgagggggtgacatcgtggtgtccctgtgaggggggtaaatggaagacccatgaataccgaaccagggcaaacctgatgcggcgggctggacacatgggttttcctagcaaaggagggcctcttttccacaaaggagaaagggcaatg

SEQ ID NO: 657279 - DNA, 315 bp, Homo sapiens
ggggctcccccctttgccccgggtgaagggcaggggggcaattttagctccctgcacccttgcccttttagggggaaagggtcctttcttttcagcctccccgggaggtggggatacagggggatgcccccccgcccgactaatttggggtttttttgtaaaaaagaggtttcccccatttgggcagggggggtttcaaactcctggggtcaagggttttgcccccccccctttttcaaaaatggacaataattttacccgggtgcctgaaaaaaactttttttaatccttttagtaataattttgggccaggga

SEQ ID NO: 657280 - DNA, 968 bp, Homo sapiens
  misc_feature (285)..(285): n is a, c, g, or t
  misc_feature (557)..(557): n is a, c, g, or t
  misc_feature (624)..(624): n is a, c, g, or t
  misc_feature (766)..(766): n is a, c, g, or t
  misc_feature (790)..(791): n is a, c, g, or t
  misc_feature (821)..(821): n is a, c, g, or t
  misc_feature (861)..(861): n is a, c, g, or t
  misc_feature (863)..(863): n is a, c, g, or t
  misc_feature (866)..(866): n is a, c, g, or t
  misc_feature (946)..(946): n is a, c, g, or t
ggacaagggtcaccatggcaacagtaccacgccagcggacgggagtaacaggggacgtctctactgcatttccaccgcttcaggtcgcttctctgggagtcacccccttcaccttatgtgctctgtgcatgagccgctgtcgtgctgccaccggcgtacggatgtactacgaaatgatcgaaaactgctcctgaacaactgccaaacttcgctgttatatggagtgggagctgttttgttaccactttcagaagttgttccccgcctgctgagcaatgaggattnagggtatactggcccgagcccccggcatacaggtgcactcttaagaccgctgctgatatatcgggcacgatgcatggcctagtccttagcctaccagagtggcagattcgtggggagagttaggttggttcttttcggtggcccagtcatgttccccatccccttactatctacgatgtctgcgtatgcaaaacgccccgacctgacaaaaagcctggacgctcgggagagagaacggcgcgtcacatgtcgcaaggcagaagattttgtgncatgatggggcctcgtccataattctcgagggtctatagaaaataactccacaaaaaaagggcgacnttaggacccgggctgatagcgcccatgtgggggtcacagggccgcacatgagcacattctgaaacaagtgaacgcgtacgttctttgcgtatcttctatgcgatagcacacactccagtcctcgctgtgttgcagtacctcnacacttccgcctcgggccgcagtnnccagaagagggatcactattcgtccggccnaacgctgctccttaagtccacgatgagtgggagccttgtncnccntgcacctatactagcacagctgtaacaggcatcacttccacgctacttccttatgccgataaacggacgctttcggtttnacgtgtgagggaacgagcagag

SEQ ID NO: 657281 - DNA, 651 bp, Homo sapiens
tgccgccttgggggacgctccggatcctgtgccttggctgcggtcagcggggagcccgggcctgctgtcggggatgggggctgtttcctacacgcagggccagagtccggagccgcggacccgcgagtatttctactactgtggaccaaccatgggcccaagctttccctggatgattccaaaagtgaagaaatttcatcacctggcttcaaagacccgcagattcctggatcaccgttcgttcatcaccgccttgagacccagaccgctagtggtgcgctacgaaggaccgcctttacccctttcacctctcgacccttgctggcaggagagccgcaagcttcctgtcgctgccgaggcaccggcacggtggatcttcacagcaccttgctgaaccgcggaccagggtgcctccgtcgcactctcctactgacggacggtggcagaaggccctggcacgtgccccataagaagcacaggagctgcaatggcatgccccctgagcccgggacaaaacgggggatgcccttgtagcgaaacacggggaagccggagagcagttgccggagcaggacgatgtggcccattggttgcgcttcacggcacctgggaccatagggaagcatacagagccattggttacgaagtaag

SEQ ID NO: 657282 - DNA, 214 bp, Homo sapiens
atagattcttacacattaaaaaagcatttatcttggctaaaaatgaaacgacttttcaatgatcaacacatggtttaaatctgcttgctaatttatatctatccacaagtctgtctagctgttcagctaccaggaaattcaattatgttctgtaaacctttgttgaacacctactatgtgcctgtggcacatttgtgaattgcataaacagaaa

SEQ ID NO: 657283 - DNA, 117 bp, Homo sapiens
acctcccctgcgccatgtatgtcttggccttggacaggaaggggttgtggagatcttttctggggagttgctggattgcagagaaggaacactgctgcccaggagaccaaacctcag

SEQ ID NO: 657284 - DNA, 925 bp, Homo sapiens
  misc_feature (2)..(2): n is a, c, g, or t
  misc_feature (91)..(91): n is a, c, g, or t
  misc_feature (95)..(96): n is a, c, g, or t
  misc_feature (103)..(103): n is a, c, g, or t
  misc_feature (105)..(105): n is a, c, g, or t
  misc_feature (130)..(130): n is a, c, g, or t
  misc_feature (144)..(144): n is a, c, g, or t
  misc_feature (147)..(147): n is a, c, g, or t
  misc_feature (155)..(155): n is a, c, g, or t
  misc_feature (160)..(160): n is a, c, g, or t
  misc_feature (165)..(165): n is a, c, g, or t
  misc_feature (167)..(168): n is a, c, g, or t
  misc_feature (174)..(174): n is a, c, g, or t
  misc_feature (202)..(202): n is a, c, g, or t
  misc_feature (216)..(216): n is a, c, g, or t
  misc_feature (225)..(225): n is a, c, g, or t
  misc_feature (231)..(231): n is a, c, g, or t
  misc_feature (255)..(255): n is a, c, g, or t
  misc_feature (259)..(262): n is a, c, g, or t
  misc_feature (264)..(264): n is a, c, g, or t
  misc_feature (268)..(268): n is a, c, g, or t
  misc_feature (279)..(279): n is a, c, g, or t
  misc_feature (287)..(289): n is a, c, g, or t
  misc_feature (299)..(299): n is a, c, g, or t
  misc_feature (303)..(303): n is a, c, g, or t
  misc_feature (308)..(309): n is a, c, g, or t
  misc_feature (313)..(313): n is a, c, g, or t
  misc_feature (319)..(319): n is a, c, g, or t
  misc_feature (323)..(323): n is a, c, g, or t
  misc_feature (326)..(326): n is a, c, g, or t
  misc_feature (333)..(333): n is a, c, g, or t
  misc_feature (347)..(349): n is a, c, g, or t
  misc_feature (359)..(359): n is a, c, g, or t
  misc_feature (364)..(364): n is a, c, g, or t
  misc_feature (367)..(367): n is a, c, g, or t
  misc_feature (374)..(374): n is a, c, g, or t
  misc_feature (378)..(378): n is a, c, g, or t
  misc_feature (392)..(392): n is a, c, g, or t
  misc_feature (407)..(409): n is a, c, g, or t
  misc_feature (412)..(412): n is a, c, g, or t
  misc_feature (446)..(446): n is a, c, g, or t
  misc_feature (455)..(455): n is a, c, g, or t
  misc_feature (490)..(491): n is a, c, g, or t
  misc_feature (527)..(527): n is a, c, g, or t
  misc_feature (608)..(608): n is a, c, g, or t
  misc_feature (917)..(917): n is a, c, g, or t
tngttaaaaatttagatatcaaaagggtatttcgtgaagaaaaacagaacagtatcagagcatcaaagaggaggaaacactactagtttcntttnnccaaaananttaaacttttatggtttagtggttnaacactagcttcgnttnttagaggnttatntaaananntttctnttggtgttagcaccaaacaaggccattngtatttctggcatnttttgcttngctganagttttagttggttttccaaggtntttnnnntntttnttttttgtttnttattgtnnnttttcacacnttcngttgnntttntagctnggtntgnttttttntttttttggttttnnntatgtttttnggaanttnttatgtntttngggttggttttttntttagcagcgtccannnggngggggtcttgtggccggcagcgtacaatcatcanaggttcttnattgttggtgcagaccctggagcaccagtttattnngcagcccctggtagacctatgggtcctccatattcntgctgagtgttagcttaacctcactgagcaaatctgagatgaggtcatttcgggctctcaggactttcagcctcgcctgantcctcatggtggacatcaggattttcttctgctgctctatctgcttctcctttttctcataatactccataatcttcagtcgttgggtttgcacgaggcgtcctttctcaatgttaaactcttcctcagccttggcatcgatttcctctgctttctcattggcttcctgctcaatgaaagccatcatgtgcttaatctgctttttcacatcgacatcactcagggccatggctgctctcagaggggacggcagagagggagctcgtacaccgtttggctcctttgacttaggacaatttcaggagtgtntctggagt

SEQ ID NO: 657285 - DNA, 259 bp, Homo sapiens
gctcatggtaccagaccaagtcacggggttggtctgttccaaagtaagccttacagggctgcatcggcccaggggacgggctcttttgtttaattctcatgcccattgagcacctctacagttttcaaaaaggtatgccataaattgcctacttattgctgtctgcctatttgtgagaggcaccctatctggcttacggcatcacaaagagcatactttttgtactctgtactggctgatgattgaccagaaggtgcct

SEQ ID NO: 657286 - DNA, 944 bp, Homo sapiens
  misc_feature (1)..(1): n is a, c, g, or t
  misc_feature (314)..(314): n is a, c, g, or t
  misc_feature (324)..(324): n is a, c, g, or t
  misc_feature (332)..(332): n is a, c, g, or t
  misc_feature (346)..(346): n is a, c, g, or t
  misc_feature (353)..(356): n is a, c, g, or t
  misc_feature (358)..(360): n is a, c, g, or t
  misc_feature (365)..(368): n is a, c, g, or t
  misc_feature (370)..(370): n is a, c, g, or t
  misc_feature (375)..(375): n is a, c, g, or t
  misc_feature (378)..(378): n is a, c, g, or t
  misc_feature (399)..(400): n is a, c, g, or t
  misc_feature (405)..(405): n is a, c, g, or t
  misc_feature (407)..(407): n is a, c, g, or t
  misc_feature (413)..(413): n is a, c, g, or t
  misc_feature (416)..(416): n is a, c, g, or t
  misc_feature (418)..(418): n is a, c, g, or t
  misc_feature (422)..(423): n is a, c, g, or t
  misc_feature (428)..(428): n is a, c, g, or t
  misc_feature (444)..(444): n is a, c, g, or t
  misc_feature (446)..(446): n is a, c, g, or t
  misc_feature (473)..(473): n is a, c, g, or t
  misc_feature (509)..(509): n is a, c, g, or t
  misc_feature (588)..(588): n is a, c, g, or t
  misc_feature (595)..(595): n is a, c, g, or t
  misc_feature (939)..(939): n is a, c, g, or t
ngggggatcctggagcccagggaatcgacctggagggccagtggagggagcggagggtgcgaggatcggctcctccgcagccggccctggaggggttcttgggggatcgcgccaggccaaaagtctgcatgggcggccccgagcctccctgagccggcgcgccccgggcgtggggagatgccgctctgggcgcggtgccgctgcgggcccgggtgcggcgctcgcccagggctaggtgccccgtctcaggcgagaccccaggagcccgccgcccccgctgtctcttcagccgacgtagacacgtcgggcgggancccagtctangcgtgttnaagctctgggtccncataagnnnngnnncctgnnnntngtgtnttnttttttttttttttttattgnnccatnantaagtngangnaganngtgtncccggcctgcagcggnangatgaggctgaagatgcccagggtgcncgggctgggctggctctcggccaccggcttattctncaggccctcaggctcgtagccaccggagtctacgcgggccacgccctggttggagcgggacagcacggcctccactttntcgtgcnggtgcccagtcagcaccgcgctcagcaagtagcgtccagccagtggcgctgtgaacacgcctgtctctggatcataatagcctccatcattgagcaggactctgtcgaaggggaccgtgcctggttcagaccggggcaaactcagagcagctgaaaatgccacttggggcacaggggctgctggtgccccctccactccctgttcaccttgaggacctggtggcccgatggggccctcttgcccgtccttgcctggtgatcctggaggtcagcaagggctgggggtcctgcagcccaggaggccctgggggccagcctctcctgcaggccagtgaggtcttcangctga

SEQ ID NO: 657287 - DNA, 1010 bp, Homo sapiens
tattcatgcttggcaacatttattggatggattttccccaattaaatatttctcatcatttcctcacatgattagtactggctagcggacctactaaaaattttaacactggactttattaattaagagatgggcttggctattttgccctaacaccattccaaagggagaactattagatggtctggttattaatattcaacgcaaaatgttgtgagacgaaataatttcagctatgtctcaggtgtctcgctgggctcttaagggtggcaatacagcggtgggtggtgtgagactggtctctggcagagatgttctctcataacgcagggtgggacgcattggggacaccacagggtctcacaggttttacctcttggaagagacactttggctggtcccggaggatcaaaccctttctgggtgggcatctccttcttggcttaaggggcacccatttgaggtgtgcccaacatttgaaagactttatatccattcaagggcctcgtgtactccatgtccgtcttcttagcaaataccaaacagccgatgtgagcagttaaaacctccccggggtatccatctggtcagtgatgccagatccccagggggccttctttacggcgcgtggtgtgtcacgatgtgtggccgtggccccttttctggggggtcaacccctatgagtatgatgtggaggcatcttctctcctggggcattcttgggtcagggggtcaggggccacgaggaacacccttcctataaatgagagttcctcgtgaacatcgcgacgacctggggcctccatagggaccgggtggccctcggaaggagagacaacgtctgcggcttgaagggccccacgttcgtagacgcggggcaccccgatggttgtgggcagtggaagatccccggtctttctcgggttctgcaaagggtccggggagctttgacgttgtccttctgcgacgggggcaccgtgtccggctttgtggtaccctgttgtgtgctc

SEQ ID NO: 657288 - DNA, 521 bp, Homo sapiens
tgagtagggagacagagggcagattcaggagaggaatagggtagtcacctgtgttgggagcaaatccttcctgtgattccaatgcacaacgtgtgagaaccactacttgctgataatagtcattctgtcctgtatttcatgcgacatttcatctcctatcctgatatttacatgtattcttccgtttccctcactgtagtgataaacaacatatcatttacctagatgtgccatttttttcttatgtaggtctgtgaaatatgaatcatttagtacatattttcttaagcacacatcaattttctccttatagtagttggaccgattatggacacggaataattttatactgtggctatgagagcatttaagagattattaggagaaagtattctattctagttacttcaagttttcttacttcaactatacttttagcaggacctatatcttatgaattttgcagtctatatgtatcacatgtgacaaagattcttaggactagcaccaaatgtggaata

SEQ ID NO: 657289 - DNA, 329 bp, Homo sapiens
  misc_feature (92)..(92): n is a, c, g, or t
  misc_feature (256)..(256): n is a, c, g, or t
gaagccattgaataccctattgaccataagaaaaaggcagggaaagttgttcaacggcaacccaggcactgaaggaaaaagaacatggagantgacaaaagcccagagggaggagtaaaaggacacaaacaccattctcagggaccaggactgggcgctgttctcagggaccaggactgggcactaatcacagaactgtaacaggcgccccatgggaatgaccaactgttagatggggcctgcagggcagcacctncctcctgcctcccaccaacagcttcttaaagggaaatgccgactcttttcacaccagtcccctcactgcggct

SEQ ID NO: 657290 - DNA, 543 bp, Homo sapiens
tacaaaaatacacaagcttatatgcattaacaatttacaccagttcacaaaaaaaaaaaaaaaaaaaaaaaaaaaaaaaaaaaaaaaaaaaaaaaaaaaaaggggggcgggcaaaaatcccccggggggcccatctccccccgtttttcttcttcgaaaagagggggcccccagagagggggggctcccatctataatcaaaccagccgaccagagcgcggcgccggcgttaaacaacacgcgcggggggagcggagaaaacaactcagcacaccaggcggactacttggggggaacggaccccacacctggcgggggggggaaacaaacagtggctgaacaccaccccccatgacagagaatactaacacacgccccgaggagaacaaaatacaacactctgcacacgacgtgcactagtggcgggtaaaccccaccgaccagcgattagaagacgccccggcgagaacaagcagttggcgcaccagcagagacttatcgttagaacaaactttatatccagggagtgacaaagagaaaaac

SEQ ID NO: 657291 - DNA, 193 bp, Homo sapiens
agaggcgaccaacctaccgatgctggtgatagctggatgtagaatatggaatcttagattcaactttcgatttgcccacatgaaccctctagctccccttgtagatttaactgttagtccaaagaggaacagctcttcggacactaggaaaaaaccttctagagagagtaaaaaattaacacacccatagtag

SEQ ID NO: 657292 - DNA, 315 bp, Homo sapiens
agcggagttgccagattaccagcatctgggttgctattccaaggctcattcagatgaaagacgcaagaagatcaagaagacgataacgagttctctctctttgaagttgctgtgcaggatgagtatatatcgagtcgatctcactcagtgcatctgtgctcatcgatgtgacaagctgtgcacagcgtattgtattagtaaatgagtcacagtgcgggctaatcgactaagatccgttgctccagtgataggtgacagtgtcgtaacgattttatgaggagacaatgctcgaagaaatttctagagaaaatctta

SEQ ID NO: 657293 - DNA, 289 bp, Homo sapiens
gcagtaagacatattttcatgtgggtggtcacgcaagaaatcaagtaacacaatgaggaattgctccccacgaagacttagacctgggacaaatgggtcgttaactttcatttttacatcttctctcaccacactaaacctcgaatggtcatccttagcaacctaaaagactatgcaactccaccactgaactggtatcttattccactgactgctcggacactctgcactcactacagaaaaaaataaacccagaccattttgcctagagcccttcaaccaccaaaca

SEQ ID NO: 657294 - DNA, 132 bp, Homo sapiens
gcgctggggcggtagctccgtggccggatgtgaggccttcccgcctggcccttgtgttagccgcctcgcggcagcgcgatctcccgcccttggtgctgcccccgggcggtacctgctctctcccagcgccac

SEQ ID NO: 657295 - DNA, 205 bp, Homo sapiens
cttcttatgcccaactcttctgctgtctgggacggcctgcggtggatcaggagtgagtctggacaccacacatataataaccaagagaagtgtgcattagacggcatcaaaacacatttaatgagacttcaactgtagctttccctggtatccagggagaataaaggcacacaaggcaaaataaagtaatggcgaaggctgatgg

SEQ ID NO: 657296 - DNA, 618 bp, Homo sapiens
  misc_feature (19)..(19): n is a, c, g, or t
  misc_feature (22)..(22): n is a, c, g, or t
  misc_feature (42)..(42): n is a, c, g, or t
  misc_feature (44)..(44): n is a, c, g, or t
  misc_feature (142)..(142): n is a, c, g, or t
  misc_feature (180)..(180): n is a, c, g, or t
  misc_feature (182)..(182): n is a, c, g, or t
  misc_feature (186)..(186): n is a, c, g, or t
  misc_feature (192)..(192): n is a, c, g, or t
  misc_feature (200)..(200): n is a, c, g, or t
  misc_feature (206)..(206): n is a, c, g, or t
  misc_feature (208)..(208): n is a, c, g, or t
  misc_feature (216)..(216): n is a, c, g, or t
  misc_feature (219)..(219): n is a, c, g, or t
  misc_feature (223)..(223): n is a, c, g, or t
  misc_feature (234)..(234): n is a, c, g, or t
  misc_feature (238)..(238): n is a, c, g, or t
  misc_feature (246)..(246): n is a, c, g, or t
  misc_feature (258)..(258): n is a, c, g, or t
  misc_feature (267)..(267): n is a, c, g, or t
  misc_feature (273)..(273): n is a, c, g, or t
  misc_feature (314)..(314): n is a, c, g, or t
  misc_feature (317)..(317): n is a, c, g, or t
  misc_feature (320)..(320): n is a, c, g, or t
  misc_feature (326)..(326): n is a, c, g, or t
  misc_feature (341)..(341): n is a, c, g, or t
  misc_feature (360)..(360): n is a, c, g, or t
  misc_feature (368)..(368): n is a, c, g, or t
  misc_feature (371)..(371): n is a, c, g, or t
  misc_feature (375)..(375): n is a, c, g, or t
  misc_feature (379)..(379): n is a, c, g, or t
  misc_feature (386)..(386): n is a, c, g, or t
  misc_feature (395)..(395): n is a, c, g, or t
  misc_feature (422)..(422): n is a, c, g, or t
  misc_feature (428)..(428): n is a, c, g, or t
  misc_feature (438)..(438): n is a, c, g, or t
  misc_feature (447)..(447): n is a, c, g, or t
  misc_feature (459)..(459): n is a, c, g, or t
  misc_feature (476)..(476): n is a, c, g, or t
  misc_feature (506)..(506): n is a, c, g, or t
  misc_feature (520)..(520): n is a, c, g, or t
  misc_feature (524)..(524): n is a, c, g, or t
  misc_feature (542)..(542): n is a, c, g, or t
  misc_feature (546)..(546): n is a, c, g, or t
  misc_feature (563)..(563): n is a, c, g, or t
tgcaagttttttgactttnatnaaatctttacaaaacagaananaaaattccggcattgacagtgggggtaaaggaaaacttctgagccccgtcagtccacctggtacattggaataaaagtgcttggatgtttttcccccnctttaaaaaaacttttgaggtttttttttttttttttntntttnaaaaanatcgtaanaataananagggccgnccnccgncccccagcgangggngcgggccnggggcccagggncccccaggntcttcnctcattcacagtaacggttctgaccagtcccccagggcgcncgnggntgcganagggggggggggggngggggaagtgactttcccncccctgcnggnccangggngtgggcnaggggttcnccggggcgcacccctgaacccaggggngccgcngggctggggnggcactaancctctgcttggngtaacggaccagccgcntggagaagaggtctttggcagccgcagganaggtgggcccagtncttntgggggaactcgttcttncccncctggatgccctaaaanagcatgttctggcaggcagggcaggcctcgccgcggtcccagccgcagttgctgc

SEQ ID NO: 657297 - DNA, 252 bp, Homo sapiens
aatatgtccacaacatcttcaacattcctccctccaaaagcaccagatctactggctggacataggggcttgtatctaatgaatacatgcagtggaggtgatggtagtgtgactacgttcctaaactgcatcatggcgttcctaccttgagtaccttttggactgactacgccctaggggcaagctaggctgccactgtcacactggccacctcaactacccggtgtgccgacgctcgcaacttcgtcactc

SEQ ID NO: 657298 - DNA, 878 bp, Homo sapiens
gatctaattagtcatctattgaagctagcttttacagagaaatatagatataaatattaaaaggaatccgtgtttaaaattatatgtaattactcgataacacgctttagctctgcataagcaatcaaaccaatgaaatgttgctgtcatctaaaagggtgtataacatacatcgcttttgatgagaataggccttagtgtatttattttatgtaggagacgtagtcgggtctgttagccccaggttgagtagggcagtggagcgatcttggtcagatgaaactctagcctcctgggattcaagagattgttccttgccttcgagccctcactcaagtagctgtggctatcacaggtcgtactaaccatcatgaccagttacatttatatggtcgtaccgagtagacgacctgggtttcaccatgtcgagtcaggctgttgcccaaagctcactgtggctcagggtgatccggctgcctctgtctcccaaagtgctgggattacaaggtgtgagaccagtcttgccaaatgcccttatgttagattgggaagtctcgattggatgatatatgtgttctcatcttcttagcatggactgggtggagactctgtgtggcccaatacatgttgctgtttcaagggattgaacaatgtctcagtctttaaatgacgtgtatacaaggtagttgactagttttgaaatatctgagtttattgggcaagttatttacccaactcagggtcgtgctacatggcatgggcaggtgaaatggcaacggttttctacattcattccctctatgggtaaagtggggggcaaattatatttttgacttaaacggtgctcgaatttatctccacaggaaggtgttttaaaa

SEQ ID NO: 657299 - DNA, 329 bp, Homo sapiens
  misc_feature (58)..(58): n is a, c, g, or t
  misc_feature (62)..(62): n is a, c, g, or t
  misc_feature (205)..(205): n is a, c, g, or t
  misc_feature (217)..(217): n is a, c, g, or t
  misc_feature (256)..(256): n is a, c, g, or t
  misc_feature (274)..(274): n is a, c, g, or t
  misc_feature (291)..(291): n is a, c, g, or t
aggagcgtaatgaggacgtactggggtgaggaacgttatgggatgaggaagtactggngttnactggtagtttcataaaattttttaaaaacaaattaaaggctgtacatgatttactttattgaacgaatcacaaacagtaatattaagaacatacaattaaactttatagtttatttcctactcactgtttagggatactttnatctattattgnaatatgactcttacaatttcaaggtccataggcaatatntttataggaatgatgtantaaacatatttgtgttncctagcactgcatctaaattcctacttgtcagccgtac

SEQ ID NO: 657300 - DNA, 680 bp, Homo sapiens
  misc_feature (1)..(1): n is a, c, g, or t
  misc_feature (104)..(104): n is a, c, g, or t
  misc_feature (109)..(109): n is a, c, g, or t
  misc_feature (117)..(117): n is a, c, g, or t
  misc_feature (119)..(119): n is a, c, g, or t
  misc_feature (123)..(123): n is a, c, g, or t
  misc_feature (125)..(125): n is a, c, g, or t
  misc_feature (127)..(127): n is a, c, g, or t
  misc_feature (131)..(131): n is a, c, g, or t
  misc_feature (133)..(133): n is a, c, g, or t
  misc_feature (146)..(148): n is a, c, g, or t
  misc_feature (151)..(151): n is a, c, g, or t
  misc_feature (158)..(158): n is a, c, g, or t
  misc_feature (178)..(179): n is a, c, g, or t
  misc_feature (188)..(188): n is a, c, g, or t
  misc_feature (192)..(192): n is a, c, g, or t
  misc_feature (198)..(198): n is a, c, g, or t
  misc_feature (202)..(202): n is a, c, g, or t
  misc_feature (209)..(209): n is a, c, g, or t
  misc_feature (219)..(219): n is a, c, g, or t
  misc_feature (229)..(229): n is a, c, g, or t
  misc_feature (233)..(233): n is a, c, g, or t
  misc_feature (239)..(239): n is a, c, g, or t
  misc_feature (241)..(241): n is a, c, g, or t
  misc_feature (244)..(244): n is a, c, g, or t
  misc_feature (249)..(249): n is a, c, g, or t
  misc_feature (253)..(253): n is a, c, g, or t
  misc_feature (268)..(268): n is a, c, g, or t
  misc_feature (273)..(273): n is a, c, g, or t
  misc_feature (275)..(275): n is a, c, g, or t
  misc_feature (278)..(278): n is a, c, g, or t
  misc_feature (280)..(280): n is a, c, g, or t
  misc_feature (283)..(283): n is a, c, g, or t
  misc_feature (293)..(293): n is a, c, g, or t
  misc_feature (300)..(300): n is a, c, g, or t
  misc_feature (302)..(302): n is a, c, g, or t
  misc_feature (334)..(335): n is a, c, g, or t
  misc_feature (345)..(345): n is a, c, g, or t
  misc_feature (354)..(354): n is a, c, g, or t
  misc_feature (386)..(386): n is a, c, g, or t
  misc_feature (437)..(437): n is a, c, g, or t
  misc_feature (469)..(469): n is a, c, g, or t
  misc_feature (481)..(481): n is a, c, g, or t
  misc_feature (484)..(484): n is a, c, g, or t
  misc_feature (493)..(493): n is a, c, g, or t
  misc_feature (501)..(501): n is a, c, g, or t
  misc_feature (607)..(607): n is a, c, g, or t
  misc_feature (617)..(618): n is a, c, g, or t
ncctttcatgtgaccccccattgggccttaatagccctcctgtttgaccgggctaataaaccccggggtcctctggaaaccatggtgcagtgtgcacacagacnaaccntattctcngnatantntncaancnttaaccatgtgannntcnagaaagntctttagcctgctctctaannactccgggntcancaaatnaacntgtaaanagtctgtggnctctcttggncttngttttnanatntattntggncccaggcttgtctgntaaanancanantgncaaatgtgtncaggcgncnctccatatcagaacatcattgtgtggaccttnnaggcggattntgagtttgnattgctggcatctgctctccctctccctgcantgattctcgggttcttgacctgagcagggtctcaccactgagacacagccntggagggtgggcttacatgaaaacatggccgnatggggagtggncgncagaggagnccagaggncaatatccagagactcccagtttagctgcatgcagagacctgttgtttgtatatttttgctttctaaaagaaatgctagagatagctgggcccagtggcatgtacntatagtctcnnctactcaggagttcaagtccagcctgggcaacatattgagaccccgtctctaaaaaaatcac

SEQ ID NO: 657301 - DNA, 569 bp, Homo sapiens
ggattcgccacgagccagctttgagatagcggcacaatgctgagtagatcagaaaagcaccttttaatagtcagttgagtagcacagagaacaggctaggggcaaataagattgggaggggaaatcaccgcatagtctctgaagtttgcatttgacaccaatgggggttttggttccacttcaaggtcactcaggaatccagttcttcacgttagctgtaacagttagctaaaatgcacagaaaacatacttgaagctgtatatatgtgtgtgaacgtgtctctgtgtgagcatgtgtgtgtgtgtgtgtgtgtgtgtgtgtgtgtgtgtgtgtgtacatgcctgtctgtcccattgtccacagtatatttaaaacctttggggaaaaatcttgggcaaatttgtagctgtaactagagagtcatgttgctttgttgctagtatgtatgtttaaattatttttatacaccgcccttccttacctttctttacataattgaaattggtatccggaccacttcttgggaaaaaaattacaaaataaacttttatagaaaaagtaaaaaaaa

SEQ ID NO: 657302 - DNA, 705 bp, Homo sapiens
taggagctgctaaaatgcctggattacctcggtgccgatcagcggatgaccacagaggatgagaaggacgacaagcccatccgatgctctgtgctgagtggggatattcgccttgcttgaaaaccttatggtcagcagcacttactctagagctggatcaagcaagttagaaggatgacattcacgcgaaacattcgtcaagaagaatttaatagaagctcactgggtattaacacgaaatctgacactggcctggtccccgaccagcactctgggcatttggctgccatggatagcagtacgactccagaggtgaacacgcgctttacaagagttgccagggtgtaccatagcatgagtcagatgctgattcgtgaggacccaataatacattattcatagcgtaagatgcaggtcttgccgagagttttgatggtggagcctgtagttggatcagcgtggcagcctactagacacttgaatgcacaggcatgacgagtggagcgtgcgagtatgaatactaacatatcaagattccacgattccattgggcctcctgaagattgacccaacagttaccatgattgacgagtgggagagaagctgatgtcgcatacagtgatgttggctggctgtcaggaaccgattgaagaaactgcggagaagtactttgaacccatttacttcatccagagagggttggga

SEQ ID NO: 657303 - DNA, 165 bp, Homo sapiens
gaaaaaagacagctaggaaacaaaagctaagggcaaatgtacaacttagaagaaaattggaagatagaaacaagatagaaaatgaaaatattgtccagagtttcagattagaaaaatgaaaaacaatgcttaggacaaagtattgggagaagttataggaagata

SEQ ID NO: 657304 - DNA, 668 bp, Homo sapiens
  misc_feature (92)..(92): n is a, c, g, or t
  misc_feature (97)..(97): n is a, c, g, or t
  misc_feature (105)..(105): n is a, c, g, or t
  misc_feature (107)..(107): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (119)..(119): n is a, c, g, or t
  misc_feature (121)..(121): n is a, c, g, or t
  misc_feature (134)..(136): n is a, c, g, or t
  misc_feature (139)..(139): n is a, c, g, or t
  misc_feature (146)..(146): n is a, c, g, or t
  misc_feature (166)..(167): n is a, c, g, or t
  misc_feature (176)..(176): n is a, c, g, or t
  misc_feature (180)..(180): n is a, c, g, or t
  misc_feature (186)..(186): n is a, c, g, or t
  misc_feature (190)..(190): n is a, c, g, or t
  misc_feature (197)..(197): n is a, c, g, or t
  misc_feature (207)..(207): n is a, c, g, or t
  misc_feature (217)..(217): n is a, c, g, or t
  misc_feature (221)..(221): n is a, c, g, or t
  misc_feature (227)..(227): n is a, c, g, or t
  misc_feature (229)..(229): n is a, c, g, or t
  misc_feature (232)..(232): n is a, c, g, or t
  misc_feature (237)..(237): n is a, c, g, or t
  misc_feature (241)..(241): n is a, c, g, or t
  misc_feature (256)..(256): n is a, c, g, or t
  misc_feature (261)..(261): n is a, c, g, or t
  misc_feature (263)..(263): n is a, c, g, or t
  misc_feature (266)..(266): n is a, c, g, or t
  misc_feature (268)..(268): n is a, c, g, or t
  misc_feature (271)..(271): n is a, c, g, or t
  misc_feature (281)..(281): n is a, c, g, or t
  misc_feature (288)..(288): n is a, c, g, or t
  misc_feature (290)..(290): n is a, c, g, or t
  misc_feature (322)..(323): n is a, c, g, or t
  misc_feature (333)..(333): n is a, c, g, or t
  misc_feature (342)..(342): n is a, c, g, or t
  misc_feature (374)..(374): n is a, c, g, or t
  misc_feature (425)..(425): n is a, c, g, or t
  misc_feature (457)..(457): n is a, c, g, or t
  misc_feature (469)..(469): n is a, c, g, or t
  misc_feature (472)..(472): n is a, c, g, or t
  misc_feature (481)..(481): n is a, c, g, or t
  misc_feature (489)..(489): n is a, c, g, or t
  misc_feature (595)..(595): n is a, c, g, or t
  misc_feature (605)..(606): n is a, c, g, or t
tgtaagccttccctgggcccaaaaaatcttctggtggaccagcctatccaaaccgggggtctttggaaaccagtggccgggtcccacagacnaaccntattctcngnatantntncaancnttaaccatgtgannntcnagaaagntctttagcctgctctctaannactccgggntcancaaatnaacntgtaaanagtctgtggnctctcttggncttngttttnanatntattntggncccaggcttgtctgntaaanancanantgncaaatgtgtncaggcgncnctccatatcagaacatcattgtgtggaccttnnaggcggattntgagtttgnattgctggcatctgctctccctctccctgcantgattctcgggttcttgacctgagcagggtctcaccactgagacacagccntggagggtgggcttacatgaaaacatggccgnatggggagtggncgncagaggagnccagaggncaatatccagagactcccagtttagctgcatgcagagacctgttgtttgtatatttttgctttctaaaagaaatgctagagatagctgggcccagtggcatgtacntatagtctcnnctactcaggagttcaagtccagcctgggcaacatattgagaccccgtctctaaaaaaatcac

SEQ ID NO: 657305 - DNA, 1203 bp, Homo sapiens
gtgcgcgctgtcatggctgctttgagacagccccaggtcgctggagctgctggcctgaggccctggctgagccttcctgggatggagttcgtgtggcctgatgcccagagcatggcctgtgtcatgctgcctgtgtgcctgtgtcaacctcatctgtgggaacacactggactacaaccagtggcctggtgctgcctatgtgctctgtgagctcatgacggtgctggtgggcagaccccgcaaggatgggctggtgtctctcctcaaccacctctgagggtgccgatgagccccagcggctgcagtttccaatgcaccacaagcaccagcgctcgcatggagacctgggactccatcggtgggccaactatgtcaaggcgagtgattcagtactacccaagctgcccccctccctggcttcagtagcagtggttgtgtcagactcaggtgcccactgaggagagaagatggactgtccacggctcaggatccttgggcaagtggacacgatacaaccttcctacagacacgctacagtccagagctcggagcaccaatagactagcccgcgacccaggtgatgtcacacgctaggaccggaacaccacacagcattcgacaagggaatgccctgatgagcaattccatggacccacgagcattctgactgactgggacaggacacagcgccacgcgcattgatcaatatgacgtgatgcggtccttggcagacacgcactaggggatgggaaacacacagagaaaccgccagacgccatgggcccgatgagcccagcaagaaacgcgacgaagtggtcgcgcacaacacccatgagcccccacgcgaacgttccccgtgcgacgagaggagacccactgaggaaggccaggtgcaccgggcggagtgcacagcgagaagcccacggggaaggaacaagggggcacgcgtaacaggccggcgaggcaaacccaggaatgcgccaacgaggggatgccgcgcggaacgcgagcacacgtcgggggacgaaacagggcgcgagaacctaacagcgacatacgggacgcagcgaggccccgcaaaagcaccaactccgcaccgcgaccgaagcagccgccaacgaacaagagtcagccaacacaaacgacgagacacaaagcacctgaacgaccacgcaagtgcaagcacgcacaacaagaccagac

SEQ ID NO: 657306 - DNA, 261 bp, Homo sapiens
ttagaggataaggtcatttcagttcctcagagcacttatattgcattttttaaacatcttgtctatgtatgcttgtaatttttgtttgattttaacttgctgcacttctcatgacttagcaaaaaaaaaaaaaaaatagggggggaattgtgtgatgacacgggcctttaatatcatacatttcggcatgtaatgggctaaataaattttgagaatactggataaacccctgagggtatcatggatagaccggaaatggag

SEQ ID NO: 657307 - DNA, 329 bp, Homo sapiens
  misc_feature (21)..(21): n is a, c, g, or t
  misc_feature (166)..(166): n is a, c, g, or t
gtcactgccagcgcagactcngtctcaaaaacaaaaacaaaataaagagaaatgtaagttaaaaagtactgagaaagggtttagtttttaatgtttaaaactctttaacgctctgcactcgatatggtaggaaaaaagatctttccggggccgggagcggtggctnacgcctgtaatcccagtactttgggaggccaaggcgggcggatcacgaggtcaggagatcaggaccatcctggctaacaatgtgaaacctcgtctctactaaaaacacaaaaaactagccaggttgtggtggcgggctcctcggggctccccttgctcagctg

SEQ ID NO: 657308 - DNA, 212 bp, Homo sapiens
tccagtacccgagcatgcatgcatgcgtgcagggtcgacgtgtatacaccactgcggtgcatgcctccctgaacaagtaccggcgacacgtgagcaccgtgctgacctccaaatatcgttaagctggagcctggtcgacgtgtattcaacattgcggtgcatgtctccctgtacaagttccgtcgacacgtgaacaccgtgctgcactccaa

SEQ ID NO: 657309 - DNA, 185 bp, Homo sapiens
ctagaggatcccgggcagaggcttgggaagaggagggtggaggctgagcgttatctaggttcccctaacttcaggtactgcagacgagcctccagttctggcttccgaattgatgtcccatatagagtttccaagtctgagaacattggcttgacgccttaattgatgtccaccaatctctcgga

SEQ ID NO: 657310 - DNA, 229 bp, Homo sapiens
  misc_feature (162)..(162): n is a, c, g, or t
  misc_feature (174)..(174): n is a, c, g, or t
  misc_feature (197)..(197): n is a, c, g, or t
  misc_feature (209)..(209): n is a, c, g, or t
tgttttcagacggagttttgctcttgttgcccaggctggagtgcagtggcatgatctcggctcactgcaacttctgcctcccaggttcaagcgattctcctgcctcagctacttgggttgctgaggcatgagaatagcttgaacctgggaggtggaagttgnagttagccgagntcatgagatcgtgccattgcacnccaggctgggcnacaagacaaaactctgtctc

SEQ ID NO: 657311 - DNA, 359 bp, Homo sapiens
cggtccagtctgtttacacaactggtaggtgtggacatatggaacatcacacccttaactaagaatgcaaaccttggcctgcacttagcacacaaagcaacttaccaagttttatcttaaagttaaaaattgctaggagttaattaaaactactagaaatagatttacatgcagggtgtgtaagaacagtaaaatgttttttttagtaaaaggttataagaaggcttggaaatgtaaacttttgcctagggttaaagaattgttttgagttaaattaggaaaaagctgaaggttcaaagaagtggtgaaagaactgtggaaattaatctttcagaagaggttctttgtgtaaactgatt

SEQ ID NO: 657312 - DNA, 887 bp, Homo sapiens
gggacatgctgagctggagccgcggtccggacggcagctgcgtgccccgagctctcctgcctcccccctgcccgccaagccgaggcagctcgagcccagtcacgctggcccaagcagcagcgccgagagcatgccccagtagcagcgccattggccgggtgagaacgcctacatcgacaacctcatggcggacgggacctgtcaaggacgcggccatcgtgggcctacccacaggacactcagcccatccagatcttggagccggcagatccccggggaaaaaacgttacagttcaacaattcacgcccaagattgagagctgagttgtccctgggtatgacaaacagacccgtgttccaacgtctcattataacggttgacattgtggcatgcccaccctatgggcggtgccctagcacaacgtgatccacggtggactcccgtgggaccatcaacatggactgcacgacacttgcggcggcaacttcaagaccattggcgatacttatcagtataacccatcagagaagtgcaacccacgagttgataggctccccaccagcacgttctcacaagtggccaatctttgtatccaacctcaggtactttgtacagacgtgacggccatagcccgcgtggccttcagatagcgcccaaaaacagacaggctttgttccacctcgtgtatgcggctaaatggatatcaaacaaagtgaacactgggcatttatgacaaaactttgggccctatccccaagcacttttctggagcagttattaccacaaaggtatagcattgagccctttagatatcgtagcacacccttttcaccacatttcaacacccggcattccgctcagtcaggtcttattgcagcacgcaatc

SEQ ID NO: 657313 - DNA, 870 bp, Homo sapiens
  misc_feature (6)..(6): n is a, c, g, or t
ggctcngctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacatttttgaccaaccgcagcaatgcacagagacaggatattgccttcgcctaccagagaaggaccaaaaaggaacttgcatcagcactgaagtcagccttatctgggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaggaaggaggtcccaggggctcagatccttgacggcgggcgtgcccacttccaaagttttgaagggcaaagtgcagcctttgacgtggaaagattcgccacgggtaacgggacggaaggtctggcagttgggcttaaaaacccctttgtgaccgtttcacacaaggggggcaagcgacacaagacccaaaga

SEQ ID NO: 657314 - DNA, 254 bp, Homo sapiens
tgactctgaggatcccgtctagaaataaaacaactgctaccacagaaatacaaaagatcattcaaggctaccctgaaaatctttacatgcataaactaggaaacctagaggagatggataaattcctggaaatatacaaccctcctagattaaactagtaagaaatagaagctctgaacagaccaataacaagtagcaagattgaaatggtaattaaaaagttatcatcaacaacaacaccagtgtggagagag

SEQ ID NO: 657315 - DNA, 132 bp, Homo sapiens
ctttggtcgagacacattagaaatgcctgtatagattctcaaggaacttgtacttttgagtccccatgattttctacatactctggttccccttctacaagcacaaccattgtacttaccatcacagtaata

SEQ ID NO: 657316 - DNA, 1318 bp, Homo sapiens
  misc_feature (1)..(1): n is a, c, g, or t
ntccggagacacacattccgggggggaaacctttcccgccccacaccttgatgtggtttgcccccctgccaccaaaaggggtttaataagagagccccaatgagaattggtccttctgttcccatgtgaatttattgtgagctggaagtgttggacgccacagaaatcctctccggagaattcttcttatttgaccgcccttggaggtgtgaaggaacggaaaaacggggacctttgaatgtgttttcccccaccaggtgggattccataggccattctacttgggcccccggatgtccgggtaggccgttggccccccccccccctcctcgaggaagaaaggtatttttttgaaataagggtcaaccacaagggagggttaccacagcccccctttgatttggaccacaatgttttgtgtaaaaagcccactctcacgggtatatagaaagggttttaaaaaagggaagcaacacccttgggagagaaaatatgccgcttttcctctgttggagacaccctggggttttccacgtgggcccacatttttcacgagaatctctcagggccccccctcgttaatattttttgcgcttgaagattcgcgcgcctgtgtaatttgaaaccttcccccacttgaaaaagggcgcacaaaggggggacaccgcccgaagatttaaaagggtgtccctcgagatccacgaaacttacactggggttcttcccccgccacagctggaaaaagttgggacacacaggtgtgagaaaatattttataggttccttgagaattccacacagagagagaaatagtatcccggcccacacagtgtcccctcgtgacactcatatgtaatatatcccacgccacagaccacctcataaggggcgacactacccacgagaaggcgctctgtgctgttaccctcgtttgttgtgtggagtgaaatgagtctgataaccccgcacacaccgcgccctgagggcgctcccacgaaaatggtgctccacccacatggctttccacggctaaccacggttctatgagaaacccacgccttgcgagaaataccacgttccccgctggaccactcccctcgtgaggggtgaacgcttatgcacttataccccccacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaaccaaaaagaaaaaaa

SEQ ID NO: 657317 - DNA, 438 bp, Homo sapiens
caatccatctttttcttgtaatatcatgacttttctctgcttcttgggagcacttgcagcatcactagtggtacttcatatgggtccaatagtgttattcagtgtttatggaaatgcactaaaaatgatgaaaaatatgtgaaaactgtaagaggttacttttactgtcatatgcagtttactggagaaatgaactgctcacacaaagatgattagctttacatgatattttaagcggatacttcagctcaccacaacagcaacaggacttggctctgaaattattatagtagtatagtatatactacaggtaattttatgccattatgattgaatactacctcttcacgtctgttaacatttctcttgacagctaatggtaccatgtacagtctttatttgtgtatgttttaatccattttagctttttataaaaaa

SEQ ID NO: 657318 - DNA, 1398 bp, Homo sapiens
  misc_feature (6)..(6): n is a, c, g, or t
ggctcngctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacatttttgaccaaccgcagcaatgcacagagacaggatattgccttcgcctaccagagaaggaccaaaaaggaacttgcatcagcactgaagtcagccttatctgggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatcccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcacttaccccccacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaaccaaaaagaaaaaaa

SEQ ID NO: 657319 - DNA, 198 bp, Homo sapiens
gtagagacggggtttcacctgttagccaggatggtcttgatctcctgacctcgtgatccacctgcctcggcctcccaaagtgctgggattacaggcgtgggcaccagacccgggaaaaagatttttaacaggatgccgtaaaattatatgccattaagattcagagagctttttggtgcctttatttgttagtcgacg

SEQ ID NO: 657320 - DNA, 1457 bp, Homo sapiens
gctctcagactctcgggcacgggccaggttatcttgtagacataacaacattcggattgcactctacccggagagtttcccgcttggttgaacacatggcctcaggcagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacatttttgaccaaccgcagcaatgcacagagacaggatattgccttcgcctaccagagaaggaccaaaaaggaacttgcatcagcactgaagtcagccttatctgggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatcccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcacttaccccccacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaaccaaaaagaaaaaaa

SEQ ID NO: 657321 - DNA, 118 bp, Homo sapiens
gtcctcatgtaacatttaaaatgcttattaaattcaatttcatcaaaatattggaatgagagttgttactgaaattgagatacaaatgtatcctctccctgaagaaaagagtgcttgg

SEQ ID NO: 657322 - DNA, 734 bp, Homo sapiens
cctcagatgaatgcggtgttaagacctgcaataatccagaatggctactctgatctatgttgatacggacaatggagaaccaggcacccgtgtggtttgctaaggatgggctgaagctgggtgtctggaccttcaatcaaagccttagcatgggcgatctcaagtttcaacaccacgttctggcccacacgttcgatgccccaccagccttacctaaagctcactcagcaaccggcattaggggacactgtcactcagcagctaacacgacacaagctctgtctacagtacacaacgggcgtagccccctgcaacagcatcacaaaccgagcgcaacgcgctgtctacgtgccccaacaataggattgaccctgcagcacagaccagctctgacactgccctcactcacgtcctcatgtctcctctgcccttctgccacttgctatcggcggtattacgcggaagcaactacacaagagaagcttgtccgtacttcgcggagctcggcacccgtgcgcggtccatacgaacgcgtttctgccgcaacaggttgcaaggctagccgttgacgcttaggcaagtacagccaccgatatggaattagggtgccttggcattctacacaagtgtgaagatgggcagcgcggcgccaggtgacatggcatacgccatgcactgtatgtgactgcagtcggtagaatgtgtccactgggcagggacgctagcagtaggtg

SEQ ID NO: 657323 - DNA, 1238 bp, Homo sapiens
  misc_feature (6)..(6): n is a, c, g, or t
ggctcngctcagcatttggggacgctctcagctctcggcgcacggccaggtgtggatgaggtcaccattgtcaacatttttgaccaaccgcagcaatgcacagagacaggatattgccttcgcctaccagagaaggaccaaaaaggaacttgcatcagcactgaagtcagccttatctgggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatcccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcacttaccccccacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaaccaaaaagaaaaaaa

SEQ ID NO: 657324 - DNA, 182 bp, Homo sapiens
  misc_feature (39)..(39): n is a, c, g, or t
  misc_feature (61)..(61): n is a, c, g, or t
gtattcttgtctcctcaactcctcattactcttcactanctactctcagctactttcttanttacttttgtctgttgtttggacaggatctcactctgtcgccaggctggagtgcagggtgcgatcatggtcactgagccttgaccttcccggtcaaactattctccacctcagcctccaag

SEQ ID NO: 657325 - DNA, 1444 bp, Homo sapiens
  misc_feature (6)..(6): n is a, c, g, or t
ggctcngctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacttgtggtaccgagctcgcagtcgacagttgcgaacagcacgaacatggatgaattcgtcctgtacgacctgactcgagatgaatatggaccaatgaaggaaacttgtcgatccagggagcatggagattcaaggactgtagtctggggcaccctgtgagtacccggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattatatcccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatccctgtgagggtgacgttagcacttaccccccacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttagaaaccaaaaagaaaaaaa

SEQ ID NO: 657326 - DNA, 608 bp, Homo sapiens
  misc_feature (6)..(6): n is a, c, g, or t
ggctcngctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggatgaggtcaccattgtcaacatttttgaccaaccgcagcaatgcacagagacaggatattgccttcgcctaccagagaaggaccaaaaaggaacttgcatcagcactgaagtcagccttatctgggccacctggagacggtgattttgggcctattgaagacacctgctcagtatgacgcttctgagctaaaagcttccatgaaggggctgggaaccgacgaggactctctcattgagatcatctgctccagaaccaaccaggagctgcaggaaattaacagagtctacaaggaaatgtacaagactgatctggagaaggacattatttcggacacatctgttaattcctgcagctcctgcgtgttctggagcagatgaatctcatgagagat

SEQ ID NO: 657327 - DNA, 286 bp, Homo sapiens
ttgaatattagagaatatctgtagaccaagtagtagtctaataacatactgtgtaaaactatgttttgttaatgtgttatcttttcccttttgtgataaaaaaagaaggtaaggggagaaatttaccagctgcttggaattatttatccatggaagatctgtagaaaaggtccctagatatacagatagacctcctgcaacggacttcatgaaaggccaagagggggagagtttgtgtactgtcctagacttgtagcctagggagcttgcctacatgtgtaagagc

SEQ ID NO: 657328 - DNA, 737 bp, Homo sapiens
gtgcgggtggagtcgcggagctactcctcatggccgccccgccggagccccggctgagcccgaggcagagcgaagtcccttaagctcctaggattcccacgcactgtcgaaacatactcccatgcgccccggcaattcaactactggtcatggtctcacttaggactctgtacgctggcctggcctttcggcaccaatttgcctctggctcccacctaagtagcacacttagcacagatcactgctgacttgcttgcgcacgctagcgcacgggctatcacctcattgggctggaccttatcgggcgcatggcctgggcttcccactgtgctcacgcgctacttacacctcaacttgccacaacggcccacacaggaaacttcccaaggcgcacacaggaaacttgggccccagcacgacgaggcacaccactttccccacagaggaacaggacttcttgcacttacttgcacacggggctagcccacagctcttcgcacctcccccttggcaacagacgttagaggaaacccaaaccacactcggggcccagcggcccagcgccacggccacaccctgaggaccacccgaacctcccttctgcaccgtccccaattagggacacagcttcaacagctgggttacccccccgaagcactgcttcgcacaggaaatgtccagatcgcccaagcgatattagaccaacccacttcttcccacgtgggttgcgccacaat

SEQ ID NO: 657329 - DNA, 1386 bp, Homo sapiens
  misc_feature (6)..(6): n is a, c, g, or t
ggctcngctcagcatttggggacgctctcagctctcggcgcacggcccagcttccttcaaaatgtctactgttcacgaaatcctgtgcaagctcagcttggagggtgatcactctacacccccaagtgcatatgggtctgtcaaagcctatactaactttgatgctgagcgggatgctttgaacattgaaacagccatcaagaccaaaggtgtggcatgcaggtccacccattgtcaaaccattttgcacccacaccgccagcaacatagccacagcagcaccaggcatcattgcgcttcagccgtcacccagcagcaaggcaccaaacaacaggcacactatgccatccagccactgcaagtccaggccttcatcatggcccaccctggcagcacgtataaagcatttatagggccatcattagcacaagcaccaccatagactccaggtcatagcaccgctctcatgcagactaaaacagctatacccatgacaagcgcggctcggagacaccagcacggcaggcactctcatccatagcagaatccatcataggatcccaaggaaacccaaccgcagggcaggcgtagacgaggcaacacattcacaccaagcaagtcataccaaagggcaaacatggtaccaaagcacatgcatcgtgggcagcaaaggaccaatataatcatccagggcaccaccaatcctgggtagcacttcccggacaaacagcagtgcacagcggaacaggcccacatggccaaaaagggggacacagacaacgaaccgcagcgacgggaacgggcctacctgaccactaggccgtcatcgaacccgagcactatgcaccccaagcaatgcctccgggagaaacgatcaaatggaacggccagcggacgtccacagaaccgaacccgccgcacccgcgaacggtaaccacaaacggcggcgaccacgcaaatgaaggaacccgcagcggggccgacgagggccccccacccatcacaagagaaaagaaatacgaaaaaaaggtaccaaaggacggaagcacagcgcaaactcgcgaagcatgggaaagcgagacagaagaaaacagggcacacaggaagacccggcacacaggcagcaccagaaacagaaacacggcacccagacaaccgcccacaccagcacaggcgcacaacgcagcggcagccccgcgacaccgcacacggcaccaccgcaaaaggcacacacaaaaaaggaaccacaccaagcacggcccgatcacacaccaggcgtcgaaccagacgacgagagaagcagcacataaaccaccaacaaccaggacacaacacgcggcaccacgcagagacagcgcacaccgcgaacgtccgaccgcagacacc

SEQ ID NO: 657330 - DNA, 199 bp, Homo sapiens
ctaccgaggctccagcattactggtatttggagtgtcagcacgttgctcacagaatgccaggcacttgtccagggaggcgtgcacctgagtggtaaactcggagggaagttggacggccagggtcactagcaggcagtgacttaggagcttgacgttgaccgggtccacccgaagtttgtgcgcgttgccggtcgctca

SEQ ID NO: 657331 - DNA, 249 bp, Homo sapiens
gtagctgggaggagctgaggacaactataaagagcaggtgtgagacaatgcacaacttggatctactcaatctactgattggcatgccagaggaccacagagaggggtcggtcacattttgctcccaggttgtgagcttgagagcccgggttaaatgacagttgttctcccatgggaatgggaaaaatctaacagaaactggttttgagagaaatgcggatgagtctaacaatgggaacacatttgagg

SEQ ID NO: 657332 - DNA, 1138 bp, Homo sapiens
  misc_feature (283)..(283): n is a, c, g, or t
agacaagtcaatcgcccttgggagactctgcaacatacgccgttgcccgcgcattctatagatatggcacacatgtgtccaatctgcgggcgatcttgcttacccatcacgggactgcaaatagttgtccggatcgcactgtgtgactaccactcgtgttttgtgagcaggtacccactggccttgtcaccctcgtgcgaagtacactcactcgcttattcacgcagtgtcctttctagatgctagacacaggtagggggacaaacgttgcgtcagccggttntgaactgttttgctgtgcgccgttaggaccccggggtgcaatgtctcgtccggcgaacctctcattcgtggtttctctcttgtgtgtcttagtccgatcggagcacggttgcaatgagggccagccggggggaacgctcgccaatccttctctgggtctactaaggggaagggtaaacgtccgcgagcttgcagagaggccgattttgcctgagtatgctatgatcatcgcacgctgtattggcgttactcaaagtgcccaggggacattggctgagtggccagtggcggcggaaagcgagcaaggagagaacgcgcaagccacgcgtacaaagcccgaactatgcacgtcgcagtgccctggagatcgcgaggcataggcgcgatgtgccccagggacagggggagctggcgacggccaatgcaagggggatcacgcccatggagcgacggaaccgtgcctcccaactcgtgtcccagggatgtttcagagcctacttggctcaatcgctgctcagcacccatgccgggattacagctgtgccgttatgtgagggggctggagagatgggcataaggtcaggaaacgttgggatggagccaaccagccactgtatagacggcgtgaggccctctggggccctgccggaaagggagccacccgtgctcctcccaacaaacgactcagaagcagcagaaagacgggtgactgtagaggagcaactcagctctacggggagggagctcattgggtgagcttctacagggctgagaactgcgctttggggacttcagccttccggttccagtcgtgggctgagtggggggtccagaatacctggatgccccttcccca

SEQ ID NO: 657333 - DNA, 136 bp, Homo sapiens
gtcagcaacttcctatgttggcctggaaaggactgggattacaggtgtgagcaccgtgcctggcatcgattctcgacaaagaaatgaaataaaaaaaaagttagccgggtgtggtggcatgtacctttagtcccag

SEQ ID NO: 657334 - DNA, 357 bp, Homo sapiens
acaaggaggcctccctacctccacttcatcccacacaggagtcttgatgctgggtgggagtccaggagtctgtctaggaatccaggaaggcttcctagaggaggagccattgcatctgggcccttgaaggatgaatagaagtttcctaggcagcgaagggccaggtactcagaagaccacaggcaagacccagccccatggcctgccccaaagagttcacatctcataaatgatgcttgaataataacaataatagtaacagctcccacatgctgagtgtgcgctgctaggacacagcatgtgacaggaattcagtgcctgaatgaatgagcccattaattaaaccttctcctttaa

SEQ ID NO: 657335 - DNA, 738 bp, Homo sapiens
  misc_feature (154)..(154): n is a, c, g, or t
  misc_feature (619)..(620): n is a, c, g, or t
  misc_feature (648)..(648): n is a, c, g, or t
gggcagctttgtggccggaggcaggtctgggttactgagggttgacagctgtagagtatgacctcaggttttcttcttttcagctggccatcctctctggacctgtcctttgactcattcatacagtgggggaggggtacctatcttacggagntgtcctaagttctaaatgcaaagcgctcccatctggcatctatggcacagatatatgttggactcacaggagtgatgctgagtggcggaggcagtgcttttcttttttttttttctgttttttgtttttttctggtgataagagtctcacccaggttgaagtgtagtgacatgatcccacctcactgccactgccacctcctgggtttaagcaattctcgtgcctcagccttctgaagaggtggatttctaagcacacaccaccacgcctggctaatttttgtatttttagtacagacaaggttttaccatgttggccaggctggtctcgaactcctaacctcaagtgatccgcccgcctcggcctcccaaagtgctaagattacaggcgtgagccaccgcgccgggcaaatgtttttatttggactgtcaggaagctccagagctgcagctggtggaaggcggnnaaaacactgcatgcgtctagatgcacanaacaaaatccaggagcaggatgggttgggaaggccttgggtggatctcaagagaaaagacttttgcttctagtttaagagtcagacagag

SEQ ID NO: 657336 - DNA, 266 bp, Homo sapiens
ggaggccgaggctgcagtgagctacgattgtgctcctgtactccagcctgggccacagggtcacaccctgtctcaaaaaaaaaaaatggcgttccaaaagcccctgggccaagttttcaagggttgggggcccttgggggcctaccgggaaaaccttaaggccgggggaaacctccggtaatgaaaaccgtttcctgggttgcccccggcccgaatggggacccggcctaaatttcaaaacatgggccaaggtggttcctgggggg

SEQ ID NO: 657337 - DNA, 208 bp, Homo sapiens
tggctagctgcagttgacgtgagcaggaggcattgctgatgatcttgagtgctgttgtcatacttctaaatggttcaaacccattaagaacatgggggcatcagcagagggggcagagatagatgacccttttggctcccccctgcaaatgagccccagccttctccatggtggtgaagacgccagtggacctcacgacaactgcagc

SEQ ID NO: 657338 - DNA, 666 bp, Homo sapiens
tggaccagtcggctctctgtaaaatggaccaatcagcaggatatgggtggggccagataagagaataaaagcaggctgccggataacgcagtggcaacccgctcgggtccacttccgcactgtggaaactttgttctttctctgtttgccataaatcttgccactgctcactctttgggtccacactgcctttatgagttgtaacactcaccgcgaaggtctgcagcttcactcctgaagccatcgagaccacgaacccactgggaggaacaaacaactccagaggctccgccttaagagctgtaacactcaccgcgaaggcctgcagcttcactcctgatccaggagaccacaaacccaccggaaggaagaaactcctaacacatccgaacatcagaaggaacaaactccggacacaccgcctttaagaactataacactcacctcgagggtccgcggcttcattcttgcagtcagtgagaccaagaacccaccaattccggacacataactagcaaagctacctcaggatggagcagagccagcccctgggcacaaagtggaatggcgatgtgagctgttggaaaaacgcaacacttctcaattcggtatccatttaccagcgagacccggttcgggctcacgcatgtgaccacacttctgttg

SEQ ID NO: 657339 - DNA, 861 bp, Homo sapiens
ggctgctatttctctgtgaggtaggaggctgccatctgtaaaatgagtgggaactcattatctttctgatgtctgtctgtgccaccacaagttatctgttctacagctgcaagtttcccactctctttgtgtcagtggctggcaaatatccaggcatgcaagcttcctatcagtacactgagtaagaaggtgtttcactctgtgtggcccaggctgaagtgcaatggcacgatctcggtcactgaaacctcggtctcccgggtcaagtgattcttctgcctcatgcctcccgagtagctggaattacaggcatatgccaccaacccaagctaattttccatttttagtagggacgggtttaaccatgtgtgtcaggctggtctgtgaatcctgacctcaggtgatccacctgcctgtgttctcctaaagtgctgggatagcaagcatgaaccgtgcgtcttggcccattttttcttattcttaaacatcctataaacattgtggagctagtgtatggggaggttattcctatggtggatggagcagtttaaaaaagctgaaattagtgaaagtcttcccaaggtgatttacacaaatttataagccccatgttcttacgtagtaaatttcaacaattttttctattggaagatggcatggttttcttatgacaggtatttaatttcaagggataaaagggttaacttttggaacatttggcttaatatgctggagcataatatgagtggaacgggaagggtcaattccgcgaagaatacccaaataagaggggggtcacagaacggtggacgatttggtagtagggaaaggtaggcaaagtaggtattagatccgagcggg

SEQ ID NO: 657340 - DNA, 108 bp, Homo sapiens
gttttctccatgagctgtgtctgattagaagtagagttccaaccattcaatattccaccaactgccatgccctgtgtacaactgcagaaaaatttccgtccaacctat

SEQ ID NO: 657341 - DNA, 1228 bp, Homo sapiens
  misc_feature (240)..(240): n is a, c, g, or t
  misc_feature (454)..(454): n is a, c, g, or t
  misc_feature (787)..(787): n is a, c, g, or t
  misc_feature (791)..(791): n is a, c, g, or t
  misc_feature (796)..(796): n is a, c, g, or t
  misc_feature (804)..(806): n is a, c, g, or t
  misc_feature (810)..(810): n is a, c, g, or t
  misc_feature (819)..(821): n is a, c, g, or t
  misc_feature (824)..(824): n is a, c, g, or t
  misc_feature (829)..(829): n is a, c, g, or t
  misc_feature (835)..(835): n is a, c, g, or t
  misc_feature (839)..(839): n is a, c, g, or t
  misc_feature (844)..(844): n is a, c, g, or t
  misc_feature (847)..(847): n is a, c, g, or t
  misc_feature (950)..(951): n is a, c, g, or t
  misc_feature (1040)..(1040): n is a, c, g, or t
  misc_feature (1047)..(1047): n is a, c, g, or t
  misc_feature (1052)..(1052): n is a, c, g, or t
  misc_feature (1055)..(1055): n is a, c, g, or t
  misc_feature (1057)..(1057): n is a, c, g, or t
  misc_feature (1061)..(1061): n is a, c, g, or t
  misc_feature (1064)..(1064): n is a, c, g, or t
  misc_feature (1139)..(1139): n is a, c, g, or t
gttctttcccagaagtcgactttgtccagcttcatggagttttaccccctgcacacactgatggctactcagccagagaccgagtgggtcccctgtgcagatttctggagctctttttctgcctaggccccacccctttatgctctactccgtaaaatctagtcactgtgtcctgcccagagtcagatgcaaccaccagactcagtttctccagtttctaaatgtatctggctgggaggnaagtacagaccctgttactgcctcatgaaaggaaactgttgactactacttggcctggtgcctctcacttaggccctaacagtataactgattgcccaggagctgcatagttcacgttaactgaagtctgaagtgtatttcgggagggggcatttttccatgtcagggcttctttaagaccacaaagctgaagtctgtgctcgctgctcagcgnaggccgtgctctgcgcattgcgtgcatttgctgcctcctccctcctcctgaatggccacctcttccctgctgatccgcatgctgtctgcacctgaagcctctctccgtgttggtcaggtaggatttctccacccttttcgccctccatcaccttccatcttctactttgggcttctcccacattccaactcatttctaggtttttctagccagagaagagaggactggcttcgttcatctctctcaaagtagttaggacacagcgtttcaccagtagaaggagtttcctccattagaatgagtgactgtgtgtgtgtgtgtgtgtgtgtgtgngtgngtgtntatatttnnntccntgactgatnnntgngcgancagctngcanttgangcnctatatagggcatgtctaaattgtgcacccaagagaagagcctgggagaagcctcattgtgcggccttggccctcatggcacagatcccaggttggctgtagnntttagaagtggacacttttctaacatcagaactcatccagtccttacgttgaatcacacaaactcagtggcgtcactttggatcgaacngcacgtntcagntgncnctgnganctcacctggagctggagaatcaccctgttcccgctgttgcaggcgcaggacctggcaccgtaggacttagccggncaggacccgcaccgggggccctaggaagaactggggtagtgactaacagcgggccacctacggcggggccccggaaccaagcagaccgg

SEQ ID NO: 657342 - DNA, 967 bp, Homo sapiens
  misc_feature (240)..(240): n is a, c, g, or t
  misc_feature (454)..(454): n is a, c, g, or t
  misc_feature (787)..(787): n is a, c, g, or t
  misc_feature (791)..(791): n is a, c, g, or t
  misc_feature (796)..(796): n is a, c, g, or t
  misc_feature (804)..(806): n is a, c, g, or t
  misc_feature (810)..(810): n is a, c, g, or t
  misc_feature (819)..(821): n is a, c, g, or t
  misc_feature (824)..(824): n is a, c, g, or t
  misc_feature (829)..(829): n is a, c, g, or t
  misc_feature (835)..(835): n is a, c, g, or t
  misc_feature (839)..(839): n is a, c, g, or t
  misc_feature (844)..(844): n is a, c, g, or t
  misc_feature (847)..(847): n is a, c, g, or t
gttctttcccagaagtcgactttgtccagcttcatggagttttaccccctgcacacactgatggctactcagccagagaccgagtgggtcccctgtgcagatttctggagctctttttctgcctaggccccacccctttatgctctactccgtaaaatctagtcactgtgtcctgcccagagtcagatgcaaccaccagactcagtttctccagtttctaaatgtatctggctgggaggnaagtacagaccctgttactgcctcatgaaaggaaactgttgactactacttggcctggtgcctctcacttaggccctaacagtataactgattgcccaggagctgcatagttcacgttaactgaagtctgaagtgtatttcgggagggggcatttttccatgtcagggcttctttaagaccacaaagctgaagtctgtgctcgctgctcagcgnaggccgtgctctgcgcattgcgtgcatttgctgcctcctccctcctcctgaatggccacctcttccctgctgatccgcatgctgtctgcacctgaagcctctctccgtgttggtcaggtaggatttctccacccttttcgccctccatcaccttccatcttctactttgggcttctcccacattccaactcatttctaggtttttctagccagagaagagaggactggcttcgttcatctctctcaaagtagttaggacacagcgtttcaccagtagaaggagtttcctccattagaatgagtgactgtgtgtgtgtgtgtgtgtgtgtgtgngtgngtgtntatatttnnntccntgactgatnnntgngcgancagctngcanttgangcnctattgactcatgtctaggtagacaccctctagaggaacctcatagaagcctcagtgccactggcgtgccccgcatgtgacatagcccaagcttgtggcagaatgaatactgtcctgtcc

SEQ ID NO: 657343 - DNA, 1339 bp, Homo sapiens
  misc_feature (240)..(240): n is a, c, g, or t
  misc_feature (454)..(454): n is a, c, g, or t
  misc_feature (787)..(787): n is a, c, g, or t
  misc_feature (791)..(791): n is a, c, g, or t
  misc_feature (796)..(796): n is a, c, g, or t
  misc_feature (804)..(806): n is a, c, g, or t
  misc_feature (810)..(810): n is a, c, g, or t
  misc_feature (819)..(821): n is a, c, g, or t
  misc_feature (824)..(824): n is a, c, g, or t
  misc_feature (829)..(829): n is a, c, g, or t
  misc_feature (835)..(835): n is a, c, g, or t
  misc_feature (839)..(839): n is a, c, g, or t
  misc_feature (844)..(844): n is a, c, g, or t
  misc_feature (847)..(847): n is a, c, g, or t
  misc_feature (950)..(951): n is a, c, g, or t
  misc_feature (1040)..(1040): n is a, c, g, or t
  misc_feature (1047)..(1047): n is a, c, g, or t
  misc_feature (1052)..(1052): n is a, c, g, or t
  misc_feature (1055)..(1055): n is a, c, g, or t
  misc_feature (1057)..(1057): n is a, c, g, or t
  misc_feature (1061)..(1061): n is a, c, g, or t
  misc_feature (1064)..(1064): n is a, c, g, or t
  misc_feature (1139)..(1139): n is a, c, g, or t
  misc_feature (1326)..(1326): n is a, c, g, or t
  misc_feature (1331)..(1331): n is a, c, g, or t
gttctttcccagaagtcgactttgtccagcttcatggagttttaccccctgcacacactgatggctactcagccagagaccgagtgggtcccctgtgcagatttctggagctctttttctgcctaggccccacccctttatgctctactccgtaaaatctagtcactgtgtcctgcccagagtcagatgcaaccaccagactcagtttctccagtttctaaatgtatctggctgggaggnaagtacagaccctgttactgcctcatgaaaggaaactgttgactactacttggcctggtgcctctcacttaggccctaacagtataactgattgcccaggagctgcatagttcacgttaactgaagtctgaagtgtatttcgggagggggcatttttccatgtcagggcttctttaagaccacaaagctgaagtctgtgctcgctgctcagcgnaggccgtgctctgcgcattgcgtgcatttgctgcctcctccctcctcctgaatggccacctcttccctgctgatccgcatgctgtctgcacctgaagcctctctccgtgttggtcaggtaggatttctccacccttttcgccctccatcaccttccatcttctactttgggcttctcccacattccaactcatttctaggtttttctagccagagaagagaggactggcttcgttcatctctctcaaagtagttaggacacagcgtttcaccagtagaaggagtttcctccattagaatgagtgactgtgtgtgtgtgtgtgtgtgtgtgtgngtgngtgtntatatttnnntccntgactgatnnntgngcgancagctngcanttgangcnctatatagggcatgtctaaattgtgcacccaagagaagagcctgggagaagcctcattgtgcggccttggccctcatggcacagatcccaggttggctgtagnntttagaagtggacacttttctaacatcagaactcatccagtccttacgttgaatcacacaaactcagtggcgtcactttggatcgaacngcacgtntcagntgncnctgnganctcacctggagctggagaatcaccctgttcccgctgttgcaggcgcaggacctggcaccgtaggacttagccggncaggaccctcgtacctgtgggcacttaggaagtaattgtgggctaagtgaacttaaaccacgtcgtggactcagctttacttgtcttggttgttaccttcctgtacttttcttaaggccagtgatcagcaaaaggtttcctttaaaagagccagagagtaaaggttcccaagcttctggggggccanaaagnctcttaaa

SEQ ID NO: 657344 - DNA, 170 bp, Homo sapiens
ggaccgccgacgcggcggactgatcgaggcggccgggcggcgggcttctcagcaccgaagacgagcgcttcctggctcggctataattacaggcttttcgatcctctgcccgtccatggcggccggtgggtgaggcttgcgggtgccccggcggggcgccgggggcttca

SEQ ID NO: 657345 - DNA, 263 bp, Homo sapiens
ccagctttgtagtgggaggactctgcagtcaactctttgccactaggtggaattgaagaacttgttaaatttttgatttctcccctttaccaccttttaggttatcagaggttttattcagtttaaacctcagcaattggcaactaccataattgtctgcagtgatcaaggccaggcccgtaaaactccaaaccaaaatctccacttgttctgctgtatggatagctattcctctgctgttctctcccaccacaaacgtggga

SEQ ID NO: 657346 - DNA, 250 bp, Homo sapiens
caactctccagatgcctccagactcccatctcttcgttgtggctatggtgcagcaaaacactccgttgatccgttcccatgcccgtattccatatgtatcgggtgaaatttccctattcatatattacgacaacgagcgcttgccaacatgccgcactcacctgcggcacacctaccccgccccgccttccagaagtacatcaatcagcttctgctcacccaggcgcatagcacccgagtctgaaggcag

SEQ ID NO: 657347 - DNA, 122 bp, Homo sapiens
ttggcaggatagtgccaacagcctcaagatcatcagcaatgcctcctgcaccaccaactgcttagcaccccctggcaaggtcatccatgtacaactttggtatcgtggcaaggactccatgg

SEQ ID NO: 657348 - DNA, 417 bp, Homo sapiens
  misc_feature (144)..(144): n is a, c, g, or t
tctggcgccggattctcggcctcgcccttcgcagcgcattgatcctggagctttgtgtagctgggcacgccttctcccctgcatcaccacagctgcaccccgcgagcaccctggaccttagtcccggactcagaccccttctgngactccccacctgccaaccccttccaggtgtgcccccaggactgcagcgcacagaccaaagacatgggtgcccaggccctgtgggtgccggaagcggggcctttgagtgggccaggccactcccccgagctccagttgccttaggaggagtcacagaatacactggaacaggagctgggtcaggctctagagctgactcagtttccccaggaaccccacccgccttggggctcaggaacactacactgcacaggaatcccggcgccgagggta

SEQ ID NO: 657349 - DNA, 215 bp, Homo sapiens
aggatcagatgggaaggggcggagagaagatataaaacacaatttgtgtttctctataccacagggtcttgtgtcgccaatgtgcgccatgtgtgtcaatctcaggatatccctcctcgctgagagccaagaaaaactctctcaaaaataaaaggaaaatgtgttctctccatatcactcccgctgtggacacattctattatgtgatatatgcc

SEQ ID NO: 657350 - DNA, 251 bp, Homo sapiens
atcttcttgcgtacagccgctgtagatctcttcaagggagactcgaaggtcgtgtgtgactgaggcgatcttgcttactattcggagcgggctcttgcggcagagctgggacagcggccaataattcacgtaaggatgaacgccaccacatagcccataaggagaagacaagaaaaataggagtacatcaatagtccaattagccattacctgccaccgataacacagatagaccccaaaaaaaagggtag

SEQ ID NO: 657351 - DNA, 1352 bp, Homo sapiens
gccatagcagtgtcactgcgtgggttgtgtttgtgtagagaggcgtgagcgagcccgcttgtccggagatgcaacatgctgactgttctgtccctcccgggagcccccgccgactgtctgccgacgagtcgccatggaagtgcagaaagaggcacagctgcatcatgaccctgtcggtgtggaagatgtatcactaccacgacatgcagacgcggtggcctgcggctgaaccggagctctgcagactgatacgcatggatcatgacgcagagcccgggagactctacactactcgagaccaggatgcgaggacaccatcgcagcccggagagaaggataagtagcacgagacacggacaacatccaccatcgaggaaccccatacggacgcacatgacaacccggaccacccgacgcacgaccggagatcacacaggaaccggcagaacaaaaggaagcgccccggaaagggaggagccacacacggaatacaggagagacacaaaaggaacaaacgacaagagaagagcgccaccgaaccaggcgcgcacgagaaggaccacacaacgaccattggactgagaccccaagaggaacccacagccaaacagaatcagacagagacaaaaagaacgccagacagcaaagcactgaagggcgaccgggccgcgagacacagccgggagactggatcaccagaagccaaagaacaaagagccacggcgcatggacaccaaccacccggaccagaaacaagcggacagaggcaagccacaacgaccgagaacagagcacaccgacaaaaggccaatgcaaagacagcacaaacaagcgccgcaacagggaaaaagcgaaaacattaagcacagaaaaatgagaccgcgcacaaacctgcaccacccaggcagccataacccacgcgacacccaggaccagggcaaaaaccccaagacgcacaccaacagaaaagagacaagcacgaagggaagaagacaacaacccacaaaagcaaagcaggaaggaaagacaggagaacacgaaaaacgtgagaaacaaacaaaacaacaaagcagaaaacccaaacaggaacggaaagaacaaaagaagcaggacaaagcagaggaccacagggcacaacaccaaagagagagcagcccaaaagcggcgagagaagcgcgacacacaacaagaagccagcaagagccaagccagaaccgcaaacagcgagcaacacaaaacgggcgagaaagcagaggcgaacgaacgcagaacgaagaaaaaagaaaggaaggccaagaaaagagaaagaggcagagaggcagaagagaacgaaagcgcaaagaggacaacag

SEQ ID NO: 657352 - DNA, 119 bp, Homo sapiens
tggcacgagagaccaactttttcctgtataatttttttcctgtataacccccccttgccaagcttttttttacaaccagagccccccccaatgatgattaaacccctgacacattttta

SEQ ID NO: 657353 - DNA, 325 bp, Homo sapiens
cggcacgagggtaaattggaaacgtttatttcctttaactctttaaatgtgtcacactttttgctttctatttttaaactttgtgtctcctacaaaataataatcaaaaacaaaaaaagtaagcataacccgtagtttctttccaaatgcctttaaagtttcaaagcagtaattacaccttgcggcactacccggttcggccggtgcctggctggagggcgccggagagcctggagcagggcgccggagagcctggagcagggcgccaggaggccggagcaggaggagaaggagtaggaggaagtggtcactagcgcggcggccg

SEQ ID NO: 657354 - DNA, 105 bp, Homo sapiens
atactgatacaatcgagctcgtacccaggtcttttcccctcaaagttagcagtctttatagttttcaaggttcttcctgattggttcagctgcgttcacttccga

SEQ ID NO: 657355 - DNA, 331 bp, Homo sapiens
agtaattacagggaaattagacctttaacccttatatcataaaagaaaaaggtggctggacgcggtggtcacgcctgtaatcccagcactttgggaggccgaggtgggcggatcacgaggtcagaagatcgagaccattctggctaacatggtgaaaccccatctctactaaaaatacaaaaaattagccgggcgaggtggcgggcgcctgtagtcccagctactcgggaggctgaggtaggagaatggcgtgaacccgggagacggagcttgaagtgggccgagattgtgccactggactccagcctgggcaacagagcgagaatccatc

SEQ ID NO: 657356 - DNA, 825 bp, Homo sapiens
  misc_feature (16)..(16): n is a, c, g, or t
  misc_feature (26)..(26): n is a, c, g, or t
  misc_feature (32)..(32): n is a, c, g, or t
  misc_feature (58)..(59): n is a, c, g, or t
  misc_feature (122)..(122): n is a, c, g, or t
  misc_feature (142)..(142): n is a, c, g, or t
  misc_feature (163)..(163): n is a, c, g, or t
  misc_feature (169)..(169): n is a, c, g, or t
  misc_feature (172)..(172): n is a, c, g, or t
  misc_feature (192)..(192): n is a, c, g, or t
  misc_feature (209)..(209): n is a, c, g, or t
  misc_feature (251)..(251): n is a, c, g, or t
  misc_feature (310)..(310): n is a, c, g, or t
  misc_feature (312)..(312): n is a, c, g, or t
  misc_feature (393)..(393): n is a, c, g, or t
  misc_feature (420)..(420): n is a, c, g, or t
  misc_feature (458)..(458): n is a, c, g, or t
  misc_feature (472)..(472): n is a, c, g, or t
  misc_feature (491)..(491): n is a, c, g, or t
  misc_feature (524)..(524): n is a, c, g, or t
  misc_feature (533)..(533): n is a, c, g, or t
  misc_feature (637)..(637): n is a, c, g, or t
  misc_feature (820)..(820): n is a, c, g, or t
gggtccgggtccgctncctggcgctncgggcnggcgggccatggtggtttagattganncgggcccggccgggagacgccgagtcggagggggtggcagtaagcggcggcaaaggctacggngctcggtttggctgactggngagtcggcaggcggcaggaancatccnagnccagcggacctactgctggncccggcccgcctctccntccgcctccttctgctgctgggttacaggcgccgctgtccanctctactccggggtctagtacagcgctggcgctacggcaaggtctgcatgcgctccctncnctacaactcctttgggggcagtgacaccgcatgttaattctgccttttagcctttctactgactggtagacaacgtgatcngctggtttggagtcgtattcgtagtcntggtgatagtgctgacaggctccattgtagctatcgcntacctatgtgttcngcctctcatcctccgaacntactcagtaccacgactctcctggcatttcttntatagccantggaatctgatccatacattgtcttccactactaccaggccatcaccactccgcctgggtaccaccccagggcaggaatgatatcgccaccgtctccatctgtnagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagtngggac

SEQ ID NO: 657357 - DNA, 128 bp, Homo sapiens
gctctgctctagagatccctaagagaccgtgttgcaatgcggttgttccactatactggcagctgtctacgcctttagaccatttctccaagtcgctcttcctggacctggtgtagctccagcgagga

SEQ ID NO: 657358 - DNA, 370 bp, Homo sapiens
  misc_feature (8)..(8): n is a, c, g, or t
  misc_feature (24)..(24): n is a, c, g, or t
  misc_feature (334)..(334): n is a, c, g, or t
attattantggtattcttaaaaanacaggaaaaaaaaattcgggacacacctaaatgattgtgaatgctttgaaaattgtcatccaaaccacagcccacaaaagtaggccaggacctgtgtgataaacctaaatggggatatgccttctaatggcaaagatttctgtaggacccagagtcttgtaagttatagtgaaaatattgaggataaaataaaaaatcacccatcataccaaaaccaagaaaatcacaacttgaataagaaaaaggaatgacaacactaagatgaatcagatttggaattatctggcaaggatttttaaagcaaacatcntaaaaatgctctaacaaataattacaaagtatcttg

SEQ ID NO: 657359 - DNA, 163 bp, Homo sapiens
tgttaaggagagaaggtgcatgcatggggactacttagaaaagctctggtggtcttgtagggtcagaacactagaaatttagttatatatagatttaaagtggtatgcaggggacacatataaacccttaacttctttaacttagccctgtgaccgacctgct

SEQ ID NO: 657360 - DNA, 117 bp, Homo sapiens
tccaaggatgagaaactgttcagcaactgtttagaacaggatgactcacaccaagtccaatcaaagccattcttgcacttgtgaaatggttctgaacgaagtattgtaactcctctg

SEQ ID NO: 657361 - DNA, 633 bp, Homo sapiens
  misc_feature (633)..(633): n is a, c, g, or t
gaggagagagagagagagagagagagagagagagagagatagagagagagagagagagagagagagtatagagagtgacatagagatatcaccccttctcgcacactttttttgcagatttcttcttctcaagatctctccctcctatgcgctccgactctttgtggaagcccctattggagagacccctgtgcagcccctctctgttttttatatagttctgcgcaactctcttttctataggtgttttcacaacctctatattgctcttgcccaatttcttgctcttaagagatatgaacctctcttccgagtatgtctgaaacactcttgttgctcccacccctaactgtcccggctctttttttttgttttcgagagttgtgccacccctttttgatattctctcttgtctctctccccaccttttatccagttttttgcccgccagtaggctcttctcctcttttcttttacagagtttttctcctctcacccttttccactttttttgagtttttcgctttttgtcccctcccccctcttttttccttcccttctctctgacacatgtcccctttttctgtgtgtttttggggccctctttcttccctccctttttttttttttttn

SEQ ID NO: 657362 - DNA, 662 bp, Homo sapiens
  misc_feature (75)..(75): n is a, c, g, or t
  misc_feature (139)..(139): n is a, c, g, or t
  misc_feature (174)..(175): n is a, c, g, or t
  misc_feature (203)..(204): n is a, c, g, or t
  misc_feature (271)..(272): n is a, c, g, or t
  misc_feature (330)..(330): n is a, c, g, or t
  misc_feature (353)..(353): n is a, c, g, or t
  misc_feature (368)..(368): n is a, c, g, or t
  misc_feature (399)..(399): n is a, c, g, or t
  misc_feature (401)..(401): n is a, c, g, or t
  misc_feature (433)..(433): n is a, c, g, or t
  misc_feature (450)..(450): n is a, c, g, or t
  misc_feature (495)..(495): n is a, c, g, or t
gggacgtgcggctcccctcggcctcctcgccatggactgcggacgactcccgggcccccaagggctccttgcggnagttcctggagcacctctccgtgggcctggcaatggccatctgtgcgtgctgaccagcggctgnggatgctcaaggtatgaacgctgccgtcctgtgcnngtggtgcgcatgtggtatctacgtgggnngccaatggtgtacttcatctacgagggctaccagggcatggtggacggaggctcaaacatcgcaganngccgactgggagagtgtctccagcatcctgcaagtgtgtgcgggacgatcattggcangtgcgcggtgccaggccttccgnacgcgggaaggccgnctgaaggctgcttgcaacctgctgcagcgcngncatcaccaacctgtgtgtgatcggcggggacngggagcctcaccggggncaacctcttccggaaggagtggagtgggctgctggaggagctggncaggaacggccagatcgataagtgaggcccgtgcagaagtacgcctacctcaacgtggtgggcaatggtgtgctccatcgacaatgatttctgctggaactgacaatgaaccatcggcacggactccagcctgcacaggatcatcgaggtcgcgacgccaatcatga

SEQ ID NO: 657363 - DNA, 84 bp, Homo sapiens
acatctgtgtatttctgcgccacgactgggacagggacagataatgagcagttcttcgggccagggacacggctaaccgtgcta

SEQ ID NO: 657364 - DNA, 548 bp, Homo sapiens
  misc_feature (1)..(1): n is a, c, g, or t
  misc_feature (7)..(7): n is a, c, g, or t
  misc_feature (28)..(28): n is a, c, g, or t
  misc_feature (52)..(52): n is a, c, g, or t
  misc_feature (65)..(65): n is a, c, g, or t
ngtaaanccggtggtggacaagcctttnaagaaaaaagtacctagttggggnaatttttccaccngatacaaataagcttgacccccctaaatttaaaaaatattatttaaaaaaaataaaaatgtcaagatttaattccacctgtcaacagaagtttaattcctgttgaatgggtaaatattggctttggcctaatcaagagatttcgacatgcaaggcatcccagctgaaatgtgacttggtgcaccccctatgatgtgagtttgtgctgtatttaagaaaaagattttaccccatctctactaaaaataaacttagcctcctcggtagctgggactacgggcatgagccaccagatccaactaattttttgtatttttagtagagacgggtttcaccatgttggccaggctggtcttgagctcctgatctcaggtgatctgcccgtctcaccctccaaagggctgggattacaggtgtgagccactgtcccagccagaatattcacttctaaatgtgggtgtgtattcaggtgacttcccattaa

SEQ ID NO: 657365 - DNA, 782 bp, Homo sapiens
  misc_feature (4)..(4): n is a, c, g, or t
  misc_feature (180)..(180): n is a, c, g, or t
  misc_feature (195)..(195): n is a, c, g, or t
  misc_feature (492)..(492): n is a, c, g, or t
tttntctcagctccgggcgtactgccacaattacccctggatgaattcctcagtggaaatatcaacaaggtcttgcctggtacagtggctcacgcctgtaatcccagaactttgggaggccgaagcaggcagatctcttgaagtcaggagttcaagacaagcctggccagggggattcanagggtacatgtgcanatttgttacctgggcatattgcgtgatgctgaggttgggagtacaactggtcctttcacccagactcagcccacctgcacccaggtgattaaaaagctttattgctcacacaaagcctgtttggtggtctcttcacatggacgcgcgtgacatttggtgccctgacttggatcaggggacctcccttgggagatcaatcccctgtcctcctgctctttgctccgtgagaaagatccacctacgacctctggtcctcagaccaaccagcccaaggaacatctcaccaatttttatcanaagacagggatgtcaggcctttgaacccaagcctgcatgtgtacattcagatgggctgaagccactgaagaatcacaaaagaagtgaaaatgcctggttcctgccttaactggtgacattacctggtgaaattccttctcctagctcagaagctcctccactgagcaccttgtgaccaccgcccctggctggcaaaacaacccccttggactatatttccattaccccaatcctgtcggccaccttatctccttctctgactcttttttgaactcccaccgccccagggt

SEQ ID NO: 657366 - DNA, 105 bp, Homo sapiens
ccttttcagctgttcttcaggtagctcgtctggtttcgggggtcttcagcatttggctctccttgccaagttatttctagttaattcaggatgcagcactgacca

SEQ ID NO: 657367 - DNA, 218 bp, Homo sapiens
ttgcgcgagccatagatctgaagcttgaggttctgtggcagtgtggcatgggttgggtcacgagttctgaacgacggcccagccggggcgtcccgattctgaatattcagcagctcgctgaagtttgtcctcaggcaaagaaacttctgcctcccacggtcactatgcgggcagcccacacccaccccacgcgggcgcaaggtgctcggcggtcgcaa

SEQ ID NO: 657368 - DNA, 417 bp, Homo sapiens
ctgagacacttacgatctcaaaaaaaaaaaggagacaggctcttgccctgtttgcccaggctggagtgccgtggcacgatcatagctcactgtggcctcaatttcctgggctcgactgattctcctgcctcagtctcccaagtagctgggaccgcagttacttgccaccatgctaggctaatttaatatttatttataaaaattaaaatattttttattttatttaggcaacatgctatgttgcctaaacgggtctagaactcctggcttcaggctatcctcttgcctcggccacccaaagtgctgggattgcaggtgtgacctgccatgcctggcttcctattctctatttctaggagataagctttttgagctttcacatatgagtgtgaacatgtggtatatatctttctgtgc

SEQ ID NO: 657369 - DNA, 137 bp, Homo sapiens
tccatgccatgaactgcctgaaacgcaggcgcatacttcgctattctacaccctatgtaggctccctgtcccctgactctatcgcactatctttacaccttacaaacatccctaggctcactataacagttctacct

SEQ ID NO: 657370 - DNA, 446 bp, Homo sapiens
  misc_feature (175)..(176): n is a, c, g, or t
  misc_feature (227)..(227): n is a, c, g, or t
agagctcacagtccgcctctgctttcttttttttcctgctagctccctcctaccttctcttctgtaccttccctgcacagcctcctccccagcctggatccacagccaccatcccatcacttgcctgctgcaagtatcctcagcactgcgcacctctctcccagctggcagaaannagccctggggaatccaactcctggacttctctacacctgcacacaggttgncaggagttgccagaggtcttggcacagcagcctggctggaatcacagagcaatcctcaaccttggccaggccctcactgcccacctggcaaatcctcaagtgtgaccctagtcatctttctccttttggggttttcagactttctccacaagtctcagacaagctcaagtcactcccacatgaaaaataaagacgggctgtggtgcagaataagatccg

SEQ ID NO: 657371 - DNA, 251 bp, Homo sapiens
cttggccaaaatgggggggccccattttgggttgggggaattttttttttcacagccccccctgggggacagttttaattaaaattaaaccccggggtttttttccccaaaccggggggggcctttcctggtccccaaggcaggggaggcatgttggggtttcctttccctttttttttagttgggcccaaaccccccctttagtttttttttttggccccttccttccaataaaaaaatttggggcccca

SEQ ID NO: 657372 - DNA, 150 bp, Homo sapiens
ttggttgaggagagatgagggcatcttgggctgttcgtgagttttctgcataggtgacagggtgtgtctcttacagttggaaatcggggttccagagttggtcaccaaaatcaaaatacaccaattgattggcggaggaatctgaaatta

SEQ ID NO: 657373 - DNA, 114 bp, Homo sapiens
  misc_feature (2)..(2): n is a, c, g, or t
gnaggatcccccgcttgggtcttcaactcaaaattagtcccaaaatttgtggcatatgtttagattttaaagttgatatttcccctattgacagaataaactcattaaaagagc

SEQ ID NO: 657374 - DNA, 215 bp, Homo sapiens
aaatgccaggctgacgggaatggacattatcaaaccgtgaaagaactccccggatctggtgaggcacaagcccaagagaggtaggaggctcattcatccgatcgtcactgcatgctggcaatggcatagcccccttctggatgctgcaaaacagataccatcgattccacggccagggcctcctgcaatcacggccagtcctggacgactcacag

SEQ ID NO: 657375 - DNA, 152 bp, Homo sapiens
agtgacatgcacggcatacgggttgattcagaaagaacgcgtatatgacgatgtcatttcacgacacgtgtgtcaatcagcagtcaatgggcgcgttcgacggtttcagcggaacgaaacggcagccacggtagacgcaaaacgcgtcaagt

SEQ ID NO: 657376 - DNA, 150 bp, Homo sapiens
  misc_feature (138)..(138): n is a, c, g, or t
  misc_feature (142)..(142): n is a, c, g, or t
taggcctgggtggtcagtttcacccgggcatgctgacccgggagccccggagcccctgggcgctgcgctgaggcctggacccgctgccgtggcgcgcggcgcctcagccgagaagcgggacgaggcggcggcgattgnatgngcggtcgc

SEQ ID NO: 657377 - DNA, 943 bp, Homo sapiens
  misc_feature (1)..(1): n is a, c, g, or t
  misc_feature (7)..(7): n is a, c, g, or t
  misc_feature (12)..(12): n is a, c, g, or t
  misc_feature (23)..(24): n is a, c, g, or t
  misc_feature (86)..(86): n is a, c, g, or t
  misc_feature (137)..(137): n is a, c, g, or t
  misc_feature (241)..(242): n is a, c, g, or t
  misc_feature (387)..(387): n is a, c, g, or t
  misc_feature (444)..(444): n is a, c, g, or t
  misc_feature (455)..(456): n is a, c, g, or t
  misc_feature (491)..(491): n is a, c, g, or t
  misc_feature (503)..(503): n is a, c, g, or t
  misc_feature (553)..(553): n is a, c, g, or t
  misc_feature (563)..(563): n is a, c, g, or t
  misc_feature (573)..(573): n is a, c, g, or t
  misc_feature (608)..(608): n is a, c, g, or t
  misc_feature (655)..(655): n is a, c, g, or t
  misc_feature (777)..(777): n is a, c, g, or t
  misc_feature (824)..(824): n is a, c, g, or t
  misc_feature (829)..(829): n is a, c, g, or t
  misc_feature (884)..(884): n is a, c, g, or t
nccccanctcanctctttcattnnaattagttaagagagccacaccaatttcttcttcattataatcacccattcatcccttattncacactttttctactcaattccaatatctcccactccaacctaccaatttnttattccacttcccttctatcctcttaataacctactcttcacctaactcctctttaccatcctttattataacattttatttttttaaggaggcggaccacannaacaccaaccgccactttgcctcacctcccccaaaattatatctgctgttgcaaccctttctacaccacatatcaaacacaaccttatccctactaaaacgctctcccattcactaatcatatcttcctgtatatccgatcattngaataaatataccccaaccttaacataacaaatttcatatatattctcaccttcatntgcaactattnngtatatttcaatatatggggccctttcaaaacaanagaacctcccancacctcccttaacctcccttttatcactcttgcacccaatttcagctaanctcccacttnaccctaccancctgtaaaattaccgcccttacataaataataatnctaatttcaccaattataatactcattaagacgcccactccctcttnaatatctcttaccctcccccttaccctttctattttccaaaactcttcctatacctaaatcctcacttcaaaacccttaaaaaatcattttaaccattttatacaattatataacactctcnatccaagtttacttattatatataaacccctataaatttatttatcnatgtncaagacttctctccctttcttataacgcaaaccctgtacccttaatgtaactatncctcgactttcacacttcctcatttaatcaccttcttcacaacgttatttgttacaaat

SEQ ID NO: 657378 - DNA, 130 bp, Homo sapiens
ggcttaaaataaatttattgtgcactacaaaatgtaggcatactggaaactaaaggtacattattaaatatacatatgcctctgaaagcttttcaacacacatgttttcatccaaccactaagatgtcat

SEQ ID NO: 657379 - DNA, 1075 bp, Homo sapiens
gtggtggctcacgcctgtaatcccagcactttgggaggcagaggcgggcagatcacctgaggtcaggagtttgagaccagcccggccaacatggtgaaaccccctctccactaaaaatacaaaaattagccgggcgctgtggtgcatgcctgtaatcccagctactcgcggaggttgaggcaggagaatcgcttgaactggggagatggagcgttgcagctgagccaagcattgcatcagtgcacctccagcctgcgtgaccgacgtgcgactcgtgtcacaccccccgcccacccccccccccccccacccctccccccgccccccctctccccccgcgtccggcccccccgccgcccgcccccgcggcccgtcgcccaccccccctccgcgcccccacccacccttcccctctattcctccccaccccggtgcgctcacaaactcctctagacgatactcatcccccacaatatctactcgacaaaccacacccacttatataactacttctcccacctacatccccccgagctccataaacatcctctccaccttatccaaaaccacctgaagaaaccctctccttaaaccggccgccgacgcgcgacaagcccccggccgcacagcacgcggacacgcgaccgcaccgcgcgggacggcgcgggcacgctgcgagcggagtgagagcagagcgaaccacggaggaagcgcgagggcagagggaaatgagcgatgtatgagagtagtggggagaggagggaggagagggatgaggcgggagagcaaggcgagggaggagacagagaggcgagccagaggagcagagcgccaggcccaggggagagggacaaggcggacgtccgggaccagaggtgcgatgggcaagggacagagggacggcagcgcgcacgacgatgaggtgggcccagacgaagacagacgaagacatacagagcgaagagagtagagccgcggggagaggacgatgggaagcagggcagggagaagagggggcaggggaggatggacaagaggagggacaagcgggctgggacgaggggacgggagataa

SEQ ID NO: 657380 - DNA, 459 bp, Homo sapiens
  misc_feature (61)..(61): n is a, c, g, or t
  misc_feature (75)..(75): n is a, c, g, or t
  misc_feature (93)..(93): n is a, c, g, or t
  misc_feature (98)..(98): n is a, c, g, or t
  misc_feature (110)..(110): n is a, c, g, or t
  misc_feature (133)..(133): n is a, c, g, or t
  misc_feature (143)..(143): n is a, c, g, or t
  misc_feature (146)..(146): n is a, c, g, or t
  misc_feature (148)..(148): n is a, c, g, or t
  misc_feature (178)..(178): n is a, c, g, or t
  misc_feature (184)..(184): n is a, c, g, or t
  misc_feature (201)..(201): n is a, c, g, or t
  misc_feature (214)..(214): n is a, c, g, or t
  misc_feature (253)..(253): n is a, c, g, or t
  misc_feature (281)..(281): n is a, c, g, or t
  misc_feature (286)..(286): n is a, c, g, or t
  misc_feature (291)..(291): n is a, c, g, or t
  misc_feature (300)..(300): n is a, c, g, or t
  misc_feature (302)..(302): n is a, c, g, or t
  misc_feature (325)..(325): n is a, c, g, or t
  misc_feature (327)..(327): n is a, c, g, or t
  misc_feature (333)..(333): n is a, c, g, or t
  misc_feature (339)..(339): n is a, c, g, or t
  misc_feature (388)..(388): n is a, c, g, or t
  misc_feature (390)..(390): n is a, c, g, or t
  misc_feature (401)..(401): n is a, c, g, or t
  misc_feature (406)..(406): n is a, c, g, or t
  misc_feature (409)..(409): n is a, c, g, or t
  misc_feature (412)..(412): n is a, c, g, or t
  misc_feature (420)..(420): n is a, c, g, or t
  misc_feature (439)..(439): n is a, c, g, or t
ttaaaaattctgtgcatgtactttatggagtacattctatttttgttttcagataccctanaaccaatttttttnagtaatcttttagaattnaaatnatcataaataancgaaaataatcatcacatagttnaaaattgtanatntngagtaatttaaaacaatctttgcatttaanagtaanaatcaaagacccttcanaagtgcctttatnagcaaaaatgtgaccagcaatgacaaccttgggagaatnaataaaaaataaaacaaaaaataaaggnaaaanaaaanagggaaagnanaaaagcgacatgaagcaaaaaananaaaaancacaanacgaaaaaaaaggaggaaaaaaacaaacattaaaaaaaaaacaacgaananataaaagaagnaaggncanaanacgacagnaaaaaaaaaaaaacaaaanaagaaaacccaggcaacacc

SEQ ID NO: 657381 - DNA, 107 bp, Homo sapiens
ctacaaaatgaggtgaatagagggcagactcatcctggtggggtgtgtgtgtgtgtgtgtgtatgtctatcttcctgattcatctgattcatcaatcagaaagacct

SEQ ID NO: 657382 - DNA, 707 bp, Homo sapiens
agcggagagggcgagcggagcggcggagtgcggcgccccgcgagctcctgaggtgttggttatgaacagtgattcggattcacgttcttgccaaccaatcgaggcgtgaggatcactccagtgcccagtctcaggaagctctgtcttgtgcatacactcatcgtccatgctctctaccctcgtctggaggggcaggagtttggcattgagcatatccttgaagacaagaatgcacccttcaatgcagtgtagtaatatatcgacgtaagaatggaaaaagatgtcccaatgctgccccaaagtcagagaagaaatgatggggtgtccttctgtgtctgaacatgtccgtatgaatgccctggcacattcatgctccaaagtgaatgaatgacccaacccagagaccatgtggggtgaaagcagcttcctgtgtccagtcttgaggtcttcatatgctaaggaacacgatgcttggggtctcagagctccacgaaaggtcagtcctcgagttgaatgtccagcctgaatactaagatgcccgacagctggagtgactggggagcaaagagaccccttactgtggatcagcacatggagaggtgacccttgatggtgaacgactcgatagggaatagaccggggatcaatatgatccccctagatacatgctggctgtgctaacacgtgtgaaagaagttgggccctga

SEQ ID NO: 657383 - DNA, 116 bp, Homo sapiens
ccccattcccaccagtaagacgggacgaaaaagtagagcggcatagatagactcccctaaagagagttatggaccttggtatagcaaccctacacggaaagccatgaattggatat

SEQ ID NO: 657384 - DNA, 104 bp, Homo sapiens
  misc_feature (25)..(25): n is a, c, g, or t
  misc_feature (38)..(38): n is a, c, g, or t
tttgaaaaagaaaacaaactttgantcattatttgggnttttgcatttcttataagcttttctttccataaaggatatagctgattacaacgaagactaggtgt

SEQ ID NO: 657385 - DNA, 1113 bp, Homo sapiens
  misc_feature (166)..(166): n is a, c, g, or t
  misc_feature (184)..(184): n is a, c, g, or t
  misc_feature (419)..(419): n is a, c, g, or t
  misc_feature (427)..(427): n is a, c, g, or t
  misc_feature (429)..(429): n is a, c, g, or t
  misc_feature (530)..(530): n is a, c, g, or t
  misc_feature (541)..(541): n is a, c, g, or t
  misc_feature (743)..(744): n is a, c, g, or t
agcggagtgcgatcttcgggcggtcagagttggtctgttactcgggtggaggcggagtctacggaagccagttttctgcattcacttattccatggcatgtagagcgctttcccgcctgtgccgggtgagagtgcagagcacgaaggtgcgatgatgagcactatngttcgcggacacgtctcnctcatcgtgttattagtcgtctgtgtgcatcggtctcgtgtctcgcagcagggcgataagccgtggtgtcgcatgagttgtactaggatctagtacaaggtacctaagatggactggaacggtcagaaaagtgtgaagaaaggcatgcacgtaccataaccatattgcgaagacacgacacggaccaggatagacatatataacacggagatgcatgtcatggctccgcacccancacgtaancnaactgaagcactagagacgaggaccatatgcaaggatgtaacacgtgagagtagatttagactaacgagcatgaatcgtcattcgaagtggtttccgaacnttgaaatcgcnatgctattgcattagttgcgcttattggttgttacttgcacctacatggcgaagtcgtctcatattcgccatatgttgtgatggctcagacgtggggctggccacaagcgtttcagctttttaccccttccctttcttgaactatcccacaggacgtggtctacatcggaagatctagcggtgggaagactgacgagccagnncagaactgtgcgctgtcgatttgccgtggtattattgctcttgatactgagtgtccgattgcgacaggaacgattccagacagaattctcgggcccttggccgccttcatcgaagctcgctactcaagcctcgtcaagggtgcgttttcgattgtgcgccaaacaacgctccgtttctggagaaacgcttcttcttgggacttcgaaagaagactcttaattattgtaatccaattacttttcttatgacacgacaccacgttcaggaactgtggaaagctgctatatggagcaatgagccatagggtagccttaactacttggggcctctttctaagttttgaattattcttaagcctttggggtatg

SEQ ID NO: 657386 - DNA, 496 bp, Homo sapiens
ggggccataagccaaatctttgtattatgccaacagcagtctggcggggttggtgcccactaatacacccctcgctggcggctttttctggaggcgttggttgacagtgtggcccagggcatccctttccaacagcaccagtttgacaaaaatgttttccaactggagcaggcctttgttttcagcaagcaaaggtaccccagccagccgcgaggagacactgtggacctggccaaaaagattttcctcaaatattaccccggctgggtggccggcttttggtgataaatttgccaccactgggccttgttttccgctaattccagggcagatttcaggggccaaaagttggacagacatcacaggataacccaggcttgggaggaggccccccggcctgttggtggggtttgacctggggggattggagggaaatgacctgccctccccccccccccaaagtgtgggattaaagtactgttttttttccccttta

SEQ ID NO: 657387 - DNA, 176 bp, Homo sapiens
ggggaacccccccccccggtttttccctaaaaaagggtggttttaaaaagcttgttgttttgggggaaagacccttttttaatttttttccccccgggtttttttgggggggggggggggggctttccccctttctttggggggccttttttgggtttaaatttttttttttttta

SEQ ID NO: 657388 - DNA, 200 bp, Homo sapiens
acccccccccccggggttcccaaagggggggcccccaaaaaaaattttttttttccaagggggcccccccccccaggggggggggccccgggtttttttttcccccccccaaaattttttttaggggtttaaaccccttttttggaaaaaccccggccctggggttttccttttttcaaaaaaaaatttccccccggcca

SEQ ID NO: 657389 - DNA, 81 bp, Homo sapiens
gttgaggacacggctgtatattactgcgcgaggtgggatgctgcaacttcgcgcttcggtatggatgtctggggccaaggg

SEQ ID NO: 657390 - DNA, 438 bp, Homo sapiens
  misc_feature (36)..(36): n is a, c, g, or t
  misc_feature (146)..(146): n is a, c, g, or t
  misc_feature (230)..(230): n is a, c, g, or t
aagatcttctaaatggaatgcttgttgcactgttcncaggcgagtggctgccatgagacctgaggaccacacttgggggaccaatcatgtccttcaccactgtgccttagaatcgcccctggacagagttcctgggcagagggganagcagctcccaggccttactcaggcctcaggtccatgggttgggcagccagtctgggcccttctcaggatcctcatctccatcntcatcttcttccttcacagcatttacttggagctcttttgtgacacaccatgtcagtcatgatgatcgggccacagccaggccctggccagctgacttcccattttaaaatgggaacttgtggtccaaataaccataaaaaaagcttaccagtgattaaggtggtgcctaaatatccagtcattgaataaatcccatgtagcaagtgt

SEQ ID NO: 657391 - DNA, 318 bp, Homo sapiens
aggctgaggcggaaggatggcttgaaccaaggagttcagttgcaccactgcactcctgggttatttttaaagaccctgtctctagaataaataaaaaagaagttagagaccagcctgggcaacatggtgagaccctgtctctacaaaaaatggaaagattggctgggcgtggtggcgcacgcctgtggtcccagctacttgggtggctgatgtgggaggactgcttgagcctggagggtcgaggctgcagtgagctctgattgtgatcacaccaccatattccagactggaagacagagcaaaaccttgtcaaaaaaa

SEQ ID NO: 657392 - DNA, 1207 bp, Homo sapiens
accgcctatgtgagtcataggaaatgccgcgattcaagatgaatcggtgatatagtgcgtctgtactatatgagtatctgtcatccatatagggtatacccttccggttcatgaacggtctcgtttagttaccacacgtgcacttgtgttgtttatctcatcgatgttaagccaggtcaagacgcttcgatacggtcaattaccaagctacatggttatgctttatgatagtgcctacccagcccttggctcttcatgttggacccatcaattgggtctttaatcctggcctcctgttggggtatcacccttatattctctggttgtcaaatacgtgatatgcgaagtagagtgcaaacacttggattgcaccgtattaacttacgggcgatcctcttgttatgtatattggcactgcttaacagtagagggtctgctaagctcgtgcttcatgtgacctttgtgtaaacccaagttgtattatctgtacgacgttgactccgattgtatagtatggtcggcgctaatgtactaccaagctagacgagcgacgttagagcctctattgcgatgtcgttgtaacttgtacttgatattgcaatagcaggtacactgatagcaatagccccatcatggtccatacaagctagccaacagccatgcattacagaatattttccggtttggggctgtaccttcggtagctagatacccgatacgctctcgtagcacagtacaatcgcttaagtacttgctacacaagtctaaatgcgtatacttactatatctctatattggatccaataacttgaccaacggttacaagtgtacccttagggataactagcgcaatcctattctagagtcctatatcaacaatagggtttacgacctctgatgttggattcaggacatcccgtatggtgcagccgctattaataggttcgtttgttcaacgattaatagtcctacgtgatctgagttcagacacggagtaatccaggtcggtttctatctacttcaaattcctgcctgtacgattaggatcaagagattataaggcctacttcacatatagttgccttcgccccgtaaatgatatcatctcaatacaacgtgtgatcccacacccatccagatcgtggttggtgcggtggtggtgcgtggtttgggggttgggttgttggttcgtgggtgggggggggtt

SEQ ID NO: 657393 - DNA, 681 bp, Homo sapiens
tggctgcccgcgcggggtgctgcattctgtaagcctccggagcgcacgttggcagtcggctccctcgttgaccgagatcaccgacctctctccccagctgtatttccaaagatgtcgctttctaacaagctgacgctggacaagctggacgttatagggaagcgggtcgttatgagatgtcgatcttcaatgttcctatgaagaacaaaccagagtacaaacaagccagaggattaagggctgctgtcccaatgcatcaaacttcgtgcttggacaattggacgccaagtcggtagtccttattgatgccacctatggccggcctgatggtgtgccctatgcctcgactgagtacgtccttagtagccacgtttgctgtacgtacactcaagagtctctgctgggcagaggatgttgctgtgtcttgaccggactgtgtacggccctagtagagtggacgtacacatgcctgtgccaggcccagtcctgctgcggtcttgctccgtccctgctggcacgatacctccgactttcatagtgcgaggaagtaatgggaagtggcaactagactgcttctgggaaccaggtttaaagccgagccagccatacatagaagcttctccgagcttcactttccatgctaggggactgtctatgtcaatgatgcttttcggcactgct

SEQ ID NO: 657394 - DNA, 368 bp, Homo sapiens
caacatgcagtcagtgttgtgttccaatgacgcgaagtatacaccagttactgagaaactctcagtttctcattcaatttcgcatagcgctattgctaccacaaactaaatgggtgtacatttttgagtgctgatttattactcaaaggtttgaatttggagactgaaacaaaccatgctttatctgtgtactttgagaaaatccatccacaagaaaggagccaagcgtcagttcccaatggggggaacattctcatggaggtactgtaaggctaagtctgtccacttcatttcttgtcctttgacagattctgtggtgccaccattgtcttgtacaggttcaggaagctcatttggtagctattcgg

SEQ ID NO: 657395 - DNA, 273 bp, Homo sapiens
ggttttaacccccttttttttaaaaatttatttttaacccccagggaaccccccaggccccaggttggccaattttggggcttttccggaattccaaaaaaagcccttttccccaaaacccaaagttttttttttttaacaaaacccccaaaccccctttttttttttttttttaaccctttttttaaaacccaagggaaaaacccccttagtcccccaaaaaaaaaaattttttttttaccttttccccaaaacctggggggggagggggga

SEQ ID NO: 657396 - DNA, 604 bp, Homo sapiens
gtgtgtgtgtgtgtgtgtgtgtgtgtgtgtgtgtgtaagggctgtgggtgaggtgtgccgttctgggggaacagcgtgggaaggcagtagacgcgggcagtcagctaggcagagacctgtcggtcatggcaccgcctaatgatagtaccagtaccgctgtggagcgagcctgacagcttggaggtgctcggtgaagatcttggacgtctcaaactcgtagtcgtattagtgtggagtggcccgagatgagtgtagaacagagtgctaagggagcacattcgctgtcgtctgtcgagtgatcccatctgaaaaacaagggctcgatttgaccagcggacgagcttctgcgagatgataagaagctgacgagaatacagctgtggggggactaggttatccgtccgtgggtgaaacgggctccatctctcagacatccatctccgctgtcgtggcgggatctatcatgagacgcgaggtctggcctcactccactcactggtgtggggatccccccctgaatacgtcggagggtgtggccgctctggttcgatgagcaggagatgcgacagctatagttctggcaggaaccttgcatactacgagg

SEQ ID NO: 657397 - DNA, 151 bp, Homo sapiens
cactgtcctgtaagtggatgggtatgcggaagagcgaggggtgaaggcggattgggacaacagcagcaggtcagaagagggtggcagcatctcagaccacagccgagaggaagatgcgactaggaggaggctgccgaggaagacggggagg

SEQ ID NO: 657398 - DNA, 165 bp, Homo sapiens
tggctcttatctgtaccggtgctggtttatggtgaccttgaggtcgaatttattacacggtgagctgatctttgggcttagcatggtaccttgtcaccaccgacaaggtgccttggacttttccttcagctgtgactgtgaacacctcattttccttgggctctt

SEQ ID NO: 657399 - DNA, 1234 bp, Homo sapiens
  misc_feature (1234)..(1234): n is a, c, g, or t
accctgcgtggcaatccctgacgcaccgccgtgatgcccagggcacacgacacgggcgacctggaagtccaactacttccttaagatcatccaagctactctggatgattatccgcaaactgtttcattgtgggagcagacaatgtgggctccaagcagatgcagcagatccgcatgtccctttcgcgcgaaggcgtgtggtgctgcatgggcaagaacaccatgatgcgcaaggcccatccgagggccacctggaaaacaagcccagctctgcgagaaactgctgcctcatatccgggggacatgtgggcttgctgttcaccaaggcaggacctcactgcagcatcagggcacatgtcgctggccaataaggtgccagctgctgcccgtgcctggtgccattggcccatgtgaagtcactgtgccagcccagaacactggtctcgggcccgagaagacctcctttttccaggcgttaggtatcgagcacgtaaaatctccaggggccaccattgagaattcctgacgtgatgtgcaagctgcatcagcgactggcagacacagtgggagccagcgaaagccaagcatgctgaacatgctcaaacatcttcccccttctcctttggggctgggtcatccagccacgtgatcgacaatggccagacatctaacaaccctgaaagtgcttgatatcacacgagcgagactcctgcattcctcgctatcctgggaaagggatgtcccgaaattgtcgccagtgtcattggcttgcacaatgggcaaccaatagtgttgcattcgagaacccaattctatatcaaccggggcaacaactaggccctggcgagactgaggagaacggagctaacgtctcccactgctcaagaggcacgaggcccccagggcgaggaacaccgcacgtcccttagagggggattgatcccgatgggtgatgtgtgaccaccaaagatgaccatcgagtgatattgtgcccccagaatgatggttgaccccatgacaattaaggactgatgagccgatcatcgctgacgttcgctcatgttgatcgcagacacactctacactcgtttgtgaacagacagccgctctcttcctcaacaacacacgcgcgggtgcgtccgcccgaccgcatcatggctgcataacctccgatcgacgaggccagaccagtctagatctatttatttgatataatgtatgattatcagccgtn

SEQ ID NO: 657400 - DNA, 420 bp, Homo sapiens
taatagaggcatggggtctcactggggttggcccaggctgggtctggaaacttttggggctcaagcgatcctcccaaaacgctggggattacagtctatgagccacggggcccagcctaattcctggacttctctatacaggagtcttcactggataggcactcggtctggtgagtaacctcagttggagatatctttagacaacatggtttaagaatttatttggttgaacaagatgggtaagggaatcaagattatcccatatgcatttctggttagagcagaatttggatagcttagggtgcaatcttttggagaattaaatggtttacctgggcatcagatttaattaacaattatacttagtaatggcactattacttagttaatttcggtggttgggaacatatgggtagtaca

SEQ ID NO: 657401 - DNA, 122 bp, Homo sapiens
tctgcacaataacgaacaatttcttctctcgatcactccgctgtgtcaggcagttatagtgcttatgcctttctttagactattcgcttaagtccagtctgataggtcactcctttcaggga

SEQ ID NO: 657402 - DNA, 162 bp, Homo sapiens
tgtttcttatacctataagattaatagatgcttcctttgaaattcttctttggtatttacccttgtctagaatttgattgactaatccatggatttatgattagttggacatttgaatgttagttttccaataacaacaacagctaccaactattctgacat

SEQ ID NO: 657403 - DNA, 95 bp, Homo sapiens
cccccttttcccccccagggggccccccccttttttttgggggggggcccttttccgggggggcccccctttttttccggggcccccccgtttta

SEQ ID NO: 657404 - DNA, 692 bp, Homo sapiens
gtgggtgaaaccttcgggaaagggtataaataaggccttttgtagggccttcaagccgttatctagggaaagttacacaaaaaggtcgggggtagagcttgttaacaaggcggtaaaaaagggtaataggccacgtgcttccccttcacaaagtggttctgcaccttaaaaggaaggcttgatcaaccgtgggggtattcaacaacctgggggtttaatagacccggggaaaatgttcgtaacccaggaagtgcgttacccggtcggtctttgtaagtcattgcaagcagttgcctgctaaggagatccacccgataaggcgcagcgcacaattgtgcttcatgtaccctttcttcgtgcattaggtagatggcttggccacccttagtaagtttttgaaggggtttggcaaggtaaaaagacctgggcctttccgtaaggctgggaaggacctactccggggaccgtgccttcaaagacggtggcccgtttaaggcttttgaagccccgagccttgggaagcccagccagcctttccccttgaaaggaaaggtcctgaccgcagtaatttttccactcttctttttacataaaggtaaagggaaaaatgctaaattggagttgccccccccgagagggattatccttgcaggtttgaaataaagttgcacttgttttcactcgaaccggta

SEQ ID NO: 657405 - DNA, 254 bp, Homo sapiens
  misc_feature (15)..(15): n is a, c, g, or t
  misc_feature (18)..(18): n is a, c, g, or t
  misc_feature (230)..(230): n is a, c, g, or t
  misc_feature (243)..(245): n is a, c, g, or t
actgatccagagctncantacacgaagagagtatctattcacaacagagatgtaaaccaccaacaacacgaagagagttatctattcacaacagagatgtaaaccaccaacaacacgaagagagttatctattcacaacagagatgtaaaccaccaacaacacgaagagagttatctattcacaacagagatgtaaaccaccaacaacacgaagagagttatctattcanaacagagatgtannncaccaacaa

SEQ ID NO: 657406 - DNA, 1025 bp, Homo sapiens
gcagctgaaaacatggtcaagctctacagcctgttttctggaagagtacgattgcaaccatgatagaaataaagtccagtggtggacgattcatgatggagctgtatgtgtatggatgccaacatcacttgtgactctaaactgcaagcctatcgccagaaggaaaatctttgatctacgggactggaacccaggaagatgaaaggtataaagatgctgctaaggcaaatctcaactacattggcctcggatggaaatataggctagcctagtaaatggtgctggtttggctatggccacaatggatataataaaacttcatggagggactccagccaacttccttgatgtttggtggtggtgctacagtccatcaagtaacagaagcatttaagcttatcacttccgatacacaaggtactggctattctggtcaacattttcggaggactcatgcgctgtgactgtcacttgcacagggtatcgtcatggccgcccacagacttggaaattaacaatacctgtcgtggcacggctacaacgtacaccgagtcgactgatgctaaggccactgatagcggaccagtggacttcaccaatacttgcttgtgactgacttggcatgaagctgctaacaaatggtcgtaacagctctctgaaatcagtgaccttagcgaagcaagccccatgtggctgttcaacatccagttggcccatatgatctgacaacccagtggactgcctgacggtggtaaaatgtgctataacattacaaaatcggggtcctggatatcgactctcctcataactgggcggaattggaattggcatctaggcaccaacctccaagcattgggcccgatcatcgccccacaacgacgcttccacgcgttccggccactctcccgctgcgccgcacgctaccacgagcacgcagccgctcctggcacgccagcaggcctcaccaccacactttgcccacacccgccactcatccaccatccacccttcactcaccagacagt

SEQ ID NO: 657407 - DNA, 159 bp, Homo sapiens
gtaccagtgggcccctgtgcttcatttacaataacacttgtcacatttcctcaagtacttgcctgacatcagtatgtgtgacatcctcaaagacgcccccatacctctgtatcttcccttctcttactactacccctatgggcccctacgcaggtgtcg

SEQ ID NO: 657408 - DNA, 405 bp, Homo sapiens
cgctatatctgggtttggagaaagctacatctggggtcaaaggcagctacatccggggtcaggggcagctatatcgagggtcagagggagctgcatccagggtcagagggagctgcatccagggtcagagggagctacatctggggtcagagacagcagtggcattggtagagtagcagagacacagtaccatctgtgtccagtggtgacaacagatgcctcttcatgggaaccgtcctacagtatgcttgtgtatctgtggctacctattctccaagcctggttcttcatcctgctagagattctgagaactctgcactatcatttagcaaattccttttctgcttaaagagttggcttctgttgcttgtaactacaaaccctgaccaattcaacatctttaaa

SEQ ID NO: 657409 - DNA, 146 bp, Homo sapiens
tgcacttggaacatttgctacatcatacatgtccaaccatccttctcaacaaagtcacatcaacggagacttcacctagaagagggagacaataaaatacagaggtcctcagggacgagggagaaccacaggaaatagaatctact

SEQ ID NO: 657410 - DNA, 436 bp, Homo sapiens
  misc_feature (14)..(14): n is a, c, g, or t
gaggatcccgggcntcagtgatcctcccactcagcctccttaagtgctgagattataggtatatgtgtctactttctgtttctgtgaattgtctactctggatacctcatataaatggaatcacataattttggcttttggtgactggcttatttcacttagctagcattaatgcctttaagattcatccatgtagtagtgtgtatcagaattcccttcttttggtggctgaatattctgtggtatatatagaccacatttggtttatgcattcattgggtgatggggatttgggtggctttcaacctctgggctatggtgaataatgctgctgtgaacgagggtgtgtaactctctttgagatcttgctttcaattcttttagacatattctgaaggggatggctgggtcatggtaatcctatttttaattatcc

SEQ ID NO: 657411 - DNA, 176 bp, Homo sapiens
atgtatttgtgataattcgcatactgcccatttgagcaaaaagccggttatgcgcgggcaggcctcctagggagaggagggtggatggaattaagggtgttagtcatgttacgcttgtttcacggtgcgagatagtacgtagggtcgtggtgtatatccggggtaccgcagctcga

SEQ ID NO: 657412 - DNA, 277 bp, Homo sapiens
ggcaaacaggttgagaaggagtatgttccaattggaagatcatttgaagggggctcctgccacctgctaagtagcagttcaaactaggggtttggtatcaagtcgctgaatggaagtatgaggtagggtccctctgaaggtgaattctgagatctcagtaaaagaaattgctgtgcaatgtgtatttcgtaagtgctatgctccgagaatcaatggtgtattatgcccaattcccccagtatggtagagcaagtcttgtgttaaaagcccagaccac

SEQ ID NO: 657413 - DNA, 96 bp, Homo sapiens
gcaaaaagaatgtgttgaaatttaactttgtaagcttgaaaggggggggtgatctttttttttccttacagacacccataataaaatatcatatta

SEQ ID NO: 657414 - DNA, 368 bp, Homo sapiens
tagaggatcccccgtcgacctttgaggatgtcacccaggtgtcctctgcctactcagaagacagtacctgtcgaagctgtgaccggcaaaacaagtaacatcagagctaactttgaaaacctcgctaaggagaaagagcaggaggacaagcggtcgaatatatcacaattcatctttttattgaatttgaaaccctgcaaacaccacgaatcgatactaaaaaccctcgttatcaataaagccggcaattaaaaaccacaatgagcgcaaggagcaccctctttgccctcacgatgaccctcactcctgcacaaaggctgggtggtagcacacttcgccacggggtatggcggagcggtcgacggacg

SEQ ID NO: 657415 - DNA, 453 bp, Homo sapiens
cacgcctgccttggcctcccaaagtgctgggattacaggtgggaggcactgcgcccggctggagaataattattactgttcacggttcttgggctcctactatgtgctgcgtgctccatgctcagcctctcagtcctcattcctcgtatatccacctagatttgaggatgagtggcctctcccatcagccacaatcacatgcagtttctcctctatcctcagctcagggagcatacggacgttgcgcagtgaatgcagctggctggggaaggctcaggaaccgcacccaggaagcccacctacagatcccacctcaaaccacgacatgctgcagcctccccagtggccagagcagcttaacaaagcatctttgtttcctttctgcaccccagaaaatagctgtgttggtctcttcgccatgcagagtgaataaagaataagacaaacaccaaa

SEQ ID NO: 657416 - DNA, 332 bp, Homo sapiens
ggccaggcattcacgtccacctgggccaaatagtgacacctcgtgctacaaagaaatattaaaacttagctggatgcagtgactcacacctgtagtcccagctcagggagcatacggacgttgcgcagtgaatgcagctggctggggaaggctcaggaaccgcacccaggaagcccacctacagatcccacctcaaaccacgacatgctgcagcctccccagtggccagagcagcttaacaaagcatctttgtttcctttctgcaccccagaaaatagctgtgttggtctcttcgccatgcagagtgaataaagaataagacaaacaccaaa

SEQ ID NO: 657417 - DNA, 87 bp, Homo sapiens
cttaacacagagcaacgaatagtacattaatttctttctcttcggtattttctctgggtgacagagccatcactctgcacgcgccag

SEQ ID NO: 657418 - DNA, 432 bp, Homo sapiens
  misc_feature (207)..(207): n is a, c, g, or t
tgtgcagatgctgaacggctcgggcgtatcacggcaaggaatcctgagtcttgtctacaatatgctcaggtgcatgtgcgccaaggtcaggcctcaagatacagtctcagtctgtcacacaggctagagtacattgacacaatcggggctcaatgcaacataagtctcacgggatcaagtgacgtcagccttgcaagtacccaggtnacacagtgcatgtcaccatatagagcaatactgtgtccaatgcatagagatggagtctcagcaagaagcacaggctagtcgtctccaactaatgggatcaatcaatatgatagcctgggtctcgcaaagtgtcaaaaagatacgcatcagtcactgcgcctggccgaaaggcatttgaaaagcatccttctataaatggcgctatgtggtctattaccactaaag

SEQ ID NO: 657419 - DNA, 384 bp, Homo sapiens
tattgagtcctttcatgtttcacatttccttgctttttcatgtttcttttgtccctgcattgatgtctggcatctggcgaaacaatggcgtcttcccatttttctacagccactttcatagaggctttcacctgcacttggtccttagtgtgctagttgagaagggcgtagtaactctgcttccagataagtgaaatgagataggctttgttcagctttatcaacagcatttaatgatggcagtaactttgttttcctcagtggcctagcttgtaaaagtttgtagcagtaatggcataggctgttaatggcaagggcttttttggacgcctcctatttacattcgccccacaatgaaggtacttagccatgaagatacttctt

SEQ ID NO: 657420 - DNA, 948 bp, Homo sapiens
cagggacggaaagcgaacgcaacagcaaggcacaagcgacgaggtaccgccgccccgacgtatgccgcgttaccgagttgttgcgcccccgctggcaacacgatccggacgaccaatcgggcccgccgttaacaaccgtggggaaagaagcccgctgggtgtatctccccccggacggcggccggtcgcgcatgaagatgtttagccggtgctgtgaagggccaccgtttacaacaaggggcgggccctctttaacttacgggaaggcggcttaaaattacagccatataaacgctggtagtagtaataattttaaaccggggcaagcttgccccgtttttagcccacgacgacattccccgctggtgtaggagcaagtcaattggccccttttaaacccccatggttgtcaagataacacagagggccacaccaggtactaactttggcgccttccttcatcaccttcggacttaatgatcccccgtgttgtcaaaaagtggtgtctttcttataccaatttcttacaaaacaccttccaatcctggtgtattaaactctcaaacatataaagagactatttcacacccccctcgcccactctgtgcaaaagattattaacaggtacacacggccgtttttcaaaagtgcgccagagttcaatggcaacatctcttggaatcatgtcctactcaaaacttagacagcccccttacagcagatattgtaagcggtgttcttcttgtcaccccccctcctgcgtacccagacacacggatggagacatcggcaacattaatattggggaatcggtgtatttccccacaccatcaaaggaagcttcttaactctcccggaagaaaagaaccccacacatctattaatataagtgggcaggtacaccccgtaaaaaaattaaaaagaaacccccaaaccaaccacaaaaca

SEQ ID NO: 657421 - DNA, 150 bp, Homo sapiens
gtccaccactactggccatctgatctataatgcggggcatcgacaaagaccatgaaaatttcagaggagctctgagatggaaggctctcaggtatgccggcttggataactgaagctgactgacggttcacatgatatcctggaattgac

SEQ ID NO: 657422 - DNA, 269 bp, Homo sapiens
  misc_feature (124)..(124): n is a, c, g, or t
  misc_feature (151)..(152): n is a, c, g, or t
  misc_feature (160)..(160): n is a, c, g, or t
aaaaagaagggtcagaggtcaggaaggagaacctggggagggtgtgtgggaagaatggagaaattcaggctgggtgcagtggctcacacctgtaatcccagcactttgggaagccaaggcaggnggatcacgtgaggccaggagtttgagnncagcctgnccaacatggtgaaacccccgtctccactaaaagtacaaaactgagccgggcactatggcaggcacctgtaatcccagcttacctgagaggctgaggcaggaggaataac

SEQ ID NO: 657423 - DNA, 115 bp, Homo sapiens
taataaaaaactattaacccatataatcttccccaaaattcagaataataacacactcgaccacaccgctaacacgcaagaatttacccccataaataggagaggggctctcaaa

SEQ ID NO: 657424 - DNA, 224 bp, Homo sapiens
aaaaagaagggtcagaggtcaggaaggagaacctggggagggtgtgtgggaagaatggagaaattcaggctgggtgcagtggctcacacctgtaatcccagctactcgggaggctgagacaggagaatcgcttgagcctgggaggaagagggtgcagtgagccgagatcgtgctactgcactccagtctgggtgagagagtgagacgctgtctcaaaaaaaaaa

SEQ ID NO: 657425 - DNA, 218 bp, Homo sapiens
  misc_feature (29)..(29): n is a, c, g, or t
  misc_feature (118)..(118): n is a, c, g, or t
gaattcggcacgaggcagggctttccccntgtggagtctgtcagactgcattaatagccaggtaattgccatatgttctaaggcttgagaatactcaaagtcttgactttaaactttntgacaatgctatctctcattacctgaggccacatgcagaaattactcaatatttcctctactaaacttcctctccggtttacacccttgttcctcctccc

SEQ ID NO: 657426 - DNA, 241 bp, Homo sapiens
cgcttccttcacatgcaccacatcataagaaccaggatgtctatccctgtggtgatcacaccaacacgaccgatgttggctccaccaatcaccatacacgaatagcctgtatcaaatctgataaagttgatcatcttgccggtccctcaatcaatctgcacaatatcgttcaccttgatcacaggatctgggtagcgtatagttcgagcatcatgagtcaccaggtgagggattcccttca

SEQ ID NO: 657427 - DNA, 224 bp, Homo sapiens
cattctgctcctcctatgaacacatacaccagaatagtaacccacctactgcagacctttgcactggccgtggggtctgtaacactactatatactacctgctctcggccacctagtcatgacaccacattgtgattctatatgcggcccttgccactctccaatagtttatttatttagatattttgttggtggccacctcgcggttcagctcctctgtcttg

SEQ ID NO: 657428 - DNA, 780 bp, Homo sapiens
aggaggctctaccccggtggctcctacttcgacccgctgggtctcgcggcggacccggagaagaaggagactctgcagctggcggagatcaagcacgcccgcctcgccatggtcgccttcctcggcttcgccgtgcaggccgccgccaccggcaaggggccgctcaacaactgggccacccacctcagcgacccgctgcacaccaccatcttcgacaccttgggctcctcttaagtggtcggtggtcgagcaatttctgtcagctcggctgcaaaatggacgaacgcgcgtccgtgtaacgaacgtgcttttcgtttgtatatgacgagtgatggatgagagggtatcgcaaagatcctttgttgagtaatgcaggtctgatcacataggagagctgctgggacttggtgatttgtaaaatatgaaccaatggtgacttaatgcatccacttgtacatcaaaaaaaaaaaaaaaaaaaaaaaaaaaaaaaaaaaaaaaaaaaaaaaaaaaaaaaaaaaggggggggggggccaaaaaattcccccgggggggcgcccacaaattgcacgcaccaccccgcagtttgtcgtgcgacaacaagagggggcgcccccaataaggaggagcgcgcaataataaacagcagccagcccgcggcggccgcgaggattaacaaagacacggtggggggggcggaaaaacgcggtcaccgggcgacactttggggacaaaaacccccctaccggggggggggcgaacacaaagtggggacaaacacgc

SEQ ID NO: 657429 - DNA, 163 bp, Homo sapiens
cagataaaagctaagtcttgaaatgacacttgcttagaagtttgtcccaggtgtccactccgtcactcacctgcttggcatcctcattgcaggctttaactcatcagccctgtggcctttcttgcatggaagtgctggcgtattaacacgtgcagtgtgcagc

SEQ ID NO: 657430 - DNA, 794 bp, Homo sapiens
gcgggtggccgttgctccggcctccgtgggccttgcgtgagactcaccccttcagcgtcgctggccgcagctcagctcttactgcagggccgttcctgacgagcgtgtccatcctgtcacgggacgtatgcgcgtgcaagacatcgtccgttcgccaaaaagctaggtcgccgccacctgggtcgcaatcgtgggcggtcatatgtgcgcagatggtggacgtccagttatgatgaggggactaccatccaaattgctacaatgcctctggaagtgcgaacggcagtggcagaccatgacgtggtttctggagtgtggtgccagacatttgggtgagagcacagtaaggagctattgctatggatggtacagaagtgcttggttagaggccagaaagtactggattctggtggaaccaatcaaaattacctgttggtcctgagacttcgggcagaatcatgaatgtcattggcagaaacctattgatgaaagaggtcccatcaaaagcaaacaatttgatcccattcatgctgaggctccagagttcatggacacatgagtgtagagcaggaaattctggtgactggtatcaaggttcgtcgatctgctaggctccctatgccaagggtggcaaaattgggcttacaggtggtagctggaggttggcaagaatgtacttgatcatgggagttaatcacaactgtcgccacaagccatggttggttactcgtgagtaatgctggtgtaggagagaggaccgtgaagggcagtgatttataaccatgacaatgatc

SEQ ID NO: 657431 - DNA, 1061 bp, Homo sapiens
ggccacagtctccgtgctctgtacgttttccaaagtgtgtccggccatccttgacgctgtgtgttccacgggctccctttcaggccccaattttgggtcggaaactgtagacatctccaagacaaagttttcggggactgctcctgaagatgatgcggaagacgccagagtgggttcactgcaaggaactggcctccatggacgagccaagggcatcccaggacaacgctgtgaaatcgacccccgagtgtgactgggaaaggagaacttatgccgtaaccaggaaactgggaagctcaaaatacagagggtgaacgtagaaacacgcagaaaccattcctaaagaaagtagtgatcttgtattaaattgagcagaagtactcacagatttttaccattcctgcttataaactagtatcttgcttgatcttagtccaattacagaataatgatttccactggacagtagaaaaatatgtgtaaaatagggaagaaagttagtattggatcagtgtgagtcctgaagacgtttcagtgctgtgagaacgacatccactttagggtatacatctcgctttgtaagtcagagggagcatgtcagtcactcgtgcttctcggtggcctctgagccatggtgtcgaagtgaagagtagttcattagtttagttacaacctttgtgaagtcagcacatgcccgcaaagcgtgctgtgttttagtcctggtaggaatatttatcagagttcacactatataaaacgccaacagcttcaactatggcccgttgtcaacagtgtttgccactgacgcggatagaaacggtttgcagtctactggatggatgtgtattgtggtttgtaaccattgatcggtttaaaacatgggttaagaactttgccgctaataacagaaattttgtgtagggaagggataaactagatatagatacagagcctgtttttgagttttagacacctttagttgtaaataacttaaaatagctttagtgaaacagtgcattctgtagtttctgtcctttcagtaaatgtggatgtcaatgtat

SEQ ID NO: 657432 - DNA, 303 bp, Homo sapiens
gaaatatgcacacaacgcagggggaaactgtccgcaagttataaagatttattgctattccaggcttcaagattatcccagaactcagggctgttgtgtgtttcataatttgttatgatgtatcagggtgatacaaaaatccaggcagtttgatttctaggccaccctctcttccttggacccctgctccacagatgcagctgtctggtgaggctctttcccatctgcctcattcagcccaacaggactccaagactgaggcaggcagccttgttatccccacagctcacaggtgcttgcctt

SEQ ID NO: 657433 - DNA, 397 bp, Homo sapiens
gcggtcgcgtcatacacaggcatacctctgagatattcaggtcggttctagaccacaataaagtgaatatgcaacaaagcaagtcagacgaatttttgggtttcccactacatataaaagttatatttatactatactgtagtctattaagtgtgcaatagcattgtgtctttaaaaatgtatttaccttaatcttgaaatattgcttaaaaatgctaacaatcatttgaactttcagtgagttgtaatctttttcctcgtggagggtcttgcttcagtgtagatgcctgctgactgatcagagaggtggttgctgaaggtggggtggctgtggcaatttcttaaagtagacaacaatgaagtttcacttttcttttcataaaagatttcttggtag

SEQ ID NO: 657434 - DNA, 137 bp, Homo sapiens
  misc_feature (34)..(34): n is a, c, g, or t
  misc_feature (39)..(39): n is a, c, g, or t
  misc_feature (124)..(124): n is a, c, g, or t
ggctggggaacatcgggcagcatgagcgcatcgngcatnttcctgcgcaccacggcatgcggcatcgtgcctgccggggtcatggtggtctctaccgcgaaccggcggcatactgcgcaccaanccgcctgtacgag

SEQ ID NO: 657435 - DNA, 868 bp, Homo sapiens
  misc_feature (770)..(770): n is a, c, g, or t
  misc_feature (789)..(789): n is a, c, g, or t
  misc_feature (833)..(833): n is a, c, g, or t
aactcacatggactgtcctccctcagggcttcagggatagccctcatttctttggacaagctctagcccgaaacctcacttccttaaacctgtctcccagtcatcttcaatatgtggacgaccttcttctttgcagcccctctctaaaagactctcaaactcacacggccactgctctcttaaactttctcgctatcaaagggtatagggtctccccctccaaggcccaactctccatctccatgatgacttacttaggaattcaactttcccctggggcccaggctatgactccagccagggcagcattaatagaaaatctacccccaccctcctccaaaagcgaaatcctttccttcccagggctagcaggcttctttagaatatggatttccaactttgccctcctagctcatcccctctatgaagtggccaaaggccctcccaatgaacccctaaacccctcacataacatactccccagcttccacaaactccaaactgctcttgtcactgcgtcagctccgtccttacctgatatctcccaacctttcactctctatactgctgaaagctgaggaatagccctcggtgtcttaggacaacagaaaggaaatcctccttcctttgcccctgtagcttacctctctaaacaactagataacacagtcaaagggtggccagcctgctttaaagcactagaagtggtagccagcttagctctagaaagcaggaaactaactttcagccagaataccaccgtccacagntctcataatctacaaggancttcttttctttccaagccagtaagcttcctttcttcctttcangaattaaatacttcatggccttctttattaaaaat

SEQ ID NO: 657436 - DNA, 761 bp, Homo sapiens
ggctggggcgcgaagcggggcctattatgacaaaagcctatcgaccccagcagccagcacagggtcaggctgctgggcgtcgactaggcttttgtcactacctacgggcacgcagatgacttgcattccccagctttccaccaaaccaaatttcaacacattcatctgcttactccggtatacagaacattgctaacacttattaacacgttcccgtgaacgacgcgtgtattaacatcacacagatcccatatttgcccgacaattgacttatggcccagtcacaatctcatgtataacatattgatacacacgaggacccaccttaacgccacagctgcctgagttacacagggccttcacctgcgaaccacctgtgacagatacaacaaggcaaatgctccccaactctcttgggccaaggatcccgtacgccatctgcgcctacctaagggaccacgaacgcttgcatcccacaattacaggacaccagtacttacacactcgctgaacgcccctcacatcttaccaaaatgtaacataaaccactttgtccacttacactcattaattcatgcacaccccacaacccatgacaacggcttacacactaattgcctacttcccacacaacttactcccccaccacccccatgaatccactcaaacccaattcacacagacttcatcccacactcgcacgccactacatcactcccttcactccacctctaccacctgcacccacacatgccccctct

SEQ ID NO: 657437 - DNA, 462 bp, Homo sapiens
gtaagacagggcatatgtgtatgtaggttttatctgggctcatctgttctgtttcatgatctattttttctgtaggggaccaataccacacgggcttgattactgtggctttatagtaaaagtactgaaatcgggtactatgggtcctccaaccttgctcttctctttcaatattgagttgactattctgggtcttttacctctccttataaacattacaatcagtttgctaatatccacagaataacctgctgagtttttttcgttttttagagacagggtcttgctctgtcagccaggctggaatacagtggcatgatcataacttactgaaacctcagactcctaggcccaagcagtcctcccacctcagcctcccaaatagctgggaatataggcacatgccaccaggcccagctaacaaaaaaaattttattggtagatatggggtctcactatgtt

SEQ ID NO: 657438 - DNA, 290 bp, Homo sapiens
  misc_feature (123)..(123): n is a, c, g, or t
  misc_feature (145)..(145): n is a, c, g, or t
  misc_feature (193)..(193): n is a, c, g, or t
  misc_feature (196)..(196): n is a, c, g, or t
  misc_feature (243)..(243): n is a, c, g, or t
  misc_feature (249)..(249): n is a, c, g, or t
  misc_feature (284)..(284): n is a, c, g, or t
  misc_feature (286)..(286): n is a, c, g, or t
ggaaggtttctattcgttggttgtggacctggacaaagtccaagtctgtggaacttaaaaccttgaaggtctgtcataggactttggacaatctccccccttagctattcccagggaaccccngggggcaactgacattgctccnaaatgttctcctgatgtagctttagatataaaggaaaggccctgcccnggnggctgttttttgtttgttatgtcaaaggaacagtcctgttcaaaaangggctnttttgagcaaaaatggctaataaactttgtgctgntntgga

SEQ ID NO: 657439 - DNA, 267 bp, Homo sapiens
cggttgctcgttgtgcttaaccatctgcggccagcacgcctcttgccctgtagcatgttacagcttgcacatttggtgtcttctgccgttggcactcgctgtcagttggtgctcgccgcagatctcaaagcaggcctaagggttatttaacctcaggaaaccttcttatctctacaaatagtacccttctgtgccaagctcatgtactagagtacatttacaaagcctccttagagtgggtaaaaatctagcctcgtagattaccgt

SEQ ID NO: 657440 - DNA, 106 bp, Homo sapiens
acattatctcccataaacaagtaatttgtatctggtgatttgccaccaattctaaacagttcctatagatcagtgaaattgcccattgcacagtctccactagaca

SEQ ID NO: 657441 - DNA, 211 bp, Homo sapiens
gcctggggagtgggtgttaggtaacagcagccctcacatagtgggggtcccttgggcgggtggttaggtaacagcagcctctcaacatagtaggggttcccctgggggcagacagttaggtaacagcagcccctcaacatcaggtggttccctaggggacagttaggtaacagcagcccctcaacataatgggggcttccccttgggatca

SEQ ID NO: 657442 - DNA, 190 bp, Homo sapiens
  misc_feature (99)..(99): n is a, c, g, or t
cggtgcctctcgacgactcccggtgttactcgctgccacaccgtggggccctgggaccggtcctctgacgtgttccctggccccaccgtgtgtggtgtntgtgtgtctgtgcctggccccgggacggtgccccacctgggcttgcacacgcccccggacgacggacctttgggggggtaccgacgctcga

SEQ ID NO: 657443 - DNA, 1307 bp, Homo sapiens
gtacagtacacacaatgcaattatgtacgccttttatcaaacgacttaagcagccaaaaagcttatgtcatctctccaggggggaacaacgtggtctagttcccttctgtggtctaaatgttccaaaacggtggatattgcataagtacatgtgtgctattgctgcaccatggattaaattgccgtttatttcaagaaattaagacaatgtctcaattttctatatcattgtatgtgtttcccccgctgtgtccagcagcattcgaagaactcccgataagaatcaggggagttcatactacaaggaagctgaataggagaaaaccctaagcagcattctgatccttaagctgactcttgagccctttggtttcgtagaaaagaggcgacttcgctttcagtggacttggtggttacttacgttagtgctatagacgggagccttttttccccatacttttttcgcccgaactccgagttctcgccgcgaattagtttggcccccatcttatttcacactttacacacttgctattgcctctatgtgctctcggggaaacgcccctgagtacaagggttcccttgcctttcgccctttacccttaacgcacatcctttccccccccttgtcaccttgtggataacgcccttatggccgttactaaagccgggggtaagcccagcctctacctttcccttattgctttgcgcaaacaagggattccattaccaacttctccctaaccggagattgctggggggccttgaagggatttccgttaccgtggattaaccacgaagcaaccttgaaagccgtcataactcggccccaactcacacccactctcggaagctccaacggtacacccacatttgacaacctcaccaccctccatccagccaatacccacaccccattcaacactcatctcacccccccctcacaccccccccccccttccagtcaccactccaaccagcacctcatacgtccttccccaccccaccccctccttctccccacccaacacatctccctctccaccacaaaccccacctctacaaacatcccacctctccctcctgccataacctcccaacctttacaatagtcataccatccttctccccatgcccatctgccccacacaccgtcccctctctcctctccccttttttcttttcaatacaaaaaccccactcttaacatctgtctttctttactctatcctaaattcacccccatctcaccctcttctcccctctcactcactcatcctatcctacacttatttcatcactccacc

SEQ ID NO: 657444 - DNA, 139 bp, Homo sapiens
gatgggtaagttccgaaaacaacaaaatagaaccgcggtcggtcatcgaaaccctttagtttgccaccacctcctgcatcttggggcggctaatatccaggaaactctcaatcaagtcatcgtcgatagggtttgatga

SEQ ID NO: 657445 - DNA, 275 bp, Homo sapiens
aatgagacatattgagaagtagaatgagaattcataggtagggacctagggccataagtcactcaccaagatgagtactcatctcccaggccctcagcctttgctgtctgctttgccacaaggagtaggtctcctagaagctgctggtcttcttcttcagcctggctgatccgaggaatgggcttcttaggaatgaccaggaagtgcacagtgagcctgaggggtcatatcacgtgaacacaatacactgctgatcctcatgagtcgagcgggta

SEQ ID NO: 657446 - DNA, 244 bp, Homo sapiens
ataggcatgatgggtggatccgaggtcgtaacagcctggccagacggtgaaacccccatctctactgaaaataccaaaaaaaaaaaaaaaataagccaggcttggtggcgagtgcctgtagccccagctactcgggaggctgcggtaggagaatggcttgaacccgggaggcagagcttgcagtgaccggagatcacgcccgctgcattcccagccctaggcaacagagccaacactctgtctc

SEQ ID NO: 657447 - DNA, 245 bp, Homo sapiens
  misc_feature (123)..(123): n is a, c, g, or t
tgcctgcatcccagctactcgggaggctgatgcaggagaattgcttgaacctgggaggcggaggttgcagtgagccaagattgtaccactgccctccagcctgggcaacagagcaagactctntctcagaaaaaaaaaaaaaaaagtttaaatttctgcctaaagaattgaagtttttcaatttctaccttaaaggtgttgaagttccaccagaaattgtttggcagtttaagaatcatgagaag

SEQ ID NO: 657448 - DNA, 546 bp, Homo sapiens
  misc_feature (531)..(531): n is a, c, g, or t
  misc_feature (537)..(537): n is a, c, g, or t
aattcgcggccgcgtcgacacggctgcgagaagcgacagaagggccagatggtaatgtgtaggttcaagggtattgtgtgtagcaagtgaagattgcagaaataaaacttcagttcatgcttgaaatttaagtattgttgtgatgccagaattgctgctcaccgtttttaggtttcaggtcctctgacaccttttggtatcgttaattttactgatttgtgtagaatgtcagttgtattttaccagctaatatctagaaatgctggcaagaggggtttactccagcttagatgtagtatgttagctttttcatacagtgtataaattacgagtcagctgctgaataagacagagcccagaatttaacatgtgtagcttagttgtctaaaagttaggcctcggcttcaaagttagggtcacggcataatcttgcgttcagtacaacacatggtttgatagggaggggaggggcctcttttgcgaaggggaaagtatgacaggaatgagagctatggtagccatgtataaggnagtgcngaatgttgg

SEQ ID NO: 657449 - DNA, 690 bp, Homo sapiens
  misc_feature (99)..(99): n is a, c, g, or t
  misc_feature (272)..(272): n is a, c, g, or t
  misc_feature (275)..(275): n is a, c, g, or t
  misc_feature (277)..(277): n is a, c, g, or t
  misc_feature (296)..(296): n is a, c, g, or t
  misc_feature (313)..(313): n is a, c, g, or t
  misc_feature (346)..(346): n is a, c, g, or t
  misc_feature (354)..(354): n is a, c, g, or t
  misc_feature (361)..(361): n is a, c, g, or t
  misc_feature (363)..(363): n is a, c, g, or t
  misc_feature (365)..(365): n is a, c, g, or t
  misc_feature (373)..(373): n is a, c, g, or t
  misc_feature (383)..(383): n is a, c, g, or t
  misc_feature (459)..(459): n is a, c, g, or t
cctctttaaaggcaaagacatgccagcagtgcagaggacctgatggctttgggcagcttgccagtgaccaagaatgatgggcactcgtgggagatccanctgtgtttattaaaaaagcgcaggagcataagaggggattcccagagagccagctgcaggagggaaagcatgtcattggccttcagatgggcagcaacagaggggcctcccaggccggcatgacaggctacggacgacctcgcacgatcatcagttagagcggagagggctanccntnagcccggccctcccccagntccttggtgcagccatnccgtttagcctgcctcacccacacccgtgtggnaccttcanccctggncnanttttaggntttgtcattnagcaatggtaactgcacctgggcagctcctccctgtgcccccagcctcagcccaattttttacccgaaagcatcantgccttggcccctccctcccgggtgcccccatcacctttaatgtttcctccctgggctaaacaggggaaaaacgggctgggggtagcctggatgtgggccaagtcccctgtcctccttggcggcaaaagcccattgaaaaagaaccagcccagcctgccccctattttgtcctggaaaatttttggggttggaactcaaaaaaaaaaaaaaaaaaaatcaatcttttctca

SEQ ID NO: 657450 - DNA, 427 bp, Homo sapiens
cgcgcgtctctcccaaattgtgcaggggccacaggagggtcgtcaggagagaatcctgactcgtgatgcagtttcatgaataggaagagctttggtccgtggcatttctagtccctcttttggtctattagaaacaggagagtcggccgggcgcggtgggtcacgcctttaatcccagcactttgggaggtcgaggtgggtggatggcgaggtgaggagttcgagagcagcctggctaatatggtgaaccccgtctatactaaaaatacaaaaattagctgggcgtggtgcgcgcgcctgtaatcgcagctactagggaggctgagacaggaaaatcgcttgaacccaggaggcggaggatgcagtgagccgagatcgcgccattgcactccagcctgggccacagagtgaaactccctctggaaaa

SEQ ID NO: 657451 - DNA, 1506 bp, Homo sapiens
cgcgttcgaggtccgtatctttccctactccataaagtcagtccctaatgagacaatttcctccagctagatagggagctacatcagcttagttccgaattaccagagaggtctagtgctgaagattgatggtttagcttgctgtcatggatagttatgacaaacagacgtagcgccagtaatactcttgactcctgtaccttcctctgctgaaggtaattcgttaacacagagtggacatgtagttagatcactacagccatcagcactgtgtgtggttactatgtgatactcataccttagcatggcgtaacagaggtgtcaagttattactctggtcaattcattccagctcagctgagtgtgaccaccgaggtgaattgctcattcttgatctacagctgaggaaatcaccatcctgggtacaattcacgacagagccacatctcactttgttcgaaccgattgctctctctacattgctcacgaacttcaacatctaatgggaacgcaccagtgacgtgctctccctcacattcactatttggtttagcacaatctccatttgcacgacacacgatgaacccatttctccgcttgcacctagcgcaagacattcatatacagattcatgtacaatagggtcacaggtacaaatttactcaggcacgcttttactactgacacacttgttcccattcatacattaccatggtatcacttgagaggggtcgggctagagacctagttgcacaagctatggataccaacctatgataacttgccgtttttgcgtcggcgccacttacattgttcaacagtgtccatttcaccacgcaatataaatattggcgtcggcgcgctataaaaagtccctctgccaagtagagacatggagctcccggagcagccgatattaccgtttccacgtggagtgatacgctcccaatgccgcgccaagagagacgaccggtttcaaccgtccttgtcactaattatttactcaacttttgccaccacacttggtgagatcgtagataatacggagaaacccattatattgtggatgcatatgcaaagggaagaaaccccacagatccaacttgcaacccagggatcattgtcacccagggtcactttgagtgctgagcgccgctgcggatttaacatctagagatgtggcacccgcgcgtgttcacaagaggttaacagcgtggcgaaagacaacacttaggcaaagacgcggagtgaacctccccaagcttggtgtcaccaggcgcatcaactatcaaaggactggtgatcaacacggggaggagcaacacacattcgagacgagacttccccaacatcgggccgacaccaacacgcgggagaaggcccacggatcaaccatggatggcaccacgcgcagaccacagtgtgagaacgggacagacacagagcgagatcgccagcaacaaaaacgagacaagacaacacgacggcaggcatgacgagcacatg

SEQ ID NO: 657452 - DNA, 1018 bp, Homo sapiens
gggtgtgtctctccccccctcgtgtgtgtggtcactcaccgagaatacgcctcgcggcgcgtgtgtggatttatctctcctgcgcgcgccccccccgctcttacatagttatgctacgcggcgcgctcgtctgtcgaggtgtgttctcgcgacgtgcgcgcgggcgcgggtgggcgccacatattttgccgcgcacgcgcgcggggagcaccccgcgtggtagaagacagaccacactctctctcgcgggagagatagtagtagagagagctctcgcgcgcgagatatatatatcttgtctgtgagagatatatatagatatatagtatgtgggtacacactctcccccactcgcgcgcgatatatatcttttgtgtgtggcgcacacgcgcgtagagagaaaacagccccgctctctggtgtggagagagagagtgggagagcactccgcgcgcgaatatatatgtgtgtgtgtgagagatatctcgcgcgtcgcgtgtgtgtgtagagagagttgtgtgtgtgagagaatatatagaaagagagagagaggagagaagagatatatcccagtgttttttttctgccccacacatatatagtagtgtgtgtaacacatttttatataaacacacccctggaggagcgcgcgtgtgagagaaaagtgtgtgcacacacacaccccacacagcagagagagagagagagagagaaacaaaaaaggcgcccacacaaaaaaacacacacacacccacacacacacacacacaccgcagggaccccgcggcgcacctctctatataggtgggggagagagacgacacacaccttttcccacaagaatcccacacacccctctgaaaagagagagagaaaaaaaatatgggggtataaaaaaaaaaaaaaaaagagagagagagaaaatatatcttttttggggagagaggtttttccccgggcgccccccccggttttcttctcttcctcttctccccccccccccacacacacacatata

SEQ ID NO: 657453 - DNA, 286 bp, Homo sapiens
tggagactagggctgggaatggggctctactggtaaccaaagaatgttgttctgcaattttgcttgtctcttgactactctccaccctaaggataaaacatggcctgagcaactgcctagaacaggcaatctccatgggctgtgttgctgcacttggaaggcagtgacttgcatcaggttcttagtctcttgaggctcttccgggtaggaggaggtggtggagaccaattttgacgctggagctgctacccccgtgcattgccaaagcccaccccttccggtggag

SEQ ID NO: 657454 - DNA, 178 bp, Homo sapiens
actgttgaaggcctgagactacctcggactcctctccttcggcaaggtcgaagggggttcggttaggtctctgctagtgtggagataaatcatattatggccaagggtcatgatggcaaggagtaatcagaagtagttcttgtagtagtgataacgggtggagacggttaaacggagc

SEQ ID NO: 657455 - DNA, 620 bp, Homo sapiens
  misc_feature (37)..(37): n is a, c, g, or t
  misc_feature (227)..(227): n is a, c, g, or t
  misc_feature (243)..(243): n is a, c, g, or t
  misc_feature (252)..(252): n is a, c, g, or t
  misc_feature (259)..(259): n is a, c, g, or t
  misc_feature (279)..(280): n is a, c, g, or t
  misc_feature (286)..(287): n is a, c, g, or t
  misc_feature (350)..(350): n is a, c, g, or t
  misc_feature (362)..(362): n is a, c, g, or t
  misc_feature (395)..(395): n is a, c, g, or t
  misc_feature (400)..(400): n is a, c, g, or t
  misc_feature (425)..(425): n is a, c, g, or t
  misc_feature (427)..(427): n is a, c, g, or t
  misc_feature (435)..(435): n is a, c, g, or t
  misc_feature (479)..(479): n is a, c, g, or t
  misc_feature (498)..(498): n is a, c, g, or t
  misc_feature (538)..(538): n is a, c, g, or t
  misc_feature (572)..(572): n is a, c, g, or t
  misc_feature (577)..(577): n is a, c, g, or t
  misc_feature (579)..(579): n is a, c, g, or t
  misc_feature (589)..(589): n is a, c, g, or t
  misc_feature (591)..(591): n is a, c, g, or t
  misc_feature (594)..(594): n is a, c, g, or t
  misc_feature (597)..(597): n is a, c, g, or t
  misc_feature (603)..(603): n is a, c, g, or t
aacacgtccccggggagcatgaataatttcagctccnacacaccaaactgctttaaggtcactgtggagctgtcttgtgacaagttccctccagaagaatgaattgccccaggagtgggagaacaacaaaaacgccttcctcacctacctggagcaggtgcgcatgggcattgcaggagtggtgaggcacaaggacacgaagtttgggattgctgaccctgtcattnccgtgaatgggattanccatacgtnacccggngtggggcggggattattggnntttctnnccccaggggaatacatggtgactgccagtgccgagggctaccattcagtgacacggaactgtngggtcacctttnaaaagggccccttcccctgcaattttgtgctcnccaanactcccaaacaaaggttgcgcgagntnttggcagntggggccaaggtgcccccggacctttgcaggggcctggagcggntaaggggacaaaaggattnatacctgcggtttaaaagccctagggcaggctggacctgncaaaacgggaaggggaaaagtaaaaagggagggncaaantnaggaaaaggngntcnttnaagctnccgggccccttagctca

SEQ ID NO: 657456 - DNA, 108 bp, Homo sapiens
tgggccctgatatactagctaggaatcacttgaagccagtgaggtgttgagtgaaccaagatcacaccactgcactccagcctaggcaacagagactctgtctcaaag

SEQ ID NO: 657457 - DNA, 162 bp, Homo sapiens
  misc_feature (17)..(17): n is a, c, g, or t
ccgaagtcggtcaagcngccggaggacactcatgcagccattgtcgaatgccccataagtgaagcctgggactgccttcattcagacccagcagctgcacgcagccataggtgacacattcctaagagcacatgtgccgccatggacatttgattcaccacc

SEQ ID NO: 657458 - DNA, 748 bp, Homo sapiens
  misc_feature (376)..(376): n is a, c, g, or t
  misc_feature (455)..(455): n is a, c, g, or t
  misc_feature (468)..(468): n is a, c, g, or t
  misc_feature (495)..(495): n is a, c, g, or t
  misc_feature (583)..(583): n is a, c, g, or t
  misc_feature (678)..(678): n is a, c, g, or t
agtctgatactcccatgcctacacttcttgatgactctccatgtgctttagaaaaaaggccaagattcttaatgtagcatacaatagtctgtagaatccaatccctgcccacctcggcagcttcatttcaagctaattttccactggctcctgccttccaattactgctgcattgcattttccaaaaagggtcgaatactatttccaaacccatgctctttcagaatctggctaccctccatcaagaggtggagtctattcagctttcctttgagcctgggcaggatcatgactgctgcaaacaatagattaaggcagaggtgatgctgcgtgactttcaaggataggtcatatttataaaccagtgtgttatggngaatcacagactaagcccattcaaagagacttcatggagagacctagatagagaagaactgaggcccccaaccgacagncggcataactganacatatgaatgacaggtttcagattantcagtccccaggctcatgtcagccattaggccccagagatcacagaccaggacagcaatctcactgtgtcctgctgaatattggcccntaactctggagcatacaaatggtattttgcacatcagtcatgagtgatttggacatcttagatagttgacatcggcctggcttctagtccaaatncacgatattgcctctcttaagaactttccctcctggctccatcccaaacattactattccaggcggcctt

SEQ ID NO: 657459 - DNA, 250 bp, Homo sapiens
aatctgggattacaggtgcgcgccaccacacctggcttattttcgtatttttagtagagacggggtttcagcatgttggtcaggctggtcttgaacacctgacctcctgatccgcccaccttagcctcccagaatgctgggattacaggcatgagccaccatgtcccggcccacattaattattgtttaacaggcagtgctaagatgagaggggagtacagcagctgtctcattttttttttcactttta

SEQ ID NO: 657460 - DNA, 244 bp, Homo sapiens
tgcgtggtggtatacatggggtccttgtgctggtgtacacaggaggacagggtacacgaacgggacattgtggtgtacactggtggattatgtatacggggtggtggtataaatggggcagtagtgcctctgtttacaggacgagtctgcagacgaaggggacattgtggtgtacacgggtggattatgtagaccgcgtggtggtatagatggggtaatggtgctggtgtacacaggaggatgg

SEQ ID NO: 657461 - DNA, 351 bp, Homo sapiens
ttgggcaacaagagcaaaaccccatcacacacacacacacacaaagacaatggaagccaggcatggtggtagctcacgcctgtaatcccagcacttgcggaagccgagacgacaggatcacttcagccaaggagtttgagaccagcctggacaacagtgagaacctcatctctatgtaaaatttaaaaattagctggccgtagtgttgcccgcctgtagtctcagatatttggaaggctgatgggagaggattccttgagcactgcaggttgaggctgcagttagccctgttcacaccactgcactccagcctgggtgacagagcaggaagctgtctcagagataaataaa

SEQ ID NO: 657462 - DNA, 559 bp, Homo sapiens
tcccccgggctgcaggaattggcacgaggcaaaatgaaaatgcgtatattggaaggcaagttctgaaattaaacgttgtactttggcctgatgttctgacctttaaggaagcaagagttcgtaaactttcaaatatttactattctgaactgtcgcgtaaacctgacgtatttccaagtcaacataccagtataccaatacggatgtgaataatgtgtgagtcgagattaaaaccatagcagctttgctatggcatgtcacgaaagcgatctcccttcctgagtgtgagctccagcagactgcagagtgcgcagttcacagttgtagcctgacttcagtgagtactgaagtgtgctttttgctacatgttctcagaacagtgagatcatccagcagtggcctggactgcacttacatctcatgagacaggcctggctacttgtgtgctgaatacatgcatgtgagatatttaacacctatgataagcctctgattatgcaggtgctactgttatcgtgctctccttctccacatcttatgcgatgctcttattacaggc

SEQ ID NO: 657463 - DNA, 234 bp, Homo sapiens
ggtgtcttgggaaaatgaagtgaggttaattctgcaatccatatatatcccttaggggccaacgggaatgccaaattccaggtgaccaaacagagcttgggataaaatgaaacttcaaggggactgctttgacctgggctgagtctgcctgtgccgagtccgcctgtgccatccaactggagtctcaagtcctgaggcagtacgttcagatgccccagtgcagggtcctcctga

SEQ ID NO: 657464 - DNA, 180 bp, Homo sapiens
gttaggctactatggtgtacattttttctctctctacaggtttttctagtgtccaagagctgttctcttggctacagtaaatacatgggattagaggtctggggcaattcaagttgactaagatactatcttggacaaccagctatcaccaggctcggtaggtttgtcggctctagctat

SEQ ID NO: 657465 - DNA, 330 bp, Homo sapiens
  misc_feature (142)..(142): n is a, c, g, or t
ggtcgacggtacgagcgcgcggaaggcccgttgattgccgtacagcaggtagcccaggccgactcgccagggatgttgcattacgtcggtagttataaatatctaccgacaaaacacaacggcatcgttatgcgcgacgaantggtccagagctaccacgaaggacagctttaacccgagccgctatctcaagagcctgggggggagcgacagatcccattgatcaggtggggcgagtgacggcggggttagcccgaaaagtcaggagtccagatgcaacaaagcccgcacaaggcggttccgggtttgctttgtttggccggggtaatc

SEQ ID NO: 657466 - DNA, 147 bp, Homo sapiens
gtagggatcacagcatatagggcgtgtaggagtgcaggagggaccccggacggccctgataccagatactggagggtcgtatcggtagcagaaatgccccgctccttcaacagccacacgagccccagggatagtgctcataggtag

SEQ ID NO: 657467 - DNA, 152 bp, Homo sapiens
gggcctgctcgactctgtgctgtgtccatggcccgtccatttctcccaggctgcagctttgtccctgtggctctttttctgttgtgtctcgtttctctcatttctttttccactggctttgcgtcccgtttttttttttttttttttttttt

SEQ ID NO: 657468 - DNA, 503 bp, Homo sapiens
  misc_feature (1)..(1): n is a, c, g, or t
  misc_feature (63)..(63): n is a, c, g, or t
  misc_feature (82)..(82): n is a, c, g, or t
  misc_feature (86)..(86): n is a, c, g, or t
  misc_feature (97)..(97): n is a, c, g, or t
  misc_feature (112)..(112): n is a, c, g, or t
  misc_feature (138)..(138): n is a, c, g, or t
  misc_feature (144)..(144): n is a, c, g, or t
  misc_feature (146)..(148): n is a, c, g, or t
  misc_feature (152)..(153): n is a, c, g, or t
  misc_feature (158)..(159): n is a, c, g, or t
  misc_feature (166)..(166): n is a, c, g, or t
  misc_feature (169)..(173): n is a, c, g, or t
  misc_feature (175)..(176): n is a, c, g, or t
  misc_feature (178)..(178): n is a, c, g, or t
  misc_feature (182)..(184): n is a, c, g, or t
  misc_feature (204)..(205): n is a, c, g, or t
  misc_feature (207)..(207): n is a, c, g, or t
  misc_feature (218)..(218): n is a, c, g, or t
  misc_feature (227)..(227): n is a, c, g, or t
  misc_feature (235)..(235): n is a, c, g, or t
  misc_feature (247)..(247): n is a, c, g, or t
  misc_feature (258)..(258): n is a, c, g, or t
  misc_feature (268)..(268): n is a, c, g, or t
  misc_feature (291)..(291): n is a, c, g, or t
  misc_feature (299)..(299): n is a, c, g, or t
  misc_feature (303)..(303): n is a, c, g, or t
  misc_feature (306)..(306): n is a, c, g, or t
  misc_feature (308)..(309): n is a, c, g, or t
  misc_feature (328)..(329): n is a, c, g, or t
  misc_feature (332)..(332): n is a, c, g, or t
  misc_feature (339)..(339): n is a, c, g, or t
  misc_feature (347)..(347): n is a, c, g, or t
  misc_feature (403)..(403): n is a, c, g, or t
  misc_feature (410)..(410): n is a, c, g, or t
  misc_feature (432)..(432): n is a, c, g, or t
  misc_feature (438)..(438): n is a, c, g, or t
  misc_feature (442)..(442): n is a, c, g, or t
  misc_feature (497)..(497): n is a, c, g, or t
ntactatgtgccaggcactgttctagaccccccccagaagaaaaaacaaaaaacaagatagangcagcaaacacaaattctnaagnagaagaaaggngcagttgagtaaganggctaagggaactgagaagcctgagntgatgngnnntctnncttanncctcctnttnnnnntnntnaggnnnatggtggtggtgtatgttgnntntgatggttttngttgttatngtgctatngtctttgtttgntttttgtgtgntggtgttttnagtggatgtgttggattgggtgnggtttttngganttnannaattggttggttgttccgnnttnctttccnttgtggtntcttgtgtttcctctgtggtttactttgttttgtctttggccttccttttcgttgnctgtttnttggcgtcttttttctttgcgntcgttntttntttcgctttttttttatggcttggcgcccttctagattgtttagtttttgttgcntttcct

SEQ ID NO: 657469 - DNA, 1541 bp, Homo sapiens
taaaggggacgacatttattccttttccaaatggttacaggtaaaaccaggtggaagagaatggtttaacgcagttagaaaaaaaaaaagagtacaaatctgggggttgggccattaaaagttatttacaaaaaaaaaaaaaaaaaaaaaaaaaaaaaaacaaacaacaaaaacaaaaaaagaggggggcgagcgccgcacaaagaatatctccccccggaggggccccacaaacagcggaccacccgacattttgtgtggaaacaagaggggcccccatcaatgagggaggacattattaaaaaaggacagcgggcgacgggccgcgcggggataaaaacaagagagcaggcgcgcgcggggagacaaacaggcgagacgaacggaggagagacactatcgggaggacaagacgccccctctcacacaccgggggggggggcacacaaaaaatgggagagaaaaaaccacccaccacacaaagaatagatagtacagcaagcgctcaacgctagagggagaaaaaatacaaccaagtccacaaagacaggagagcacaagaagggaggaggaaaaaaacaaagaacgggagcaaaaatagctcgacgaggacaacgagcacaagcaaaacaagacggcacaacgcgaggaaaaaacaacacagcgaacgacgaaaaaaatcttcgcaccacccaggaagcccatgaagtaaaaaaaaaacgagcggaacagacgaaaacagacaaacgagcaagaacacatacaagcagagaacagagagaagagcagaacgccaacagcaggaagcaaaacgaaaccacgacgacaaacagccgaacagaacaaaaaaagaaagagaaagacgcacacaaagaagcaaaggcggaaaacaagagcgaggaagcgaaaaaacgcaaggaaacgacacaacaaacgaacagaagaagagtagaacgaagaaaaaaggcagacccaggacgcaggagagagagaagaagcggagagagagaacgaggaaagaagaagcaagaaagagcgagaagaagaaaagaagcaagtcaaagagacaaagaaacagagaaagagcagggaaagcacgaaacgaagggacagaagaaaggaaaagaaccagggacaggacacaggagagaacgaaagcaaggggagaagtcagccggcgacgagacggagaggaggcaagggacggggtcacaaccaaagagccacagccgacagaagagaacgaacaccaacagagccaacaggcaacagacaaacaccacaacgacgaaagcaagaaaaacacaccagaagacgcagacaacgaacgaaggacacagagcagagaacacagagcagacacgaagacggaaacaagcgcgagcaaccagcccagcgagacagcaacgacaagcagagcgaagaggagcgcagagaacccgccgagacgcccagcagcaacacaggagaaggacgcagaagacaaagaacacaaaacgacaaacatataacgacaagcaagtacgacaaccgccgacggg

SEQ ID NO: 657470 - DNA, 137 bp, Homo sapiens
accgtactttctctaacgcatagggtagcgcgggcccataggcagcaccctgacaaaacaacatgatctccgtgtgaggagagggcaaggggctggatgcaggcagagcatgactttaagacaagattctatgctcc

SEQ ID NO: 657471 - DNA, 618 bp, Homo sapiens
ccgacatgagcgagcaggaaagtcccgagtgagagcgttggcaggaacccgcccggcagagatggtaagccggcgggacatgacagaacggcccagttagacaagccgtgatacaagaggcgtgatcaggcccgccatcgcgctgttcccctcaatcaggaaatccaggagtcacagcatcttaagctctcgcggaggccagagaagcattcactccctcataccagtccacccccccaacctggggacatgggggactataccctcaggtgaggcaattccgcagacgcgtttcagaggtgaggtggccctttgccgcagtgggatggaccgattgtgtcaactaatgatgtcctgaccagccaaagtggtcaggcagcaatctgcctttcacaaggaaagacaagttgttatgaccgctgctcgatgcttcagcgggggtgtaaagcgactttagcacccctcgttggggagattgggggtaaaaaaaatgggatattttgagaacccccggggggtaaattgggggggaaacttttaaaaagtccctttttttggagggaagggaatttttttttttaatttttaagtttggggggtaagattttataaaaccca

SEQ ID NO: 657472 - DNA, 416 bp, Homo sapiens
cgactctcgaggattcctgcacttcctagacgacaagagcgagacaccgtctcaaaaaaaaaggaaaaaaaaaaaggaaggggccgaagggaagggtgggagggacattctaggcagagggggtaggttagctaggatgaaacaaagcagggcctggtttcctgcacttttttttgccagcaccaacattggccttggcagcccccctgactttcttaattctgttctggcgtccctttcgtggctttctggaggtcttttttttctaatacaggccatgttttgcaagtttatgttggggttcatttttctttgcataacccagggaatcataaatcatgccaaagccagttgttttgccaccaccaaaaggggctttgaatccaaatacaaagttgacatccgggggggccttg

SEQ ID NO: 657473 - DNA, 158 bp, Homo sapiens
tatggaatgtaaaacagttcaaatctcatagaatgaagagtataatggtgggttttcagtaacctacagggtgagaggtcgataataatggactagtactcgctcttagaccgtctctttaccggcgtggatccttctagaagatcgactctgtcagc

SEQ ID NO: 657474 - DNA, 331 bp, Homo sapiens
atccgggatgcagaggttacggtgagccgtgactaccatatcactccagcctggggaacgagcgaaactccatctcagaaaataaataaataaggctaggcatggtggctcaagcctgtaatcccagcactttgggaggccaaggtgagcggatcacaaggtcaagagatcgagaccatcctggccaaccaacatggtgaaacctcgtctctactaaaaatacagaaattagctgggggtggtggcatgcgtctgtagtcccagctactcaggaggctgaggcaggagaatagcttgaacccaggaggcggaggttgcagtgagctgagat

SEQ ID NO: 657475 - DNA, 126 bp, Homo sapiens
tcagctcagtgtaggaccctgttccaacgttagcaccagcctgctcctcggcgggaacaggactcataagtgccagtgaccaggcccaaggcgcgcaagcaaggcgtgagttcccgcgaacatgta

SEQ ID NO: 657476 - DNA, 369 bp, Homo sapiens
aagccccttaatcccctttatttttttaacccccctgtttggggttatggattttaacctttttccccgcagaaatccttttttttttaaatccccccatcttcaaaaaatttttagattgcctgcccccaaaaaggttttttgtttttgccccgggaattcaagggaaaaatcttgaaagaaattttgggctgatatgaatttttcctgtccccaacccctgggggggggcttcccgggaaattaactttttttttcccaaggtttgccttttgagatgaatttattgaaaaagcccaaccccccccggggcttttttttttgatgtggggggcccgggaaaaaaaaaatgtttttttttttttccca

SEQ ID NO: 657477 - DNA, 198 bp, Homo sapiens
  misc_feature (157)..(157): n is a, c, g, or t
  misc_feature (166)..(166): n is a, c, g, or t
  misc_feature (190)..(190): n is a, c, g, or t
gaggctggaaataatacttttacattttaaatattgtgaaaacaaataaaaggaattctatctggatgcttattaatgaaggctcacgacttgggaagcctctctcacccagtcctatttaaaagagatgccttctcccttcactccctgcctgggnccatcccantacactgggtttctttttacagcnatttttaa

SEQ ID NO: 657478 - DNA, 114 bp, Homo sapiens
aatcttgaggatccccctgtgagcaacacagctgactaggatggagaacctgctgctggtgcacagagcaaacgccctggaggagcagctgaaggagcaggagctgagagcctg

SEQ ID NO: 657479 - DNA, 101 bp, Homo sapiens
tcggcacttggcagatctggcacgaggcagatctaaattaaagatggcagctaaaaactgggcttttatgaggaaaacaggatcactctgctttgttgagg

SEQ ID NO: 657480 - DNA, 1538 bp, Homo sapiens
  misc_feature (612)..(612): n is a, c, g, or t
tgggtgtcactgtgtctgtgtgtgtgtgcgtgaggtcttcccagtctcgtggtgtgtggcgcgtctctcctttatttgcagtgtgcttgtgggtgattgtccgcgcgtcgcgtgttcttgatcgatcgtcgtgtctgtgtgttgtcgttgctgtttcttgttcgtgtgtcccactttgtttttctgacctttggttgtccctcccctggggtggtgtgtttcttcggtcttcttttttgcgcgtgctgtggtgttttgtgtcgtggttctgtggcgctccggtcgtcctgtggtgtgctgttgtgttggtgtgttgggcgccgcgctacagcaggtgtgaattgtgggcgccccctccaatttaaatacatgacccccgtagggtggatgcgagaagcacccgataccaatttttagggggaacccctattatgggacttccggaagggaatcccccccaagcggttgtgtcacccagaaaaaccagcgccttgtttagaagcggcccggcccacgttgaactgtattaaccggttctctaaaaggtaaaccggaggggcctcggggtgggcgcgaatattcggggcaccgcaagaggttgggggcacacancaaccacagggtggtagtgcccctctcgaatccggaaatttgttttgtaagccccctgttggaccctcgcccctgagaaaatcgcccaaatgtttgtggctgatatttgtgaatgcctcctttgtgtggagagacaacacaatggggcgcgcgcttacaccacctgtttgcactgtcgttgcgccttcttacacggtgtccaaatgggggctgtctcccgaagggccgccaccgcagttcttacactaatgtggagagtccaacgcgagccctcggcctgggccacaactctcacgggcacgccacatttttccacgagatcccccgcagacttgttcctcacacccgcagatgttagagaggaaacccgcgagttgcccacgccacccctcgccctcgtgtttctctggtgcccctcgggaagagattgtggaatgataaacgcccccacgaggccacgccctcgttggcttcgggctatagtaattaaatgtgtatagaatatgccaccttctcggtaagctcgttataactcgcccaagtttatgctctgagaattataagggaatttggggggagcccacacgtataacttataattatactcggctagggtttgagaaatggttctcttgttataagaagtatagggttcgcccactcgagatgccacgcccactattggaaagaactatggaatattgggtcaccaccttaatctgtgtttcctcatggagaaactatatttgaaatatatttggttttaatatatggagatttttaatgtcaccttcttcacgaccaccgcctaactcccagagtgcccctcacgctgctggaccagccctttgtagctttgtaccatggccagaatgggccccaagcttagtgttgtgacccgttttttaaataaagtatccttgaaa

SEQ ID NO: 657481 - DNA, 276 bp, Homo sapiens
gcgtcgacggaacacaacaccgccgtggtgcgcctggccaaggcatgcaactgggtaactggaaatccgaggtggggatctcgggcctgacctcgaccctggaaaaccgcgacacccgcgaagacggtcgacgcaatgccgtggccatccactacctgggcaaggacggtccgtggggcctgcaattgcacgggcgcgccagcagatgtcgccacgcaatcccggcagcaacgaggtggtgaccttcggcggctatgacggcaccttcagtcgacg

SEQ ID NO: 657482 - DNA, 479 bp, Homo sapiens
  misc_feature (16)..(16): n is a, c, g, or t
  misc_feature (36)..(36): n is a, c, g, or t
  misc_feature (46)..(46): n is a, c, g, or t
  misc_feature (91)..(91): n is a, c, g, or t
catgggggtaggattncccccccggaagaggaaganggtgtttgangggataccagagtttccagtgggagaagggtgaggtttccacctncctagaaaagggatgggtgcctgatagttgccacaccccatgtgaatgtaccgtaatgcccgcagtacccccctacaaatggttaaaatgttccaattttatatacatccttacccacaataacaaaatttttttacccaaaaaatctttgagaagaaataggatacttgcatagtctcaaagtatctcccccaagatgtttattaattacaaagagaagaatgactctacaatggagaaaattagcagacaccatcttaaccaagtatcaaagttaatatcaccagtaagacatattattgttatcatcatatattcttgccaaaatgcacaatctcaatctaattatgagaaaacatcagatgaacccaaatcaagttccatttaa

SEQ ID NO: 657483 - DNA, 322 bp, Homo sapiens
tattgcatgtagggatcagtgcttatttctaagatctgtggcagtcttacatatcaaccatggcactttctcctgatcccttcactaggggatttcaggattgagaacatttttccatcgacacctttttaaaattgtaggactcgtccatgtgggcttcaatgatgggatagtacacttcactcagaggcattggcatctttaaataatctcttttaagcctctaacgtgatcagtgccttgatgccaactacggaaatctgtttagcattgaatctctgacggctctatgacaggaatagcatgatgtgctgttgcctgc

SEQ ID NO: 657484 - DNA, 989 bp, Homo sapiens
gggtgtggcggcaggcacctgtaatcacggctactcgggaggctgaggcaggagaatcatttgaacctgggagacaggtccagtgagcggagatcgtgccattgcactccagcctggacgacagagtgagactccatctcaaaaaaaaaaaaaatcctttactttttttttttaaaatctctgggtctttactcccctatattccccttacccttgcccccaattattctgaaagccccagaaattgtgtaactcactccaaggtctaagctccttaataggaaagcaggaatcaaaactgggccggtctggatttgggactcaaccacgttttccgggttttacaggtctatcccccacttaattttcccctcgggaatgccttatacccccatcaagcgcagacggtatatcaaccatgagatcatctcgttagggtcacgggtaccattactttgatacttaccccattagacacgatgatttatgccggcaggttaaataacatacaggcgcctcaagttagtccaagaagtgcagtttaattcattcacaatgaacccttgctgtgtaggtacttggatcatacaatcttgtggggtgaacggaacgcgcacccccattaaggaaacaccagcgaggctgtcacagggtaaacgacaatgcacttacggacaacacataccatcaggtgacaaaacatattcatatcagtcaaaacaaccaaaagtgggctgtgaatgcacacgaagctggtgcacagcgaggactagagactcatgttacgagagccaggttagcaggtcgagacaccggtccgagtataacgcggccgtgacgcagagacagggaattaggagcacctgagccacgaaaatttgatgatacaacaagcgcgttaactgggccgaacggaatacatgaaaccgggaacagaggtagtacaacacgcgcgccactatagagggatggaacccacctgccaggta

SEQ ID NO: 657485 - DNA, 964 bp, Homo sapiens
  misc_feature (964)..(964): n is a, c, g, or t
gtaaagattctatctgttaagggataagacttggcactgcagcctgggagacagagaaaggagtgaagtgccaagtcttatcctgtaaagattctatctgttaagggatagacctcctgacagcttcatcatctccacgcagagcagagcacactagcttaggagagagaagccgtcaagtctctgtagtgctggggacttacagctttctcttgtcactgggccatttatgttatgtatagtatggacagctgcacttctcttcaggtcttcaggcatctaaaattatgtaaattgtttgggcttacaggagatggtaagaccaggaactgaatcatgccagtgacttcctcctgcactctgaaactacctcttagtctctttacaacacttggcccttggggatctttccttctagttacccaaacctctctttcctgtgcctcagaagaattcttacttttccttagaattattattacaatgacatgcattcgttgttttgttttaaagtatggacttgggctaagtggggggcaggaaagaaggtcagtgtcttgtgtctgtggacaacaggatagggtcctgaggcatgttagcattcctcactggtgtttcaggagagctgtcgggagcatattagattcctctctatgccctcggggcaccaattttctcccttattcacgaagacggcgcttttcactgagcacgaaattaattttaagggcgggtgcaagtgcctgtccatagttacatcctacgtgtggaaaatgcgaatttcttgggcggagttccaagaatataatatgggggaattaccgcgcagttacgcgttgaacgaggatgaaaaggggtagacagtggggaaaggaagtcaatatggatccgacgtaagagaggtggggtaaccgtgacgagcgagcacggcagaacaaatcattgtcgtgggtgactgatcggn

SEQ ID NO: 657486 - DNA, 379 bp, Homo sapiens
  misc_feature (298)..(298): n is a, c, g, or t
ttcccagcaaagactgtggaaccagacagcctgattcaaatgccagctcggtctacttattacctgtgtaatcttgaacaaattacttaataatctccaagcctcagtttcctcatctgtaaaatgggacttacaattataatacacactccataggattgctgtgaggattaaatgaattaatattgcatttgtaaagtatttaaaacagttcctgtaatccatcttattttaccaaattgatggacatgatggactcccctattgttacaaatattacttgtttcccatataaatnatgggaaaaaagatgttcatcatggccttatttatattagctttttttccccataaagcttgtgtaaattatgctgtgatg

SEQ ID NO: 657487 - DNA, 259 bp, Homo sapiens
ggaagccagagtttggaagggtatgagggcggacaaaggcagcgcgatcatggaacctccggattgggaaaagtgtagaagggctccgaaaagcccgtcaaacctgagggggcgggaaactgttgcccggaggctaccgaggtgatccaacgggccggtgcggagaacgcgcccaacaatacgaatttataagaggaattcgttcaaggcgaggctgtttcccgacgatacgttgttaccctgaggggggccgttttct

SEQ ID NO: 657488 - DNA, 218 bp, Homo sapiens
aacgactacgcacgtggagtccacacctttatttgcgcttattccttgagccctctaccgttcggcaatggcgagtgccatgttcttcagcctctccttgttggcttgcggggcactgctctgggggacgacaggactcagcagtttgttcatcagctccagtaaccttgtcagcatacttggcaaggtcatacagcttagctgcctcttcaaacagt

SEQ ID NO: 657489 - DNA, 1011 bp, Homo sapiens
gccagttccggctgtaaagatggcggcttcctagtgagtcgcggcggctgatttagaaggaggttcaggctacgccatacaggagccactggacagtggcatagtccagctaagcgccctagctgaagacggagtgaggaggactatggagcattcgtgagagtctcggctccggtgtcgctcgcatgtctctgacaggggttctgacggtctcgggacaagataggggggacaggccaaggcgatggtcctgggcagtgagtgaggagtgagggtgcggccgccatgtgctgagtgaatgggagcctcaagcacttacagggaggcgggacctagtgtgcctggacaggatgtctccgtgaggcccttaggtcgagagttcggacatggaatgggtcatacttgtccaggagaacagtgatcatttgcctggactctgtcaaaggaaagtgtctctgctcattgctggagtcgtatcaaccggatattaaccactcaatgccccttcccatgttcttcccaggaagatgatggagatgttcgagcggagcattctcgtaagatcgataaaagcccttacttgagtgctggtggtggtgaccgatgactgcgtgctgggtgtcctggctggagcgtttgacgcccgcgagtctgtaatctggctctattatctggagaagggcctctgttttggcctgtcagtctggacgagttcttgacgcctcgttcagagtaaatgtgcttccggggccgcagagtcgttgcgtatgatgccccgcgtttgtggtcgcgcatcttgtgttttgcgtcacttgcggccccgtgtgcttgtgcgcctgctaagtttccctgcctttgtcttggggtgtttgtccccgggtgcgcgaggggggttttgacaggctctgtctggccggacccggcggtgagttagggtggggccgttaattggacgggccggtgttcacgctctcaccgggggtgggctactttgaaggctcgccgcgggta

SEQ ID NO: 657490 - DNA, 341 bp, Homo sapiens
  misc_feature (22)..(22): n is a, c, g, or t
  misc_feature (40)..(40): n is a, c, g, or t
  misc_feature (124)..(124): n is a, c, g, or t
gacctagaggatcttttgcggngcttcctccagctccatntttatacttgaatctgagagcctgttttctgacttctctgtgtgcttacatccaaacaaatttaagttgttcagaaagcacttngaatactgtagaaaaaaaaaaaagaaaaaaaaaactctctcacaaggtaatgaaacaatccggttggggtttaaaccaaaaacttccatctaagcacctaaaaccaagagggtgggctgttaacaaagctaatcttaaaactggcaaacgctaaacaaaaacacaaaacacacacacagtaatatagtggagtataaccaatctatggtgcactaaa

SEQ ID NO: 657491 - DNA, 237 bp, Homo sapiens
  misc_feature (3)..(3): n is a, c, g, or t
acncctagaggaccccacacgtaacgctccacttattgatttaaggtaacttgacaggtgtaagcctatttgggttttgaatttttggttttgggtggggtagacatgttgtaaggaacttatttgggctataatcctttagaaaatgtctagtttgaaacagatatcctttggaaggaatatccgggaaaggcgttacgtgtgggtaccgagctccgaaaattcggtaaatcaatg

SEQ ID NO: 657492 - DNA, 837 bp, Homo sapiens
tcataatgggtatggcaataatggtaggaatactacccctttcacttctgagtccctgaatgttacaccaacgtggacccgtctgacatgcggtctgctatgctactcatatgacataacaactagctcctatttcagtcatatatcatatctctctctcaataaactgttaagacacatactccctctagtctcttcactccttcatcattcatagactagggcatgattgaaagttggtcattatcacctaatcatctccacatactctccatcacatcttatcaataactctcagttacccactatatgtatgaattgattagcattttcataccgatatgaaccctaatcgatatccattcttaatttaactaatgtatatattactcctataactacctcaccgcactttcgctatccttacctcaaactataaaactccagacagccacgaaaccatacgtacatatctcgtcaatcgctgcacaagaaagctacacatcgtacattacatccatctcactttaacttaccattccagcactcttccttctcgcctacgaggaccttgtcacccgctatatcgcggcctcttcttgtccacatgagcctcataattcgaagaactatcacaacgaacaattagtcgctcatacatccgcctaccagtcgaatagaccaccattacattccattaacctctatttctacctacgcctaagtatactccacctcaatcacactaatccccatatctaacaacgtaaagggtggctgaccagtttgaacatttccaaaaagccaccccatttctccccacactcatcgccctta

SEQ ID NO: 657493 - DNA, 149 bp, Homo sapiens
tcaatagcggctgcactacgggatgtctgatccaacatcgaggtcgtacaccctattgttgatattgactctagaataggattgctgctgttatccctagggtaacttgtcccgttggtcaagttattggatcaattgcaggggtaccg

SEQ ID NO: 657494 - DNA, 1008 bp, Homo sapiens
ccctctgtgcttttgctgctgagccacacaacctctcattgcaaaaacactttcaaaatgctaacatattctaattcactctaggccaccaaaaactttaatactaatatctgatttgtaaatgacttaatgtatccttgaccctatcagctgaatttaatgaaatattcctctctgctgtgaaattttaccagtatagtatttggtctagtgacagagcgagactccgtctacacacacacacacacacacacacacacacacacacacacacacacacttatcctctcctctctctaaccccaaactaatatcacagagggtgactccagtgagagaacagagggaatatcttaccaaggaagggcttaaactacacttttttaagaaaagagcttttagtgttacaagacgcctacaattagatacgccgttgatattgtgtatatctgtgaaagcatcacacaatcaagactctggatattctatcactcccacatctgagattcccccctaatcgtggataccatttgtcgaaagatgttctcactctagctgaacttacaagagactatagaccaggtatctaaatcacagggcctgagagaacttggctcttatcttctgaggacaggtgagaaagcccagtggagaattaagagccttaaagaggggagaattacgtgctcccaaagaggtatcttcggtactgaccaggcagacacttttctcctatcagtaagcctccatactgtggtgagtacccccctgaggtttccatctactgtttggtcttctatctagagccaaaacataaatcagatccgtccacaagatcgtcgtcatggggtccacacaagccagcttgctcttatgggattggaaaaattcggccttccccctctaaaagaaataaaaacaaaaagcgcgtcatccgggccaccacttagctttgttaagcgccgagacggtgcctgtccatatttgtatattcatatcgatatcgac

SEQ ID NO: 657495 - DNA, 489 bp, Homo sapiens
ttctagctcggtaccccacaccctgagtcttaactaccagctactgctcctcagtgttctcagagagtatgtcttaagctgcctctgtttttttctctcagaccagaaaaccaggctgagcttgtgttcaatgagataaccgtcccttggcaaggactgtgcgggagcttgggatggactttggttttcatttatgaggcacgtggtcttttgcttcatctttcacgtttgtcttggatccagaaatttccacgagaggaagacctgtaccttcacccccaatcaccttccccttcagtcctgccgaggtcactgctaagaaccaaggacatttaaatccccatggatgactggccacgtgctcattttcctctaagtccacagttttgtgccagcagaggcggaatgagagtccggttcctgctccagcctttctgaatgttttgctttcttggtcacccccttgactcaggtggtggggtaccgacc

SEQ ID NO: 657496 - DNA, 180 bp, Homo sapiens
gctgggctggagtggcggtggatgcgagcagcctgtgggcaccccagctgctggtggatgtggtgactggggccagcttgtggtccgcaaggggagcagtgcagctgccgcccatgtctccctgggttatcctctgctggcaacctcctcagccaccagcaccagagcagggcattctat

SEQ ID NO: 657497 - DNA, 1296 bp, Homo sapiens
ccaacgcagataagaatagatcaaagcgacacgtccgcatcgcttcatctcagcaattctatagttatgtgttatgtattctaccgtccagttttgcatgagtgctaccgtcggtctgtctatgtgccgactctatgtttcgctgactgcgtgtggtactacttatgtactatacacattgtctgctatcagcaatacccctatcttctgagtatactttcattctacataaaactacatgtagctccatcatcaatccatgtttaggcgtacgcactttcacgtggcatgataacggctatcaagcttgctattgggaagcggatgacgggctgtagtatcactgatgcacatcatgagtttgagaagtacgcgtcccatgttggggaaagtgtcgcgaatgtcgaaaacagggctgtaattgtgagaagggctttctagtaggatagtatctgacgttaatgtgcggagaaaccagtttacacctgaactatgcaaatcgttcctaggaatgtatcccctgaaaatgtgggttcttgggacgtgtgatagcttgcgtcatgacaaggatcatggcaattcataggagttttgtatagcgtaactgttggaacttgagtgctgtaggctcccttatcagcaaagagtagagtgtcttttgtgccacggtagtcagtgaacttaaccggaattggtgcatgttgtgtgaagggtttaattgtcctacatcaaacttagctaaagtaatgtccatccacgtatggaggaggtaggagtatgtggaagaggtcatagctgggcactaagttcatatgcctatgagtcagtaaagactgaagtaatgtcctatgttgagctggttattttgatatatgataataattatctattgaagtagtaacaattctgtataagctggaaatatcaccaggatatatccatcatagtcttttcaggacagatagtttttactgtggggccaactaggttaaaattacactatgttagttgctactttaggcttttaaagcaagagaatcatgtagaggaatctactgcaatactatagtcttgtccagacctagcattgtcatgttggggaaatgaagcttcgtgaaatatcctaaacgcagttctagctctatctagattgagaaagtcctccaaaaagagaactattgggataccatggatgtggtggtggagataagaaaagctccctcagtattcttggagggaataatcgttaatagaaatacttaaatggctaagtttacttggaaactagctacgatt

SEQ ID NO: 657498 - DNA, 403 bp, Homo sapiens
tggtcttgaactcctgaactcaagtgatcctcctgcctcagcctcccaaagtgctaggattacagccatgagtcaccacgcctgggctgggctaatttttttttaaccttttatagagatggggatcttggtatgttgcccaggctggcttcaaactcctggcctcaagcgatcttcctgccttggctccctgaagcactgggattacaggcatgagccaccaaacctggcccaccctttttgaagtattctgggcaatgcacaaagcattccatggtggggccactaaaattccccgcttacaaccaccatagttgtagagccctagttgcaggacattttttccttattacttttttaattgggggcccaagaataatttgcatttctttgattttaccgc

SEQ ID NO: 657499 - DNA, 1055 bp, Homo sapiens
gccctggctggcagtgagggctggaaggaggtggaactggcctctgcagagatgtgtggcatgctgtgtcatgtgatggccattctgtgtgctcatgcacatgcaactgcatgcccaagactcatgacttgggtgaatgcaaacatgtggtgctgtgacatgtgccatgtgatgatgccttgtctgtgacatgttgatcccttgagatgttgggatgtttgcttgcacgagtggacgaacggacatgtgcatgttgtcgttggcctgtgatgctcatttgcctcagaagaacttcttgcatgcctgagacttgctgcttgtgcagtgcaccatggaggtccttgtcttgacacaaacaatgtacctctggatgaggttaatccttggccaacgacgatagctactgagccgtgacgcagatgagtaggttgcgattgacaacttttgacgcttgccttgttggccaaggctgcccagcggcccttttggacatcggccctctttagacccgttgacggagttcaccgtagcatacgcaagatgggagcgaaggttccgagacttggtgcacaagccgcgcttaagcttcactgggagtaccgcgcaagagccaacaaaccattgggagccgggtcaatagtagagcatgacaccctttcatgtggcaaaacaccttcaaacggtaatctacgggaacttcaatgggagagcaccttggcagccccttgggaccccggaaatgagtgggagcaccagtcctacgaaacctcaacggctgcataaccagtggatacgtggaacaggctcgaaggcggacgaattaacttccagagcataaggattacacaaatagctcttccttctacagaagagttcgttaggtggcgctcattattagaaagcgtttcaaagacccgcgaaagaaaccttggcgccagtcgaatttggacctatatcagatcgcaaggcaggtggacaacatgacaatggcacccgaagccttttaacccggggccaaagcggaattcaatcgattagacatggggcaaccacgg

SEQ ID NO: 657500 - DNA, 237 bp, Homo sapiens
gttactgtctgagcaagctgggaacgggtgtcatggctcatggagacgacctgccttccgtcgtggtcgtcttcgctggctcaagcaggagcagctacggctgctgggactagcaggtctctgggggccgggcgtggtggctgcgcaggccctcagcctgctttgtgccccctcacgactgcaagctacgctcccccttcaagaagcaacccccagcaacgggagtctttgcccagg

SEQ ID NO: 657501 - DNA, 286 bp, Homo sapiens
tcgtgtgtaaaaatcaaatctaagtagattacagatccaattacagaaacactttgaccaatttagaagagtcatccttaaaattatgttcctctggaaccatttttggtacccaaacaaaaatctgtattagtcagggttctccagagaaatagaagcatatatatatcagcctccatgactgtgtgagccattttttcatggtaaataccttcatttatatatgaagtcccacaatctgctgtcagaaagctggagactcgggaaagctggtggtataattcta

SEQ ID NO: 657502 - DNA, 225 bp, Homo sapiens
ttcatgtcgagtcctttcatgccgtaatggtggaacattgacctggctgcggatattctcaatagttatgccgggctagcctgtgtggaagagcccaagtgacatgattactagagagtacacgtggatgtggctgaaggaagaaatcatagacgatgatgatgatgacatcacccttacagttgaagcttcttgtcatgacgggcatgaaagcgctggacagaa

SEQ ID NO: 657503 - DNA, 1401 bp, Homo sapiens
  misc_feature (52)..(52): n is a, c, g, or t
  misc_feature (71)..(71): n is a, c, g, or t
  misc_feature (97)..(97): n is a, c, g, or t
  misc_feature (109)..(109): n is a, c, g, or t
  misc_feature (468)..(468): n is a, c, g, or t
  misc_feature (549)..(549): n is a, c, g, or t
  misc_feature (633)..(633): n is a, c, g, or t
  misc_feature (670)..(670): n is a, c, g, or t
  misc_feature (674)..(674): n is a, c, g, or t
  misc_feature (691)..(691): n is a, c, g, or t
  misc_feature (733)..(733): n is a, c, g, or t
  misc_feature (853)..(853): n is a, c, g, or t
  misc_feature (947)..(947): n is a, c, g, or t
  misc_feature (1029)..(1029): n is a, c, g, or t
  misc_feature (1085)..(1085): n is a, c, g, or t
  misc_feature (1092)..(1092): n is a, c, g, or t
  misc_feature (1102)..(1103): n is a, c, g, or t
  misc_feature (1106)..(1106): n is a, c, g, or t
  misc_feature (1136)..(1136): n is a, c, g, or t
  misc_feature (1145)..(1145): n is a, c, g, or t
  misc_feature (1244)..(1244): n is a, c, g, or t
  misc_feature (1315)..(1315): n is a, c, g, or t
  misc_feature (1336)..(1336): n is a, c, g, or t
  misc_feature (1344)..(1344): n is a, c, g, or t
gtcctaatagtccaactattatttttatattatttaatgattatgccagaancaggtagagtcagtaccancgtccacacgctagttcgaccaacgnagagcacatctnattatttatatttattattagtagttttctttatattgttctattgtatttatgtgttcttcttgttcaaattaaaatacacagttcatcttctctaacctgcgccttctgtgtgtttatattacctttataatatagtcatcaactcctactaccaacgtcacgcctacaatagaaacgtcgcatacattcgtgccttattcagttttatcgcttgcacaccccctatcgcatcctatagtaatcacacatacacactatctcctcttctgtctatgcgtgttccctatacgtgctctctcttatcttactatagcgccactcactttacctccttacctcgtatataatctactttnatagacatgtcacgcaccacgaatgttgtatatacccgtgacgccccatctatgtcattctacctctctcactcttcttgngtccttctcttgtatcgcactaatcacctattaggtgtgtccgatttatacctcttattctcacttctattgctgcgctctgangtaataaggcggtccctacaccgacgattgctgtccngtgngatgtctttctatatcnatacttacgcgtcctctcaagacactcccgtttccatagttncgccttatttacctttaatatactctcgccaatgagtgtgttgggacatattccagcctatttattcactcgcttgtgtgtaccaccgcatcgcgccgctgtctcaattaatagcgggcngttcttcatctatttacctctaccagtcgcctagtgtgtcctcatgttctctgtgcagttgctccttgcaacgctcagacttggctgatagtantcctcgtctcacacaccctcttctactcatctcacgctcttcatgtcgtttactcctcatgctcgctcaactatatccgttngttgtatctggcctatcattgaatcctcagactctattctgcgcactagatgaacntcttctntctctgtatnntgnctctcacagtgataacaactccactccgcnacatatacnctaccgctctctctgtctcgatcattataccgcacatatctgcgtgccttctagtactatgaatacattctcttgcaccgcgacccctctccatctccncctctgtattctacatacttctttatcaacctccactagcttactgtgacctgcctctttacttcttctcncttaatactgacccgattcgnaaataganagtcctcataatgtcctcatctcgtcctcctattttcctatttctttgcgccggctg

SEQ ID NO: 657504 - DNA, 223 bp, Homo sapiens
  misc_feature (98)..(98): n is a, c, g, or t
  misc_feature (103)..(104): n is a, c, g, or t
  misc_feature (114)..(114): n is a, c, g, or t
acgcgtccggcggagggagccgggcgtcggaggccctgaggccggccgcagagcccggagattgagcggctttggggaaggggtggttaaggaagtangcctnngcttccgtcngtcgctgctcggctctgcggcccgtttggaccgcggaggaggtcgccttcccctcccgtggggcgctcggttggactgtggaaaccggggcaacttcccccgtcttccc

SEQ ID NO: 657505 - DNA, 834 bp, Homo sapiens
cccctcaaagccaaaatgggaaaggaaacgactcatatcaacattgtcgtcataggacacgatagattctgggcaagtccaccactactggcccatctgcatctcatcacaatgctggtggccatcgcacacaaagcacacccattgcacacacacatttgcagcacaggcaggccagctgcagcatgggcaacagggctccattccacagtcatgccatgggatcttggcatcaaactgcacacagctgcagcagtgcaacgtgcgtcatccacccatacgcatcatctccgttgctggcacacatattgcagcaccaagccaaagtcactcatgctgcaatcatccattagcatagcacccaggcacccacagcagacactcttcatccacaacacacacacatgcatctcaccagtggacaccatcatcacaagagcctaaccacttggtagccttagtacactagacatatagcttgagcatatgcatatggataggtaagcgtcgccaaatctaggcacagcgtcgcgtcaatctcacgagagacacatagcggccagccaacagcacaacggacccaacttggagccacgatgatccgtggcggccattataagcacgacaaacataggcgacgctaggatagggcacaccaccccaaagcgttaaccagtatggcagaccggaggacggataacgcaacgacacgaaaagtcgggaaatatacaacaaaaagaggacagacacccaccccagtaacacacggacaccaacaacaccacgacacggactgcatgaacggggacacagatgggacgcacagcggacagg

SEQ ID NO: 657506 - DNA, 263 bp, Homo sapiens
ttagagcggaaacaccccctcggtttcacacatcagcgagtgcatcactgcatgggggaggccaaagacagcaaaacaggcagatgcagcaatctatcatatacgccatcaggttgataccggtgacgtgaggtgtttgggcaaaagctcgctcggtactcgggcagcgggtcgcctccggaggcggtggtacgaaacccaagacaggcggtgatccagtcgcctccttttggcttttttgctcaggccaggatctgggccgt

SEQ ID NO: 657507 - DNA, 92 bp, Homo sapiens
aaacccactccaccttactaccagacaaccttaggccaaccatctacccaactaacgtataggcgagagcactttgagaccctcagcgcaca

SEQ ID NO: 657508 - DNA, 426 bp, Homo sapiens
atatttagtaacccagcttagccattacttcatatattaaggaaaccccccgacctccttcttattaagggcgcttactgctcctcgtgaaagtgccctgcaatatgcttctcttaatcgtttcgaatcaggtagtatggaataaagaaagaaaagatcactctacatacagatagtaaacttaattggtgatcctagtagtattagacagtataaaaactagcagatcagtgtttagaaagactcgaaagaatgtgtaaatgactgatgttggcattatcaaggagaacttgggatgttgggtcaagaggggaaagtgttagtcaatccactttggagcaatatcatgaaggtcaattataattccatatacctttctttgatgccacagtcagagatagaatacagttagggtggccatggatg

SEQ ID NO: 657509 - DNA, 1284 bp, Homo sapiens
  misc_feature (82)..(82): n is a, c, g, or t
  misc_feature (992)..(992): n is a, c, g, or t
agcgggtgttaggccccgggctggccagacgatgccgtgcacgaaagttttgcgtgtctgatccggatcggttggtactaanggtcatgcttggacgttccaccaccaccagaattgcgagaggactgtccagtctgtgctgttgtatgtgcctggtatggttgtttgcgtaagcctaatcgaatactgcaaacgaacgacttctcggttgactcactgatactccactaacgctctacagcaccgaatcgccgaaactcctagtctcataaggaccaatctttgactggcgttatcgggcggtgcagcccttgcgcctactcgtgatcaattcttcgcgaatatcaccttggcccttgcttgagcagttcttgagcgaaccgaggaagagacgccggccaaactggccgcagattacctatagggtcccattcaagctaagtcaggggaagttagttgcttagaggagctctattgcatctatctcgaagaaaaaatctagtggtgtctcatccatacaccccttcgttcacgacgacttcaaaattgcatatgaatgcgcacgtatgtcctaagtgttgcttgttagagacaaagcctacgtgtcgcgaaagcgcgtcctggtgcgctctgttgacacgtttcctcgacggcacttacgaattgcaatagcctggttcaccaggattataaacgccctcccaagtggatgtatttgcgctagcgaaagggcatgcacaaacaacttccgtggccaaaggtgtttctcatacctggggcctgtctcgaggaagcgacaccttttattgtgataacatggcacatgccggaagtttccccatgcagttacggcgcaggggggaattagttcgactcgcgtgacttcgctttgttgtgcaaaacggaccccccccaaaggtttttatccgacccacagagggtcaagggcatgcgacatttagctcacagaagcggttgtgcagatgccacangtgcaaaacggcccgaagacatgttgggtgcgcccctgtgttgagccacttaagtgcacttgcgggctcaaacctcaaatttaaaacccattggcgcggtgggctcaattgtgggtcgtgctccactttggatacttattaccagttcacacacgggcgcggactcggaattacaatggcaccaaacattggcttggttcccctctcaagaggtggtcgctaattcttgaaatggatacccttgccgtccttcgcgcggaaactttaactttaacctcggaaaggcacatga

SEQ ID NO: 657510 - DNA, 149 bp, Homo sapiens
ctccatatgtgtgcccaggacacttttctttatgtgaagtgttattggaacaaagttgtctcttgtgctggcacacattatggagtgggcacacattatggagagttgaagtttaagtttcagaaaagatggaacctggtcacccatta

SEQ ID NO: 657511 - DNA, 930 bp, Homo sapiens
gcgcccccctagaagttattgtggggcctctcttagagctcctgtgtcctatttatcctggggcccctctgaggacccggtgtttaattccgcgcgggggttccctaccccccccggcgagtaatctcttaacaaaatttggggtaacgttttcccagttcttttttacgccgctgtcaaacaagcgcgtgtttcccgccaagcccctttccgccgggctgattcttccgcgacgccgtcagaggggtgtaccgcacgcactcgctccttccgccggcgcgaccattccctatctgccctccgccgccttggccccggttgtagcttcccgtcagccgcgcagccggtgcattcgtcaaacctgcaccccctatcacacccgtccttatatacctcgagaacaccttttttgggcctcttcaccccacggtatacagaatctatggcctcttgttccaccaagtcggctcccacacaatccttcttcccttaatacaacagggccccccccatttcttcatcactaaaacaaaacagctacccgaatggcgtttcccctttatggcccaagagcgacgacctcacattttgtggcccataaccctcctgtgttaagacccccccttccacattcagagtattcttgggggcaccccccccccacacgacaaatgcgccactgtaggagcaccgctgtatgcaaccaccagagagcgagcaatactatatttggtttggaaatcgagagctggcaccatcctgaattcgcactgcctctatggaaaatcatcttagcgcgataaatgctagacggaagattcctttttaaaaatcctcaacaccaaaggggaagagcatttgagacaccgacctactgagtggggcaccttctttcccccaataaccaaccctttttcccccacatgacac

SEQ ID NO: 657512 - DNA, 1513 bp, Homo sapiens
  misc_feature (183)..(183): n is a, c, g, or t
  misc_feature (351)..(351): n is a, c, g, or t
ggcgaccagagaggtggaactagccatgttacagccgttctctgaggatgtctcatcatcgcatccgaacggtcattgactccatggctaagaatgaagccagtaacttaaggcaaacgtaacgaccgtgaacttcgcattagatgaatccggtacggcgacctgactatggaatgggacttnatgcacagaaacatggtcgtcctgttgatcgagagtaggacgaagtggacagtcgttggagtcctgcccgaatgggctaggcatggtcacgatggaactcccaggcattggttgcccgtgtcgagcgcgcgccacggacgtgggtcgttttgcatggcaatggggagncactacgaagagcaacaccaaatgtatatagcgccaacaatggcgtcgagtcctcggacgggggcctgcgcttgagacccgattcaatacgcacgatccccttggtggcgtagcgacaaaacctcgccaatgtgcctcatgtactagcgcaggacaagaacccctcgatggggcgacccttttggtcggcccccagtaacccggagggccgagattgggggcccccagaaaagggcggctcccaaaagggtcataggcaataacttctgaccccgggggaaaaaagaccatcgtcggcataaggaggcacttttgttggatcacacgaccttctataaaagggctggtttggctaccaaaaggaactatcgtccagctggaggcccacccaaatggacacagccgatggaagaccctgcgtatgcaagggagggaactcaggaaggaaggggtggggtaccaaaatggcgctccacaacgagttgggggaataggaaccgaagtgatgccatatcaaccagcagagaggcgcgtagcccttttgcaagaagtcaatatcatacagaaggcaaacagcacggggaacaggacgattgggacaccagcccaatagacaaagttctcaccgtttggtgcggccaccagtatcgcaacaggtgcttattaaagggggccaatcggtgtgcgaaaccccacaagcgtatatcagagatggcaaactccgtatcgaacaaacttcatccaggtcggaaaggcacaacactccggtgctaagcacactataggccaccctttggagcacattttcggggggtttgtcgtagcgccaacaggcccccttaagcggaatgattcgctatagcgaagacatacaccctgccggagcaccaataggggacaacaccagggccctggcggtataaggcgacacgacacaacgggcacacgggacctgttcaacgccccagtggggaacgagacactgatgtccactgaggacaattccagcctttaggacaaggttacaagacgggaaaccgacttgggcgggccatattcaattacccccgcattaggagaaatcaaaactgtatcacagagcggacgtgttttataaggccgcaggcaccgccctgtagcgagtatttataaagcgtcacca

SEQ ID NO: 657513 - DNA, 340 bp, Homo sapiens
atctgtcatgttccccgtgagtgcggtgatggcctcacgttgccgtcggtgatcggccagtcgcgcccctggctggctgtcgcggtgaatgtcgttgtgcaccttgatctattgccctttctcggagcagccgctcaggcaggttcttgcgatggcagctccctcgtcgtgtgtggctcctccttccagtctcgggtctgtccaggaatgtgctcctcatagcccagcctcgaaggtgtaggcgtcctctgcacgcacgctatccatggcatgctccgcctgggggggccattcaacgcctccgggccattcaactcctccgggccattcaacgcctccg

SEQ ID NO: 657514 - DNA, 334 bp, Homo sapiens
ggtctcaccttcaggttcgcgcctccgactcacctcgtcttgtgttcaagtggccaacgatgcttatcgttcaggggaaaaccctcgctctgtacccctctttaccgctccatacgcgaacttggacgtgcgcctcccacagccgtcgtttcttacctctcgtggtgacactacccatcttactacgctgattctcggccggaatcttctatgtctgctagcgcactggtctggccgcaccaggcagcctatcatccccgagtcttggtagcgtgacgatccagcatcagtcaaccacggagcacgtacatgcacttcgcctgacgtgcgcagc

SEQ ID NO: 657515 - DNA, 682 bp, Homo sapiens
  misc_feature (649)..(649): n is a, c, g, or t
ggagcctggtgggtagggaagagtcaaccctcggtcgcatgtaggcctggaacctgaccaatacctgtattttcatacctacgttccggttttcaaatgtcggataacttggaccatacggacctgactgcatttgctgttctagagaatcctctgtaagtggacctgcacagttcaggcccagattgttccaggatcaaccgtagcagtagaaatcaaggatctttttcattgtctcttagcggatcatgccttttcacacgaatagaaatatgagggctgttgggagcaggcctccccctaatctggccataaactgtccccaaaactggccataaacaaaatctctgcagcagctataacatgttcataatggccataatcgcaccaagttgagaaggattagtggatctacaggaatgacgtgcaaggaacacctggcctgcacagggtggaaaaccacttaaaggcattcttaagccacatacaatagcatgagtgatcatgtgccgtaagacatgctcttgctgcagttaactagcccaacatattcctcttaattcagtcgatccattcgtttcccataagggatactgattagttaatttaatatcgtatagaaagaatgcataatgacatggttgctgtntaataaatataacggctaagctctgttaggctt

SEQ ID NO: 657516 - DNA, 1193 bp, Homo sapiens
  misc_feature (314)..(314): n is a, c, g, or t
agcggaggggtgaggtcacggtttgcgtccgagccatcacgtccctagataacgtgcaggtccggttacagatgtatggttatccctgccaaacggttctgcttggtgtcatcccactggtcagggcgtgcgcctgggcctattgtccgtgcggtcacttgagcatgccagaggaccgagcccgaatgtgcttgcatggcaatgtgagattcgagttctatgcctcgatgcgagaaggacgcgctattggcacagattcagtctttgaccactgggacgcataaggcagccaataggacttggtcagtacttgnatcgatacagggataatgtaggttgcgaaacggaacattcgagatcagtcccttcgagcaatcgataattcggctattgcgcacaggaaactgacaaatcagggcataaaacccaattcttgcgacaagcgcacatctatcagaatccgtatcaccacaggaaatttgcataaacttttaaccaatcgtactacaatacaaccgggcaaggacctcattgcctaggtggcttttggctgccttggaaacccgtgaagcctagccagagatttgggaaatctggagtcatcacgtgggacaggacttagggtttaaccagagtgccccgtagagctttcgagatctccccaagtaagatgtactatggaatttattttaatggattgacacggaacagttgtttatccaattacgaaaaagacagtgggggaagaacaaattcaagtaaaggactatagaatagtggaatagaacgtgggagaaaggctactatgtcttaggagcattgattgttccctataataaaggggaaaatctcagggggcaaatatttgcagaagcggaaaaaagccttgtccagtgacactataggccctaataagaggatgggtagcgacacctataaacggcaacttgttggcacatgtttctgcccaagggccgacggcctatgtaacacttgtcgtggaacctcagtaagtcgttccacaactgtgacacaaccctgtctggcgcacttaacttatgaggcaccacaacggtgttttaacacttcacaacaggacaaaaagcgagcacgtgtacgaagcgtttccccctgacggaaacatagtggaccagtaacgggctacacacggcaacaacacaacagcacaactt

SEQ ID NO: 657517 - DNA, 229 bp, Homo sapiens
tgtcttgttttcatgtgcgttactccccattgcttccttttctctagcacacggaagagttcatatcgactgctgaccctaatttgctgcattcactgtgggcattcctacagtccttcaatcttacttttctgttcactgatgataatccacaattgtgggtacataacccatcatttaatgcaactgactgtcgtacatcctgttatcgactccatcataccttact

SEQ ID NO: 657518 - DNA, 483 bp, Homo sapiens
aaattcagaaactttttttattactgaaaaatgacaagccagatcagttcaactttgaccattatacagacccaaattttttactaaaataaatactaaatactaacccgcagggctgacccaaggatgaaatgagggggggccctgccttgggcccaaaatttaaggggacatccaaaaaaaagggggggaaagaaagaaaagaaaaaagaagcccccaaaaccctcaaaccaaaaaactcgataatcaagctaaatgattttttaaggcaatttttaaaaaaataaatgcaaaaattttgatgaacaaaatatcaaaatgttaaagacaagatcagtaacagggccttgccaggccatattgcagcctcagccaaaaggaaaaatcagtaacattcatcttatcttttcctaaaaatttgattttttgggggaccccattttccttccccttggcctggccctggtaaccagaatatcagt

SEQ ID NO: 657519 - DNA, 265 bp, Homo sapiens
  misc_feature (262)..(262): n is a, c, g, or t
gtattgggatgataggctgaactatgtagcgttgtgcgctgtgtaaatgatgtgttgtaattgctcatcttttagtgaaaacattcttgagagataaaagccccatctcaatcatataccaaagtctctccctacacataaacgtaagaccttctccatcactcatctcaatacttatccactcatagacaggacagttgacggtggacttcaaaccacaacccacgccgcacctttcacatgttctgctaggcggatcctncta

SEQ ID NO: 657520 - DNA, 581 bp, Homo sapiens
  misc_feature (265)..(265): n is a, c, g, or t
  misc_feature (510)..(510): n is a, c, g, or t
tgagtcactcaaggaacaaaatgaaaaaagtatgcccaattaatagagaaagaagaacagagaaaagaagtacagaatcagctagtagacagagaacataagctagcaaattggcatcaaaaaacaaaagtacaagaagaaaagattaaaaccttacaaaaggaaagggaagataaggaagaaaccatggatatccttagaaaacgaccttaagcagaacagaacagactaagaaaacgacgtggacgcattacaggcttcctcncctagacggttcaaaacggcacaacttagaccggtcgtctggaaagacgaaagacgtcctgtggttgaaacttcagcaagaggaaatggaacaaacactcccacatgatagcaatgatccacagtttaagtggtggaacacaataaatccagaaactgtgaatctcacgtatatagaccattactggcactttgtggacatttgtaactctcatgactatttttgactgtactttatctacttgnacgggggggtgggtaggggacgttaactttgtgacttcgtaaccaataaagaacgttataatctaatttag

SEQ ID NO: 657521 - DNA, 187 bp, Homo sapiens
cagctcggtatctagcttccctccaaccagaccaggcttttagaagtcgagtgtggtacacacggcctcagtaggccaacccgcttgagccttctagccacggaagctgggagaggggaaggcacgaggtcctgcagtggagcctggcccagcttttcccttcgctctcttcccgctgtcccgtccc

SEQ ID NO: 657522 - DNA, 1282 bp, Homo sapiens
ggggcttacaactacacccccctcgcgctgctatttggtgtgctcgctcttgtcactgtctttaagtgtgctttgcgccctcttaataggggggcccacctgtgatgagtgatggttgttctgggaatctcactaccgggtgtgtccttgtgaacattgggtggggaactttttcttggggtccctttttgtgccgcccccgtcctgctcattcgtatccgtttaagggccctgtataaaacacgggggcccttttacctctagggacaccaagtggctgtggtttataaaagttgccaccgggttggtatctaatcccgccttgtcgctggtaagagtatccgctctacaaggtgggccagggccccctttgctcgcccaaataatcgtgtcaagctggttcccccggtgggttctcccgggggttatacccccaatacaaaagggtttgtaatgttgtggaaccatagagggccccccgtggtggagtataggcctttgtccggcacttttttgggtttctttttttcttgcctgttgccccaagagtgtattcgctcggataatcaaaatggttgttgtcggccccctcccccacccgtggtcgccccagacaagggttgcccccacaggcacacccttgggggacacaatatggggcccccccctgtcgctatcggtgaactgtttctccccttatatcgcctttatattgccctttgagatggccctgccgtaaccttgccaagcaatttcagaaataatgccccaagatggggaaaccaattggcgcacaggtggaaacccactgcccaagagtctcccttattttgtttttttcctgagaaccggaggtcttcacctcttgttgccccaggactggagatgccaatggccacaatatattggcgtcactgcaacactccgcctcctgggttcaagcgattctcctgcttcagcctcctgagtagctgggattaccaggcatccgcccacccacgccccagagtaatattttataatattttagatagagacgaggtttcgccatattggccacggatggtttcgaactcttgacctccaggtagtccgccttcctcggcctgccccaagtgctgggattacacggcgtgagccaccacaagcccggccagctttcttaatgaaatattttcctataaataaagtgggtaatccggttataaaaagtttttcacccggaattaataaatctattttcattttgcaataataaataacaaaaaaaacaataaaaaat

SEQ ID NO: 657523 - DNA, 459 bp, Homo sapiens
  misc_feature (27)..(27): n is a, c, g, or t
  misc_feature (73)..(73): n is a, c, g, or t
  misc_feature (146)..(146): n is a, c, g, or t
  misc_feature (148)..(148): n is a, c, g, or t
  misc_feature (154)..(154): n is a, c, g, or t
  misc_feature (162)..(162): n is a, c, g, or t
  misc_feature (166)..(167): n is a, c, g, or t
  misc_feature (198)..(198): n is a, c, g, or t
  misc_feature (217)..(217): n is a, c, g, or t
  misc_feature (222)..(222): n is a, c, g, or t
  misc_feature (241)..(241): n is a, c, g, or t
  misc_feature (258)..(258): n is a, c, g, or t
  misc_feature (296)..(296): n is a, c, g, or t
  misc_feature (302)..(302): n is a, c, g, or t
  misc_feature (307)..(307): n is a, c, g, or t
  misc_feature (310)..(310): n is a, c, g, or t
  misc_feature (319)..(319): n is a, c, g, or t
  misc_feature (322)..(322): n is a, c, g, or t
  misc_feature (327)..(327): n is a, c, g, or t
  misc_feature (335)..(335): n is a, c, g, or t
  misc_feature (338)..(338): n is a, c, g, or t
  misc_feature (341)..(341): n is a, c, g, or t
  misc_feature (355)..(356): n is a, c, g, or t
  misc_feature (380)..(380): n is a, c, g, or t
  misc_feature (404)..(404): n is a, c, g, or t
gtttattttgtggataaaggtcccctncaggaggctgttcacaaaaataaccctacacgatatcaacgtttanaaaacaaatcttaagactataacactaccttatttcttctagaggatgcatttgacatgccaactctcattcncnaaaatncattgttncatnngggttgcccccgccccccacatccgcacacnactgtcgacgtggtcgccnacacncatatctgtcgtgagagcncaaagctgcttctgcancgacgctactccactaaatcgagattcgcctttgcagntagggnggcgnctnctggacttntgngtgantggaaagnacngtnctccctgcataacnngagattattttgcgcgacacgtcngccaaagacaccacgaccctgccnttctctattgtatagagatgcgactcataagcagcgctgatcacaatatgtcaag

SEQ ID NO: 657524 - DNA, 1034 bp, Homo sapiens
gcaagggcttccttttctccacattttcaccagcatttgttactgcctgtctgttgaatgtaagacattttaactggggtgagatggtatcttactgtactttttatttgcatttaccttatgatcgatgatgttgagcaccttttcatgtgattgtcacttctatgtcttcttttgatcaatgtctattcagatcttttgctcactttttgattggatcatatttttttcttttgaattgtttgagctccctatatattctgcttattaatcccttgtcagaggggtagtttgcaaatatattctcctattctgtgcattgttgattgtattatttgctgtgcagaagttttttaactggatgtaatctcatttgtccatgtttgctttgattaccggtgcttgtggggtattactcagaaaatctttgcccagatcaatgtcctggagattttctccaatattttcttgtagtagtttcatagtttgaggtctcagattaaagtctttaatgcattttaatttgattttcgtatatggtggcagatagaggttcagtttcattcttttgcatatcgatatccagtcctctcagcatcattaatctaagactttttcctcgtgttatgttcttggctcctttattaaaaataagttaggaggctcacacttgttatcccaggcagttcgggagggccaggccaatggctcccttgcaggccacgagtttgcgacagcttgggcaacttggtgaaaaccttctctactcggcatcagaatcagtgatcccggagctggaaggtttcagtgagccaaatttaaccacatgtgtatcacgccgtggggaaagaggccaagatcatttctcaagaacaaaacgttctctaaaaaagggaggcacacataacggaccataccacacggccaaaggcgcaccagattatataaaatctgaacacgcagatatgtcatagacaccgcagtaacattaaacggacatgatggctaccagacaagcttgttctatgaactac

SEQ ID NO: 657525 - DNA, 241 bp, Homo sapiens
gtttttttcagcctgtttccccagccacaggcctggtacgacccccaagatgtgccgcaagcactgtttcaccattccgcacccaccaaacaacaaccaggggtggagtccaggccactttcagctgctcctttttccgggcatcgtgtcttttctttgctttttctttcttcccccacttttctttttttgacccctcccctccggtgggttttgtatcaaagctcctcaaaccccgtca

SEQ ID NO: 657526 - DNA, 322 bp, Homo sapiens
  misc_feature (14)..(14): n is a, c, g, or t
  misc_feature (148)..(148): n is a, c, g, or t
  misc_feature (153)..(153): n is a, c, g, or t
  misc_feature (156)..(156): n is a, c, g, or t
  misc_feature (174)..(174): n is a, c, g, or t
  misc_feature (206)..(206): n is a, c, g, or t
  misc_feature (245)..(245): n is a, c, g, or t
  misc_feature (252)..(252): n is a, c, g, or t
ggatgttgccactnagttgggaaaaagctcaaccctaactgttgcatgttgttggaatcctccctctgtacttcccagtctgggccctgtggggaccctgccctaccttagaaaacatggagacccatcccctggtaaccaagttagnagganaanaggtgagcacccaagggncaggggcaaccctgggagggagccatggagantgggagcctggaggggtgccttatagccatttggggagnagagggntctacaagcctaaggagacccgaggccggttactcccatcatgccttcctccctctcctgcaggatttcg

SEQ ID NO: 657527 - DNA, 818 bp, Homo sapiens
actcggcgcagccaagagcccgaccctgggtcaaaggccctgatggcccctgcctggaactgggccagtgaccctgcgcagccgctgtatctgccccctcgaggtcagtgagctgctgctgtgcccagagcaactggtgcattgtctgcctgatgtgcagtgctgacttggtgtgatttggccccatgccccctgtgctttcctgctgctgtgagttgtgcttgtgtgtgctgtgtggctgtgctgctgtgcttgcagtagtgcttatgatgatgtcctgcaccatgctgcctgctgtgcctgtgtgcgtgatgatgatgtgtgttgctgtccctgtgcagtccctgcactgactgtggcccctgccgtcccctgtgttgaccccagcgctcctgtgccctctgtgtggtggatgttgtgctgtggtctgtgcttgctgcctgatgaccctcctgtgtgatgcccctgcccatgactgcctgctcctgcttccatggccagccctgtgtggctctccatgccctgctgctctgctctgtaccaagatcctagacatgaggttcgagcaaggcgatggtccctggcaaaatgcaatgaccttagcccagtcagagaatctctctgatttgctgtggccttttggctgatgtgcctgtgctggacaccctaacctcttgtgggctgctcgctttgttgccttccttcctttcccgcacgccccctggtccgcaacccctgtccgcttgctgtgacattgtgttgtacacattgtgagccagcgcgggctcccctttttcctgattgctgcctcgtggccg

SEQ ID NO: 657528 - DNA, 174 bp, Homo sapiens
tgctctttcccggcgatccgctgcgtatgtgcaacgccgatgcttgcgcgttcgacaatgcatcgtttccgctcggaacagacaggctgggtcgtgatgtgctggccgagcttttccatgcgagccgtgcatcgctggtcgtggggctggccgcagcggctgcatccattctga

SEQ ID NO: 657529 - DNA, 938 bp, Homo sapiens
agcgggggaggcggcggcgcagacaaaggcacgggcggcgtggagggcggcgcggactgagcgtgggccaggtggcgcgggtggtggacgtcgaggctcgtgtcgagctgttgtgagctgcgtgagcgtgccttggaccggcctggctgagtttggctgcactgtagccgccgtggtgcgctgtggcttatggaacggcatttccggcctgtgcgcatgccgtggccatggctggcgccggggcgtgtagtgcggggcgcctcaatttcggttccctgtgactggtccgatgttaggaggggggatcctcgaagcgtttgtatcgccccattgtttatgcgcgcctgggggctcggggccttaggcgcgtgggcgtgtaggcgtccccagttgcggcgcctcatgggctgtgcttcggtggaagcggttgggagagccttgtttgggagggcaggcggttcttccagatgcggttggctacgaaaattgtcgtaaggaaatctcccctctagaatataccactctgtagttacaccgcctgttgataaaagcgcggtatgaaaaaaaaaaaaggttcattcacaaagaagctctgtcgaattccggggctcgaaattacccgcgggcctttgaatcgcgtccccgagaagtgcgcgtgtgcgcacccggggtgagccccaaccgcctggtttttaggtcaaaccccccttttttgagtcttggacagggggtgtttgaaaatgttagggcgggatgaccatttgtggccggaatgacacttcggaggggcgcctccaattcacggcttcgggctccacccaccgtgggttgtttgcaacacatttgttgtgtttacatcccaggtgggttcaacataacactgtcctacacaacaaatttactaacggaaaaaccaaatatggaaaagacacaaaggc

SEQ ID NO: 657530 - DNA, 497 bp, Homo sapiens
aataaacatctgtgtctgtgtctgctgaataaaattaaaaaaacgaactcgcgcgcctcgctaaaaatgggacggcgaaaccatagcagacaaaccccccttggctcgaaacagaaatatactataagtgaaaactgtttttggcggcccccctggccccaatctcctttggcttgggccggttttttcctgcgggcccaattggggcccctttggccctttcccccctttggggggggttttccgtcctcccggccgggtgtttcaccccggtggccggggaaaacccggggggtccccccctttatccccggtggggcccaccccctttggcccggggggggtatttggcaagagggcccccccggttgccctttcccaacgtgggcccccccggagggcgaatgggaatttggcaccgtaaattttttgtgttaaactccgggtaaagtttgggtaaccccgcttcttttttcccccaaggggcccgaatcgtg

SEQ ID NO: 657531 - DNA, 382 bp, Homo sapiens
aaaagaagtgttatttgtcttgtttgttttcagttctcgtaactgtagggcttaatgagggagagctaatacaggacagaatttcagaatgtagaggtccacaggaataaccaatggcaacctccttgtagcagagatggctatctattcacctaaatcatctcctctttattctgggcacagagctggaccacatttcccagcttcccagtgaccatatggtctcctgatacccacatggctgacttccacaaccagtgaaatgtgagttggagttatatgtgccccttcctggcctggtccatacaactttccttcttgccatcttccatatcctcctccccagctcttacttttaggtcattaatccagtgtcgacgcg

SEQ ID NO: 657532 - DNA, 254 bp, Homo sapiens
ctaggctggggattgaactaagtaaatgaagccaggagtacagatctagatcgcagagaattcagtctcattctagaaacattgcaactactgttagagtccaccccatgaagctgtgacacattgtgtatacatctgacttaattctatcgcgtatatagtatgttcagactatagacacaatgttgctagctagagttggcctgtcgcagtctcagtcaggacacttgagagtcgccagataagacccacag

SEQ ID NO: 657533 - DNA, 319 bp, Homo sapiens
gtgtgtgttgtgtgtgtgtgtgtatgtcccatggtggagtgtgtgtgtatcccatggtggagtgtgtgtgtatcaatgtgggcgagcgtatttttacataaatgggcgtgtgcgcgcagaggatgtgtgcgtgtgcacaatctgtttatgtatcatgtgcacatgcctgcaaatctgtgtgtacaggggggtgaacaggtgtgtgtatatatgcatgtctgtgtgtgactctgtgtgcatgatcggtgtgtgtatgtgtatgtgtccgagtggggaatgcaggtatgtatgtgtgcatgcaagtctgatacttgaatcc

SEQ ID NO: 657534 - DNA, 768 bp, Homo sapiens
gatttcatgtcttcctccagcatgactaagtctggaacagcaggaagggttgatgcttactgacctggtgatgttagaagacaagtagtttatggatttaaacattagagctggagtggggctggaaatctttgtaaaggaagttctttcagtaagatgcccctgcttgtctttgtctcttttttgtttaacaaggtaacgttttcgtttaacaaggtaacttttagtttaacctagattttttttaaaacttttcttctgtgttccatatgggaaacagtacattcatatccaggtagaggaaaactgaccaaaacagaagcaaaacataagaaagattaaaataatctctaatcctattacctagaataaaacgactatgaatatttgggctcggttacctgccaaggtgtaccggggtatacatggatatctggtcggtttttaaacaaaacgatgggatcattctgaacatacgggcctatagtcatggtcagctaataatatatcagaccttatccaactactgcactcacactactcctacaacctttgtcgaacaaatgtctatgaactattccatcgctatagcactgtgcctctacattggctgtgacggcggatcctccttacgaacagaaaggatacgcaagcatactgtgttggtgaaaagttacacaaaggtgcatcgcatgtccatggggagaaacatggtaattaaacactggtcaccaccttgcacaaggccatataatgcccaccaaccca

SEQ ID NO: 657535 - DNA, 842 bp, Homo sapiens
gaacactttgaggtactgtcttaaaatttgtgggccctcatatggataaaggcagcaatcctaaggacttgtgtttctttgaacataatctgagaaatttctcgtgtagagcagagactttcaaacctttgggctgtaacccacaggtaaaaaacgcattatatatcaaacctttagaatatgttgaatgaacaagtacttaccattctgatgctttcatggtttcagttttaaaatatgccagttgcaacccactaaatggatatctaccaatgggatgtgcaacccattagacttgaaaaaaacacccgtcacagaggaactggatatatcgtagaagtacctgacgtgatcaagccaggcacattcaccgaggcacttattacaacgctaaggaaacctgggactatcagcagaaaagtacatctggccagcagcgattagacactcacacataacagaaggggctgaaagcacaggaaagtgttgaacctaggctcgtggaagaagacatacgaaaacaacgttgatcagagtggtcatctcagaacgatattaccaggccgtcgtagtacagactagtgagcaaaatggagagagatagggaagagacagagggagcgcatcaagttgccacatgacaaaaagccccaaaggagaacatctatgagggcagaggcaaaaagaggagaccaaagaaagggaaatacgacatagggagagcccacagggacagtataagaaaggaaccaagggacgtggggggccaacacgactaggggtgggcagagaaataactggaccatgagagtggaagaaaaaaaaaacacataacggaacgt

SEQ ID NO: 657536 - DNA, 803 bp, Homo sapiens
gctgcattgttgaggacacgagtctcgggaggcatgattcctatgtagaccctgggtgttcgccgtctgcgcttgtggagtcttcggtgcgtggcgcgcgcgagcttgcttgtcctaggccctgtgctcgtgggtgcctgctcctcgtcccacattcccctggagcgttctctgagtctcgatgtctgcgttgttctgggctgcgtctctgcttggggatgagttggtgccttggcttgcctccgagtgcctagtggctcgctgtttccacgtccagtccccaagttgctactagcagtccatgtatcctcatggaggccatgggaccaagcactccgggtgctcggagctgtctagctgacagtgatggtcgtcaccttcgtcggtctggatgactcattatagacttgtggtttatagcgtcatagcttccgttatccttgttttgatcgtagagctggacttggtagtttgggttgacacacgaattggagcaattggccttggcacacaatgtattacattgagacgcctgtcgagctgcttcgcctgaaatactggttgcacctcacacgtacaggaacatccactgcgaatggtgtggaaacgtcactgtgaattcctgaggagacacatcgttgcccgtcagtggagaaaccgcgctcgcttcggttcttgtgtgagacccccattcgttgtcggtttattcgcgcccgtcccgttcgagacgacgcggcacgcccttggaaggcaaaggatgtgcacgaaggggatatctgccaggaaaggctggatcgtccctc

SEQ ID NO: 657537 - DNA, 456 bp, Homo sapiens
aatgtcatataagcgcatgtaatggacaaccattaccagttaatgtttatcacaccgttaatctacggtcttagctgtgcatttaggagatcttgtatgggtattagttatactgtattgaaattatatgaagagctctctatatatccttgatttctgaactggtgttgttgactatgatatcccatgacttggatctccctacaggtctgagtctcccatatctgcaagagattctgcaggaactgggtgtgcacacggtgtcgtagccagttcaggtactgaatatttaggatttggcgaagttcactgtattgctatatttttgtagatgaataaaactcaataaattgttaatcattctctttttgctgtatagaattgcttatatcactctttctttcatgacattggttaacatttaaatgttcctcctgtacttgtgtcgtctgtgac

SEQ ID NO: 657538 - DNA, 184 bp, Homo sapiens
ccggccccccaaacaaacaaaattctccttttggtggtgcccagggcattgggtgcccatttggtccccaaagcccctagttctatttggattttcccggggggttcctaaagggtgggaaatgggtttccagggatttttccctttcccctgatttttttccaataaaaatttttaattccca

SEQ ID NO: 657539 - DNA, 418 bp, Homo sapiens
cctttcttgaagctcaattggttaagtgactgtggctgtcccatgtgtagaagccaaagattatgtggtaattctggtaacctttcttaagagaaagctgctacaatctatattcctaagtcatcccctcttccttcctgctgcttggaagatttttttttttttggggcggggtgtctctcgtcacccaggccggagtgcagtggctcactgcaacctccacctcctgggttcgggtgattctcctgactcagtcgcctgagtagatgggatagcgggcgtggtggcatgagcctgtagtcccagctacttgcgaggctgaggcttgagggtcgcttggcgccggggggcagaggttgcggtgagctaatcgtgccattgcactccagcctgggtgacagagcaagattctgtctca

SEQ ID NO: 657540 - DNA, 685 bp, Homo sapiens
gaggacgtggagtttggttgtcattacatattcattggctctcacttctgcgacattctccgcgcctgctagccgcttgggtccccgcgctgctgggcgacatggtcgctcgcgcggcttctcttcacagctgcgcccaccccgaccacaccaaggaagccgacgaggccgagtacagggatggaccccggcgggcctggcggaaggcgacggaagcttggtgaacgcttctagggacctagttacaagagttcccacagcccaaaaagtcttctcaacagctgtgattggaacgagccctcggcatctcacatgcaaaagacacactagctctagcgtgcacacaaatggaccgacagaacaacgacaagtcacactgcacataacatggcccacgagcgtggacggtaagaaggctatggccgccagaagatcgactgctgagcggcaggctgcagctgcagcctgccagctgttcacggagttggggtctgctaaggtaccccggtaatgagttgtttcgacgcagccaaatacccgagctgctagctgcatcgctttggcctccctgccgacagctggtggcgtcggaacccagcatgacacctacttcctggcggcagctgaatcagagagtatcgaccagggggacctgggggcctatccgctctttggccggacgaag

SEQ ID NO: 657541 - DNA, 671 bp, Homo sapiens
  misc_feature (536)..(536): n is a, c, g, or t
  misc_feature (581)..(581): n is a, c, g, or t
  misc_feature (589)..(589): n is a, c, g, or t
gccagccctccgcagatgctaggagggaagcttggaaggaattctccccacagccttcagaaggagccaatcctattgttacaggaaaggggtcccgatccagatcccaagagagggttgtaggatctatcgcaagaagaattcagggcaagtagtctgtaatgtgagagtaagtttattaggaaagtaaaggattgaatggctactccatagacagagcagcctcaagggctgctggttgcctatttttatggttatttcttgatgatatgctaaacaaggggtagatgattcaggcctcccatttttagagcatatacggtaactttctaacgttgccatggcattcgtaaactgtcatggacctggtgggagtacagcaagaacgaccagaggtcatcctctggtggccatctaagttttggtgggtactggtcggattctgtaatgcaaactgttttatcagcaaggtctatatgacctgtatcttgtgctgaccttctattacattctgcgactaatgaatgcctaacctnctgcgaatgcagcccatcaggtctcaggcatatcttacccagctnctattcangatggagttactctggttcaaacgcctttgacactatgacactctggtttttggatttctcatctcctgaatggagcttttt

SEQ ID NO: 657542 - DNA, 373 bp, Homo sapiens
cccagagtccaaacagagccaaactgtatttgagggaaaactcacgaggtgtattcaacatctcacgcggcacaaacatataagaaaaggtgagagggccaccaaacacggacaaggaaaaaccaagagccacgaagtgggcgtatgtgtggatctaagcttcctaatggccaaagtgaaaagggaaatgttattaacagcccaaaaccagcctgactggtttaagtgctcttcttttcttcacccaataaattcaccggagctttcttcgcttctttaatgatggcatttgcagtctctttggccttgtctttaaaggccttgaccacactgttcatttgggacttgtgcttcaagaagaaaggaccgatga

SEQ ID NO: 657543 - DNA, 433 bp, Homo sapiens
  misc_feature (103)..(103): n is a, c, g, or t
atctcgaaatatgaaggccctgttctgcctacattggggttgggctccaacatgtgaattttgggggtgcataaactttcactctgtaacacctccgttctanctgaatactgttcatcatttatccagagatacatcgccctatttgcaaataggatataatatccaatctatagtggtagatacaaccttttctccaaatcctcatccaaataacattgctgaaacctagatatacctttcccagatcaataaattcggctccagtaggcctttgggtttgtcctcatgactgatcttgcacagcgtctaatgttgtcccctgaatctctttctactcacttaacactgttgatactaactgaatgtgcttaggctgcaccttgaagtcacggaacctcttatcctcttacattacattatttctgcttcg

SEQ ID NO: 657544 - DNA, 301 bp, Homo sapiens
gaggtatccccccctccccgggtcgagactgaccatgaaacaggtcatgcctgatctgccgtggtctaaggcgttctatccatcgacatcgccgtgaagtgtgagagcaatgggcagccggggaacaactacgagaccacgcctcccgtgctggactccgacggctccttcttcctctatagcatgctcaccgtgtactagagcaggtggcagtaggggaacgtcttctcatgctccgtgatgcatgaggctctgtacaaccactacacgcagaagagcctctccctgtaccccgggaggg

SEQ ID NO: 657545 - DNA, 645 bp, Homo sapiens
ctggattattcagactcatcttatattgctaatgacggctgacatctgattcatgtgttgttggacagcgttgatgagaccagctttacgcatttcgagagtttcttcgtactactagaatttatcaatctattgccgatacattcctgcaatagtgtcggttatacttttgcagaggaccgagtatttatactacatacattgaggcttctgcataacctctaatgatgggacagttgtttgaaccaatggtgccactatagctagcgttcacattgttacctagcttggcaccatcacaggtgcttacagatcctcttggtattatgtgcgtcggatgtgattgtcgacgagctgtagtcatgcataactctaatctacacatacctgggtatatgatcagcattatactttatgtctgatactgatgatttacattaatattactcgatggtatgagctacatggaatactgtatcagctagattacagattttgggccatgtgtgctgcatgactggaatgtttaggtctttacacagatatctctattactatgcgtatgctgttgaacccatatgtggcagcacgtagatctgtggtatttgtggagcctatatcgggatcatttccattgccttgtgg

SEQ ID NO: 657546 - DNA, 312 bp, Homo sapiens
atgactggctcatgtggaagtcaagccaaacccaatggcaagaagcccgctgcggaggagaggaaggcctacctggaagcctgagcacaccaaggccaggatcaccgacttccagattcaaggagctggtggtgctgccccgacgagattgaccttaacgagtggctggccagcaacaccacgacgtttttccaccacatcaacctgcagtatagcaccatctcggagttctgcacaggagagccgtgtcagacgatggccgtgtgcaacacaacagtactactggtatgacgagcggggccttgtacgacg

SEQ ID NO: 657547 - DNA, 650 bp, Homo sapiens
gcggccgcccccaggccagcgagccccgctcggcctgactgacagcgaccctccccgcggcgcccccggctcggcccacgcccctccctcgccgcttcctcaccagggatcccccggcctgcccgccggctcctgtccacgaacctgctctttctttacctttcgctctttttacctcgactgccgttgcttttccccagctggggctctcctctcctccccgcctactttttgtccgcgcttcccacttttctcctcctgccccccacccccttccttgcttcttggcctctccccctggaaatcgccccctcaccgtgatccaagcgttaaccgctgccatctcattggtccccagaccattccagggttccagcataaactgggagaagagactcgggaaggcggggaacggaaggtgggcattgccctgggaaactcatgtctgagaagccttttggcagagtattttgcgttggcacggagtcttcacccccacccctccccccgaagctcgcccacccctgaggacgtggccaaggagaggagggcaagggtggctttgcctgcctggaatgttctgtgctcaagtgtgggtggatggagaagatgttaggctgaaataaagactttttaattcaacgaaaaaa

SEQ ID NO: 657548 - DNA, 543 bp, Homo sapiens
  misc_feature (5)..(5): n is a, c, g, or t
  misc_feature (81)..(81): n is a, c, g, or t
  misc_feature (119)..(119): n is a, c, g, or t
  misc_feature (146)..(146): n is a, c, g, or t
  misc_feature (155)..(155): n is a, c, g, or t
  misc_feature (181)..(181): n is a, c, g, or t
  misc_feature (183)..(183): n is a, c, g, or t
  misc_feature (197)..(197): n is a, c, g, or t
  misc_feature (292)..(292): n is a, c, g, or t
  misc_feature (321)..(321): n is a, c, g, or t
  misc_feature (337)..(337): n is a, c, g, or t
  misc_feature (429)..(429): n is a, c, g, or t
  misc_feature (437)..(437): n is a, c, g, or t
  misc_feature (459)..(459): n is a, c, g, or t
  misc_feature (464)..(464): n is a, c, g, or t
  misc_feature (474)..(474): n is a, c, g, or t
  misc_feature (522)..(522): n is a, c, g, or t
gaaangagggggcccctaaacccagaacacaccccaaaaagcattaaccctacaatgcatggaaggagtaggaagagaaangagagggggtttgaagaaggagtggcagaatgaaaaancaagtaagtagaagcagaggcgaagtnatcaatggnaaaccaggagaataaagaaggaaaangnagggaaagggtgcngtaaaaagatctacctgaaaaccccaggaagaggagggggccggcttgcctgtaaatttaatattaaattggggatgggaatagagaggaaaaantaattcaggggatgaatactcagcctctnagcctgtacaagaaangctgaaggcccggggcctcaccagtaaaagcggcgggactatagggaaggggagtactcaggtccctggatggccaggaggggaggcccctncgcccttngtcccccagcccctgaggactnaagcngccgaaactncaggggacgctgctgccggaatcgggaggtctcccgccgccacttgtnatcaaacgctgcggcctcact

SEQ ID NO: 657549 - DNA, 210 bp, Homo sapiens
agatccacagcatccccaggacctcttctcccctctgggtcctgcccccatctcactggctcccatctcagattccctgtgaggctccacgcttggcttcacatgcaaagtctaggggtgaggggcccctcccagcctctcagctgacagtcctgggcctgtggtgagaataaaagccctgtcagaccgcagccggaggagccgcatggc

SEQ ID NO: 657550 - DNA, 478 bp, Homo sapiens
ccaggtgttaaaattcaaggcaatctggaacagggacctattttatacttccttaggagcacttttcaggagtccttttacgctgctttccctgccacgaagcgcttggactgcttactaaagccacgtatcctgattttacagaaacgtgggcaggtccagcagtgccactggagagctcccagagaagcccactcagaaggaagtggtcagaccaccctcgagccagagcggctggaagctggactggtcccatgaggcagaaggagcaccagcgcctgctgggtggtgtggggagagccctcagctgactctggacacacctgcttccggggcacgtggcccagagccgggcctgtggacgggcctttctttcttcttggggtggaccccgtccccacgatccctaaatggccaccccccagacagcccaacaggcagcgagaggcctgcaggcactgaggatgccaacagggct

SEQ ID NO: 657551 - DNA, 647 bp, Homo sapiens
tgcgttaggttggggtgctgatgtggcgctgagtcggcgtgagcgaggatgtggggtcgcgcagcccatgcttgttctgggctgaggctatggggggacgggatgacaagagcgttgtgcgtcatcgcccgctagcgggcagttgcttgggatgttgttcggcttgtgtggcccgggtggtcttgctcctgtggcggtctgcgtggcttcgtgcgtggccctgcgctctggggtgggtgggtgtgggcgtgtcggcgcgggcctgtagggcagtcgtggtcgtcgtggtgcctatgtgtgagcttggcggcctggccggttgggcgtgtagcccgttgtgggtgggtcgcgtttgcagggtggcggcaggagggccgtcttgtgcaggacagggtgtcgggttggtggcccttggaggtttgcgtgggcgcacgcccgggttagcgcgtgggcggagcggcaggtcacccatcgtgccgtgagtgtgagggcgtgccgcatgccgtggactgcctgatggtggcctccgctgacctctggtcccactgggaagactcagccctgcccgccagccaagccagaggcctgtgcagcccacctgggagggctcgtgcagaggcaggcctggactgggctggggccagctt

SEQ ID NO: 657552 - DNA, 289 bp, Homo sapiens
  misc_feature (7)..(7): n is a, c, g, or t
tgctctngtgtgatctagagatccccatctcgactgggtaataatacaaacataagtctccaatagggttgatagatgggtccaatggggttgtgaggagtcaggtatatgtgggaatttaaggtagtgggtgtggagctggaacgcttcctaaatggggggctgctttaaggcctactaggggtgtaaaatttttaactctctctacagggtttttccctagtgtccaaagagcggtccctcttgggactaccagttaattttacatgggggtacccattcgagatat

SEQ ID NO: 657553 - DNA, 240 bp, Homo sapiens
cagcccccacaacgcgcccttcaccccacccccacacccccactttcccacaccctgtgggtaaccctgtggtccttaggaggactacttccccacaagaccagttgaactaaattccattgaactagaagttaagactgccatccaaccactttgggctccttatgcctctgagtcaacaggccaataggggagttatggtgttggctgcggccaactgatccagactaacatggggca

SEQ ID NO: 657554 - DNA, 289 bp, Homo sapiens
  misc_feature (288)..(288): n is a, c, g, or t
aaaaaaaaaaaaaaaaaaacatggtctcccatccagaaccagaacaagagaaactataagccccccaaagtaccaggcatcaatcattgaaaactacaaagagaccagagcaggtctgaacacggagtccttacccatgggcttccgtatgttggctcttcccaggtccttaattagaagagccaaaaagtcttaaatggaaacgttttctaactgtaaaggataaggtcacatcgagtcacttaaagctggctttactgtggggttcatacacacctggctcgaacnc

SEQ ID NO: 657555 - DNA, 231 bp, Homo sapiens
aaaagatatctctgataagagggtctctggaccaagaccgaaggctgctagtggatggccaggaaattgctgtgagtttacttccagggatggctacatgcctcgatcagtacagtctacagaacttgggaagcacgtctactagctggagaggtcacatagctgccaatgtgcccatgacatttgccacccgagctggcatgagacataagaaaggtgcaagcaggagct

SEQ ID NO: 657556 - DNA, 476 bp, Homo sapiens
acaccagacaccttactaaccttgagacgcgagaaacctactggaggctcagaaggcatctagctgataagttgacggagctgtgactgctgtctgccttccgtagcagcatagcctgggcagcatgtcctgaggttacctcactcctttcttcctcttagcactttccccatgcatccctaacatttatctttcccagtttattccaaccgaaactgtatgcagagactccagtgacagtgggatccatatgggactattctcttcacttgaggccaccttggtgtcaaaagcctttgcagtccctcttagctgcttgctgtgtgagccttagctcttgaaatcactccttattcaactttcctttcaatagacctacgagaattttctctttctgctcttctcaattttccagcctctccattccattatttttgacaaaaaaaaaaggcaaagaaaagttacagagccccaaa

SEQ ID NO: 657557 - DNA, 1399 bp, Homo sapiens
tcagattcattttaagggaccttaaccgtgttcgcttaagtttgtgttctaaattagaattacagataaaacgttgacgtgtaagtaccatataatgattttatatttttattaaaaggttttttttagggctggtcaagttgaagcaggtgggagttttagcagggacacaaagaacttcgtgtacctggttgtgactcaatctcgtgtgtaaacaccacgtgcacctcaggccagccgtgattttaaaatattcacacagtccaaattatcttgggggaaattctttgcaagcattagatgtgccagaaatctgaggacttgacacgggattcattttattctaacgacactggggtgtcgctctgtcacccaggctggggtgcagtggtgttgatgatggctcactgcaggctgaagcttctctgtacctaggtgatcctccgtgtctgggcttcctagtgggctgggactcgcggaactgcatcacccatgccaggctgatattatctattattcgaggcacggtcgtaattcccacgtggttttaccccaatggttagatctttcgacacctcttggcggcctaaaacgagagtactaccccaatggtataaagataccacataatactcggagttatcgagatttttagcccatttgcccactgaagcgagagttaacacacatctactgtattaaatcacacaaatatttgtgaatgcccacttttataactctccatacactttggtataagagcgtggctcaatagattgaaatctacctcaacgagactattatcacattttggacacctccgcatctaaattgcacggacaaggcgaccctagtgtccccgaaatatgtacacgcgcgcctcccatgcgataaataaaaagcagacaaacattataaacacacctcaggagacaaaagaataaatgacacgcgcggcgcagatgtacgatagctcagtaagactcgcaagagcatcaaacaaccaaacaaacgacgccgaaaaaggtgcatgcgaatcccgcactgtgcctctggcacgcctgagcactataagcagccgacaccacacaacacacaaccagacaacacgcaacctcgcatagaagcgataatagccagctagatgtagtgaagaacacacggcacagccgccagtaaagactaacacatacggaccgcacacaactacaagatcaacatcaaatgtacaccgaactggagtataagaagcatagcgtagctacagacacagcagtgcgagcaagcacagcacgagctacgcgagtcagcgtgaacatacagacaaacaagacaggtacgagggccacaagagtagcacaaacgacaacataaagagtcagtataacagcaaccacag

SEQ ID NO: 657558 - DNA, 231 bp, Homo sapiens
  misc_feature (51)..(51): n is a, c, g, or t
  misc_feature (67)..(67): n is a, c, g, or t
  misc_feature (106)..(107): n is a, c, g, or t
  misc_feature (113)..(113): n is a, c, g, or t
  misc_feature (117)..(117): n is a, c, g, or t
  misc_feature (128)..(128): n is a, c, g, or t
ccccgctctggacagtcaccgccttcgcctcccacatccgggccagggacncggcgggcagcggggncaagccgggcgctgatactggtcgctgacagcgccaaanngaccancaanatgattttagngtggactaggacccttaacctaaaaaaagtttcccttaatcattcaaatccctatttgaagggtcccggagcgcaaaataaagtttaaaaccctgctccccca

SEQ ID NO: 657559 - DNA, 426 bp, Homo sapiens
gtgctacgagaaactccagattttatcattacgggtagtataagtctatgctgagctcagtacaaaagaacaaaaaacaaacaaaagagcaacaaaaaaggaaacagtacatattactaaagtaaaagactaaagtagagaagtatcatttaaaaaaacagaacatttacaagacaccagttattttgtgccccatatgtcattaaaaaagttactttacctttattattatttccctaggctagtcaagcagcaaaccattaatcggtcggagaaaccttcatgacatatgcccgactggctcttcgccacccacttgaaggacactacccaatcgatggaagcctttaatcgcacagccctccctattagcggactattggcggatgcagacatgttctactcgagcagttaccaaggaccact

SEQ ID NO: 657560 - DNA, 212 bp, Homo sapiens
  misc_feature (51)..(51): n is a, c, g, or t
  misc_feature (67)..(67): n is a, c, g, or t
  misc_feature (106)..(107): n is a, c, g, or t
  misc_feature (113)..(113): n is a, c, g, or t
  misc_feature (117)..(117): n is a, c, g, or t
  misc_feature (128)..(128): n is a, c, g, or t
ccccgctctggacagtcaccgccttcgcctcccacatccgggccagggacncggcgggcagcggggncaagccgggcgctgatactggtcgctgacagcgccaaanngaccancaanatgattttagngtggactaggacacgttaacctacagaagagtttcacttacatcattcaaactcactatgtggtaccgacgctcgcaacttcgt

SEQ ID NO: 657561 - DNA, 845 bp, Homo sapiens
cgtgccagaggcgccctctacaatgggggcattttgacgcgagcaaatgatttcccttttggccgccaagcagatgtcccaatccggagaaccaattgtcggacaacggttattctgggaaaggggagaaacacattcctggatggcgtttcttctgaacaaaatggactggttccagaacgcaccagaatggataagccccagttggaccattgtcggggacttgggcaacaatcacaccttgtactcggcagttttcccccctctgaattccggttatgtttcgcgtcccctcagagcacacctggggaccggtgacaaaggaggtttcagattacatccctcctctgtccccaggccccagacattctccaaggaccaaccagccagcccagaagtggcccagtcagaggtaccagcagcccttttacccatcatctccccgactgcccaatgggggcaagcaagacactctactaaacgccaagtagaggaaatggaagtggatgacttctatgatgggatccaacggctctataatgaagattatgtctcagaaaatgtgggttctgtgtgtggcactgatttatcagacaagagggacatgcttccccctgtccaccctttgcagcctgtttctgtcaagtagtttcaaaccagtgctacccttgagtgtaaactaaggtagactactttggggatgagaacaagccaaatcaggaaggctgtagaaggaatatacctttacacggctgatttggagtgagcccagaaaaaaaaaattaaactttcattatttgtgtggctaattattattcagcgttatttaagcacattaagaccca

SEQ ID NO: 657562 - DNA, 170 bp, Homo sapiens
atgagcctggctcccacctttcgcgggtacgcgattcttccgtcgtcccaccgactgggtcggcgcagcaactggactggtcttcgccacagacgacccggctatcgctgctggcgcagttcgaaggctggcacccggacatcctcgcgctgctgcacgcctcaaacgag

SEQ ID NO: 657563 - DNA, 449 bp, Homo sapiens
gaccggggcaagccatggaacggaaaaggcagacttctaatgcgttccatttataacatgtaatatatatcaaagacttaaaggagattaaagaccaatcagaataatttggcgactttaatgcttaggaagatcaaagttccctccaaacctaatttgatgttttattactaaaagcaaagaccagtatggtacagtattactccagagaaattaaaggaaaatccttagggcggcttcacccacattcattttatgaatggatacctcccctacctcaaaatgctttagggaggtactgctaccattacatggttccttattaaatttgaaaagtgcctgaaagtttgggcaccagaaagacaccccaacaacatgtgtctaaactgcaacttcaggttaatatgactaaagcagttacattgtgagaagggctgaaggtatgtgat

SEQ ID NO: 657564 - DNA, 479 bp, Homo sapiens
  misc_feature (233)..(233): n is a, c, g, or t
  misc_feature (254)..(254): n is a, c, g, or t
  misc_feature (259)..(259): n is a, c, g, or t
  misc_feature (272)..(272): n is a, c, g, or t
  misc_feature (275)..(276): n is a, c, g, or t
  misc_feature (297)..(297): n is a, c, g, or t
  misc_feature (313)..(313): n is a, c, g, or t
gctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccatgtatcctcncaaaaacagggatgcagcctnatatnccaaaaaccagantgnnattttccaccctgttaaaggnaactttgcaagtttgnaactttgttgtgttttgtaacaggccattctctgtactagtttgtcgtggttataaaacaattagcagaatagcctacatttgtatttattttctattccatacttctgcccacgttgttttctctcaaaatcccttcctttaaaaaataaatctgatgcaaatgt

SEQ ID NO: 657565 - DNA, 870 bp, Homo sapiens
cagcttcctggaagttcacccgtgtagccccttaccccccatttcgtgactcagttccgtcaatttatggtccaacatggtctaatcattttttgccccttataccgcctcttcctactagccctggtcaattttccacctcttccactcggttatcctttctgcaaattttctcgcaatctaccattggggaaaatactttaaggcctcggctttcatatcgctgtcaattattaccccacactgcattgaattcccgtatgtccctcatgatacttttactccgaataatctcgctcccaggggtatccataactctgggtattcactatttgggaagcttgtattgtagtcccagaactcgggaactttgtgtctgtgtcaaacgtgtgaagcagtagttattatattctatttttacccgttattaattacgggtaaatatgtatgtagaactttttgagcaattccggacagagtacaagtccacatagaagtcgaaccaccgaaatgcaagcactatttgtactttggtggatattcagattcttagttttatcacttttttttaaccagtaagtcattggagcaaatgtactatataaggtgaaaaaggtgctatatatgatcattgtatgagtcatttttagtagttatactataatcagttttccaatgatatgttagcttggatttttttttttatagctatttctttactgtgataaaaaatgcatgtggtaaacacctgctgtgtcacatacattgtcattctgtccagtattctcatattagaaacacaatttattagaatttcttggttaaagtatatacatttagcgtgtaccttccgagcgagtttatgtaata

SEQ ID NO: 657566 - DNA, 114 bp, Homo sapiens
tcgctagagaaagaatcccctttagcctggggggtcaggctgcagtgagctgtggtttgtgccactgtactccaggctgagtgacagagtgagaccccttgtccccaataaaac

SEQ ID NO: 657567 - DNA, 1354 bp, Homo sapiens
  misc_feature (441)..(441): n is a, c, g, or t
  misc_feature (1354)..(1354): n is a, c, g, or t
aggagaatcgcttgaacccaggaggcggaggtcgcagtgagccgagatcatgccagtgcactccagcctgggtaacaagagtgaaactccgtgtcaaaaaaaaaaaaaaaattgttactcatcctctcttgaaagcaaaaaggaaacccttaacagctctgaactcgtggctttaattttttctggctgtatttggggtgaccattggtatgcataaggcattaagtgttaacaaaaaaaaatttttttttgggctaaaaattgcaattcaccagttaaagaaggttccgaaaaaagccttagcccttcttcttcagaagaacccggggaagtgccagaagttacttacttagagaggaacgttgaagagttccgtgatgtgcaacatctcatgtgccctgtgttccaaatgtgaggtctctttgaacacgcggaattgcnccaaaatatataaacacggagttattattttgtatatctctataagatctcttatacagtgtgggtatacaccaatttttatatgtgccgagttttatagaactgtgaaatgtggcacattaattgtctctcctctctgtgggtgttaaaaggtgtgataactctgtggtctgtggataattttgtgtctctcttctgagagacgtgcacatgtgcacgtgtggggtcccatgtgagaaggcgccactctgtgtggcccccaaacgagctgctcccgaggaaaataatctacgcggtgtgttgtggcgccgagagccgtgccttttgttataggagaagaaacgctcatatgtgtgtgtctaccgtggggctccacgacgcgtgtaatgttttgctctctctgttaagagcacatgctagtatcctcctctcctaattttgtgggccccctgtgggcgtcccataatcttccgagacgtgctcttgtcgtccgctccgtgtggtggcggtaataattccctgtttgttgtgctccccctattagatgggcgccccgcattttgatcatcggttgtctcacccccatgttggggcggacacaacactggttgtttttgaccaccccacaagctgttgctgttacaacaccggcggcagggggaatccccccagcgtgatcagagaacctctttgaacggctcgtgaacaaaccagtatcttgttgtacaccgaccacacaaaggcggctgtgatcatcttgcggcagcgcccacactattctcagaggcgggggcccctctttttcccaccgcacatttgtctctttcaaaaacagtcgtcttgtcttacgtgtccgtgacaacgggacgaagacgagactcacaggcggttttggggccccttttgacaactn

SEQ ID NO: 657568 - DNA, 190 bp, Homo sapiens
atcaacgacgactctcattctcaatctcgtctctcgctcctgagtaatttctcatcatcctatcatatccaggtcatcacagcttatttctcaaactcaatctccttatctgtcataccagtgtcatactacattatgctgacgtctaattcattcctccatatatctgagttagatagagcagcagata

SEQ ID NO: 657569 - DNA, 443 bp, Homo sapiens
  misc_feature (64)..(64): n is a, c, g, or t
acggcgctcagataccattgacacccaagataatcatctagtcaggacatacttgagcaagacntagtggataatggtgcacatgatgagtttgcatcacctgactataccttacttacgggacgaggaactgtactgcaacgtggtggagctgaagtacacaggcaatgcaaacgcactcttcatcctccctgatcaagacaagatggaggaagtggaagccatgctgatcccagagaccctgaagcagtggagagactctctagagttcagagagataggtgagctctacctgccaaagttttccatctcgagggactataacctgaacgacatacttctcacgctggacattgaggaagccttcacacgacaggctgagcctgtcagggatcacagggagccggaacctagaagtcctccgagtggtccataaggctgtg

SEQ ID NO: 657570 - DNA, 403 bp, Homo sapiens
  misc_feature (3)..(3): n is a, c, g, or t
  misc_feature (10)..(10): n is a, c, g, or t
  misc_feature (54)..(54): n is a, c, g, or t
  misc_feature (119)..(119): n is a, c, g, or t
  misc_feature (139)..(139): n is a, c, g, or t
  misc_feature (161)..(161): n is a, c, g, or t
  misc_feature (186)..(186): n is a, c, g, or t
  misc_feature (215)..(215): n is a, c, g, or t
  misc_feature (259)..(259): n is a, c, g, or t
  misc_feature (264)..(264): n is a, c, g, or t
  misc_feature (355)..(355): n is a, c, g, or t
  misc_feature (369)..(369): n is a, c, g, or t
aanaagggantgggcttaaatcaggcaggcagggctttgactccttgccaactntgtggccttaggcaggttgtttacctctctgaacctgtttcctcatctgtaaaattggggtaatncctataaaaaggaccgatanaggcccgggggtttgctgtcangcctgtaatcccagcactttggganactgaggcaggtgggtcaccctgtccaanatggtgaaaccacgtctctactaaaattacaaaatcagctggcntggtntcgcacgcctataatcccagctacttgggaggctgaggcaggagaattgcttgaacccaggaggcggaggttgaagtgagctgagattgcnccactgcactccancctgggcaacagagtgagactccgcctcaaaaaa

SEQ ID NO: 657571 - DNA, 1245 bp, Homo sapiens
tccggccttcgcgcagcgcggcagcctgctccgcttgtgcccacgcgcacctaacaacagacgaacttaaccctactgggctgcactgcttgagcaaacggccaagcaagcacttcttctacttcatcgacacgttgttcccagctgcctacacccgctctgacacaagcggacgcgcacacgcacacacgcaactggcgccaaacctctcccactggcctctcctctctgcggccgcgcacagaccaggctcagcgcccccctgcgcactccctccttaccacagccacggccaccactacagcacaaccaaaagcgcccactccactcctggcgcgagcagcgcactacaacctgcactgcgcagctactcctcgcgcagcaaactcgcacaaggcacagactacgactctccttgcgcaaacacacaacaatgcactccttctgctccggccactctcacacgcacacgctaggcaacgcaacacgggccagcacctctcaatttagccatctcactcctccacccacaccagcctaccctacacctgcaccgctacactcacacctcttgcccccacctatgccccctctacctctctactctaccacaccacaccacgcacaacctgactcctcaactgcaccctctccccctctcactgctagctaaccccattccctctctccacactaacgcaactcctccatctacccacccccaagccactctccaggcactcccttgcaatctgcacttggcacccagtcacactcttcctccgcgctctcgcgggcccgctctcccctgcagtctcctgagcccgcaccctgccccgcacctgggccctctgccggcgccctcccaccctcgcacctctacctgggctctgccacgcttctttctccgggacccttcctccaacacctcagcgctccaccccttccccacattttcccgcgcgtccccaagctggcggtctaatttcgctctctgggcctcccttaaccgccccccccgtcctctctccaccacgcgcagctcccctctgcacttctccggccacccccttgtcgcgtctgcagcgcctcaacgctggtgtctccaaaccccgtctcttcgtcgccctcacccggcacctcgcgccgcgcgcccgctcggccgcactccctgtttccacgagaccgtcctctcacccgtgcgccgcccctccggcgcgcgccctccgccccctcttcgcgccc

SEQ ID NO: 657572 - DNA, 946 bp, Homo sapiens
gtatcaacgcagagtgcccattacggccgggggtgcgtcgacgtatgtgacgcgcaagcctggccgtcctccttccctcaagcagcccgaggccatggaggctgaagagacgatggaatgccttcaggagtcccctgaacatcataaaatgatcctcgaccgatggattgaaacagcgagagcaggaccggttaactgtgactatcaccctattttgtcggacgggcaccaccaatttttaggggctcaccaaagggctggttggagcttgctggtagtaagggttctttctacaaatttccttccagggagttttaccccaagaaccatgtgggtgcagatagagggtgtgagtaaaaatggcctttcgcccatttaaaaatggaggttcacttatacgtgcacacttttaatttgatacaaggggaggaagaagggacagccaaagtgattgttgtggaaaagcacgccagagtttcttacaaatatgctagaaaggatatcaaaagggccctttgaaagtcaggaaaacaagagaaaaaacctcagctcctctttaggaggaaaaactacccacggggatcaaattgaggccaacaacaaaaggacgatggccggaaacttccaagtgtctcactggagtctggccatctgcaggaatcagaaccctggtggaactggagggatagaggatggccgacgggcacacttgacgggtggaagatgacgggcccgaaccataagagggaaggtgcttcgcacagacaagccggaaaggttaaatcacaaccacggggcccctgaggagcggccagggggggcgatatacggaggaccggagggacaaaggcgaacaaacggggtccgtgccccaaaagggaataacacccggaggagggtgcaagactgaagggggcgacacgcccctagggggacaacaaccggt

SEQ ID NO: 657573 - DNA, 103 bp, Homo sapiens
ctgtcatttaccgagctacagtagctcgagtggatgctgggaaggggccttttgacactactgcactggattcatgtgagacaaaggtagcaggacactcatg

SEQ ID NO: 657574 - DNA, 211 bp, Homo sapiens
aaacgatatatggaggtcagcacggtgctcacgtgtcgacggaacttgtaccagggaggccatgcaccgaagtggtagaatacacgtacgaccaggctccagctattaacgatattatggaggtacagcacggtgctcacgtagtcgacggaactatgtaccagggaggcatgcaccgcagtagtgcatacacgtacgaactggaggcatg

SEQ ID NO: 657575 - DNA, 646 bp, Homo sapiens
tcaggcaaagcaggtggatcacttgtccaggagcttgaaaccccgtctctactaaaaatacgaaaaaaactagctgggcatggtggcacgcacctgtaataccagctactcaggaggttgaggcacaagaatcacttgaacttggaaggcagaggttgcagtgagctcaaactgtaccactgcactccagcctgggtgatgaagttaagactctgtctcaaaataaaaagaaagaaaaaagaaagaaaaaaaaaagaaaacctatttattaaaataatagctgaaaatggaagtcttccttgaggatttatagtcaaattgtcaaaagtcaaggacatagagaattctaaaaaaaacagcaagaggaaagtatcaagtcacatataagggagcatctattagactagcagcagatttctcagcagaaattccacaggcatggagagaatgggataatatgttcaaagtactgaaggaaaaaacaaatgggcagccaagaatctataagactttatttgtccctcatttctgaaggatagtttacaaattagcaaccaagagtgtgcgacactcttggttggtttgcatttgaaagcacactctcaggtgagttgtctctatccctaaaaccctgggagagggggcc

SEQ ID NO: 657576 - DNA, 1065 bp, Homo sapiens
catggtggtgggcacttgtaatcccacctactggggaggctgaggcaggagaatcgcttgaacccaggaggcggaggctggagtaagcagagattgcaacactgcactccagcatgggtgacaagagcgaaactccgtctcaaaaaaaaaaaggaattaaagggcatttggggttggagttgtgtgtatcctccttagtaacccatcacatcaacgggctaaagaagaaaagtcacgatcaatagatgcagaaaaagcaatttgacaaaattccaacacacatttcatgattaaaaaaaaaaaaaacctctttaacctaagaatggggggaaaattttccttcagctgtgtgtttaaacaacttcttccaaaacttccatacggctaccattcattactcaaatggggtgaaaaccttcaaggcttcccctttgtaaacactcgggaattattacagggatgttccctcttataacccaatctccttgttccaacattctggggaaagtcttaaggatcaagtgctgcaccacgtggaacgttccatagcctaacgggcagttgacaccccgagacaacgggcacattaaacggggtaataccagcgttgcagcacgacattaaacgagcggtgtgcccaactttgtgcaactggtggataaattcccgagtgctatgaagagttccgcaaattttgtgagaccaaattatctcccagagaaaatgagggccacagttcacgaggcaaggtttttaccaagggagcagacgaggaattctgacctttattcacgaagaaatttctccgaagcaccaacttttttccccccaaggaaatacactgtggaccgatgtgaacacacagagtgtggaaactctttggtggagaagatctcgagacagatgacaccatgatcaccaccatttaacgacgtgcggcagacacccccaaaaaacaacgggaaaaattaccaatgtagggggggcgtgtataaggtccaacaaacacaacaattgtttcgttccacagggggggcaacacgtgtgaagggaagaaacatacat

SEQ ID NO: 657577 - DNA, 731 bp, Homo sapiens
  misc_feature (15)..(15): n is a, c, g, or t
catcgaattcctttngctcggaaagcgcgccatggtgtgggaacccggaaattcggccattatggccgggggggaaaaaaaaaaaaaaaaaaaatttaaaaaccaggtgggccgcttgggccaagccgattttagattggggcaggttaaggcaggcggccgaatttggggctaattgggccaattggccttatggggggccgaataacatttaatggcccgcggtttaacaaggtggggacgggaaaaccctgggggttcccaaattaaatggcttggaagaaaatccccttttggccagttggggaaataccgaaagggcccgaacggatggcctttccaaacagtggcgaagcctgaagggcaaagggaaatggaaggggttaaaatttggtaaaaatccgggttaaattttggtaaaatcagttaatttttaacccaatgggccgaaatgggaaaaatccttaataaatcaaaggattggcccgggataggtttgagggttgttccagttgggaccaggagcccatttttaaggaccgtggattcaacggtaaagggccgacggtttataaggccgaggccccattacgtgaccctataccttaaataggtttttggggcccgggggcccaaaggccttaatgggacccctaagggaggcccccgatttaaaggcttgcggggaaaggccgctaaaggtggcaaagaagggcgggagggccgggccg

SEQ ID NO: 657578 - DNA, 735 bp, Homo sapiens
  misc_feature (420)..(420): n is a, c, g, or t
  misc_feature (514)..(514): n is a, c, g, or t
  misc_feature (605)..(605): n is a, c, g, or t
  misc_feature (649)..(649): n is a, c, g, or t
  misc_feature (655)..(655): n is a, c, g, or t
  misc_feature (666)..(667): n is a, c, g, or t
  misc_feature (677)..(677): n is a, c, g, or t
  misc_feature (692)..(692): n is a, c, g, or t
  misc_feature (700)..(700): n is a, c, g, or t
  misc_feature (702)..(702): n is a, c, g, or t
  misc_feature (704)..(704): n is a, c, g, or t
  misc_feature (720)..(720): n is a, c, g, or t
gcaataaagttttttggtgcacgggaatgaagacatttggtctccaacaaaccccggggagtcagtacagttaaggcgtccccaaataagctcagaagcaagggcactgatttttagggctttccctaaagaaagactgtttttttttgtacagtttcaatgcccatggaatagcaaaatgggctgataacctttttttaggctaagaggagccttgcttttcaggggtatatttaccttttaaagaaatctggctttataaagatgtttttgtaaacttaaaaataaggtaaaggaacaagggttttttttttttgagaagggtcccgcaaccctgttgtagtttgccccgacttttatgcaaaattccctttaaaaaaaaaaaaaaaaggggttaaaagttttttaaagcttttgggnaaaaggattccccaaattttccctttttagggccctgaggggcccccccattttgagggcccccttgggggactcctaaaaaacagttggcaanttagcccattgccccccccgggttgataattaaaaaaaaatgggaaaacacccccctgtaaggtttttaaaaattttttttttaagggtcnggccgggggttccccaaggaattttttaagttttgcccaaaaangggggnttcctttcagnnggggggtaanggaaaccccttaatnataagttnananccttaaaaaggggggnggcttttccttttta

SEQ ID NO: 657579 - DNA, 1092 bp, Homo sapiens
  misc_feature (207)..(207): n is a, c, g, or t
  misc_feature (266)..(266): n is a, c, g, or t
  misc_feature (288)..(288): n is a, c, g, or t
  misc_feature (293)..(293): n is a, c, g, or t
  misc_feature (297)..(297): n is a, c, g, or t
  misc_feature (308)..(308): n is a, c, g, or t
  misc_feature (362)..(362): n is a, c, g, or t
ggctcttcctccggggccgctggcactgcggccgctccgcaggagagaagccgggagcgggcgaggcggcggcggcagcagcgatggcaggaatagagttggagcggtgccagcagcaggcgaacgaggtgacggaaattatgcgtaacaacttcggcaaggtcctggagcgtggtgtgaagctggccgaactgcagcagcgttcanaccaactcctggatatgagctcaaccttcaacaagactacacagaacctggcccagaanaagtgctgggagaacatccgtntaccnggantctgcgtgggngctggtggtggttggtgtcctgctcatcatcctgattgtgctgctggtcgtctntctcctaccgtcagcagcagctgaccacgcagctacgctgccccaccggacccagcgcactgcacggcacttgccctcagcggccctgggcacctcgacccccagcctggctcctgaccgcgcgaccggccaacactggcctgcacctggccgacttctggctctccagcaggacctcgacgctgttccgctctcccttgacccacccccacgtgactgcccctcgggccagcccccaccatgtggccaccccctgcattttccctgctcctgccacagactggccccttgaccgggcagcatgctgctcactgcccactgcctggcgcccagccccacctggcagctccgccacacctgctgctccgcattaacacacaccccacacacaaaccccacaccacaaccaccatactccgcgccccacccgccctcaacaaaacccctcaacacaccaccatggagggcgacagcgacgcgcccgcacaaacgatgtccaatccccatcccagggtgcactcagacgagacaccccaagacaggagacacacgaccgccaccacacgatggacgcgagcaatctctcccaccacgatcaacataacgccccgcggagcaacacgcagcgtccttcgcacacaccacacaccacgagctcctagcgagagacccagaggcgaccacatcgcacaccgccgcactcgtgatagtgagccaacgccgtcagcaa

SEQ ID NO: 657580 - DNA, 474 bp, Homo sapiens
  misc_feature (207)..(207): n is a, c, g, or t
  misc_feature (266)..(266): n is a, c, g, or t
  misc_feature (288)..(288): n is a, c, g, or t
  misc_feature (293)..(293): n is a, c, g, or t
  misc_feature (297)..(297): n is a, c, g, or t
  misc_feature (308)..(308): n is a, c, g, or t
  misc_feature (362)..(362): n is a, c, g, or t
  misc_feature (464)..(464): n is a, c, g, or t
  misc_feature (468)..(468): n is a, c, g, or t
ggctcttcctccggggccgctggcactgcggccgctccgcaggagagaagccgggagcgggcgaggcggcggcggcagcagcgatggcaggaatagagttggagcggtgccagcagcaggcgaacgaggtgacggaaattatgcgtaacaacttcggcaaggtcctggagcgtggtgtgaagctggccgaactgcagcagcgttcanaccaactcctggatatgagctcaaccttcaacaagactacacagaacctggcccagaanaagtgctgggagaacatccgtntaccnggantctgcgtgggngctggtggtggttggtgtcctgctcatcatcctgattgtgctgctggtcgtctntctccctcagagccatgacagcagtaatgccccaaggaccccaggatgcaggcaattgcctcagggcttgggaattgaacccaactgttctggaaggagaancctngctggc

SEQ ID NO: 657581 - DNA, 127 bp, Homo sapiens
agtcggtaccagatcccctttcatccccactgggtgtacagtgcattatggcaaggaaagtgtcataatttgatactgtatctgttttccttcaaagtatagagctttgggggatggaaagggggat

SEQ ID NO: 657582 - DNA, 850 bp, Homo sapiens
ggcttgtcctggctctggaattttgggatcgcagcgggagcgggatgccgtgatctgctgatgcgcgggcagagctggggctgctgctggtgccgggcgagcgtgaccagtgcgtggagccatggaccgctagggcccggcctatccccgcgatgccgccggctgagtggccccagcgtcctcgcgcggctgttgccgctgctgtggtgctgctgctctggaggcgcctccctggtgctccctggctaagtcgccggcctgtgagccccccgagcccgcagggagcatccgtgatccaatggtgcgatggttgtattgttgaggcgggggagcttggtgccccgtgtgcccgtgggcctcagtggcatcgttgttttgggaaccggactcttgctggcaggcttggcaccacatgactcaggagggtgtggccacgcctgcccctcagttatcgcttgggcaccttgggttgctggtcacgtgctgcccgccctggcttcctcaccaagctctgtgccctggcgtgtttgacgaatgcttgcccttgtatgcggtctgtcaggccctctacctgctccctgagcggcggcacgctcatcctctatgaggacctggtgcacgattctcctaggcgtctccctggtgcccgtcccgagccttggtgcagttccagcgccggggcttgcccgcctggctgtcagctccaacctacatgccagctcttgggctgtcacttacgccttgccagaaccccagcaggaacttgcagggactttccctgccttcctgggcacatgaggccatccaagctcagggaaatgggatccttgactggagcctgattgcccat

SEQ ID NO: 657583 - DNA, 818 bp, Homo sapiens
  misc_feature (5)..(5): n is a, c, g, or t
  misc_feature (268)..(268): n is a, c, g, or t
  misc_feature (303)..(303): n is a, c, g, or t
  misc_feature (335)..(335): n is a, c, g, or t
  misc_feature (347)..(347): n is a, c, g, or t
  misc_feature (355)..(355): n is a, c, g, or t
  misc_feature (411)..(411): n is a, c, g, or t
  misc_feature (418)..(418): n is a, c, g, or t
  misc_feature (425)..(425): n is a, c, g, or t
  misc_feature (452)..(452): n is a, c, g, or t
  misc_feature (649)..(649): n is a, c, g, or t
  misc_feature (776)..(776): n is a, c, g, or t
atggnggtttcttcaattggtgtgtagtcctcaataattatatatgaaattgctgtcaaaccagtaagactgcatttatacatccatcattttcaggattgttggtaacctgggcatattttccccaaataactttgcctccttgtgtcacaaggcccaattcgctcacatttacttcaatgacagtacctttggtaataacacccaaagttgtatacagtggggatgagggattcttctttacaccaagtattggtaggcataaggnggctttcagttcaggatgtgttacatgggctttcntgaaacgcaagcccattggcctgatgaatctntcatatttaggnggttttcntgtaaagccatctccaacaaagcacactttagtaaccattctcttccatgccttcntctttcnctttccngttcgaataacttttaatacttcggtntcgcccggggcacgtactttaggcagagggacttcccattttcccgccggcgcggtgcggggcggtgtaatcatattggaaaggactttagcgcgagagtgtcccgcgcggtccagcagagaggcagggacgggcccggggggggcggtgcagcattcggttggttggtggggcgcttttcatgcatcttgatagtntttttcatttgtattttctcagcatgacgctgtttatggtaaagcttagccttcagaccaatcattttctttgccttctttgaacgttcatgagcctctcgactttccttctttctctttttctcanggtaatccaaacggtatccatagcgtttacggtgtaattcaa

SEQ ID NO: 657584 - DNA, 251 bp, Homo sapiens
agtaaagactaattaacatgtcacactccagaatcagtcatttctagttgtgaattccatctctgtcccttagttcctgtgtgagtttattaactgtggtaggacaactaagcctgtctcagctgcaaaatgtaaatgttagtacctacctaagagaggtttaatgaaggttaaatgagataagtatgccaagtccttaagtgtagtcccatgcgcatatgaaatgctctattgttagctgtaattatctt

SEQ ID NO: 657585 - DNA, 358 bp, Homo sapiens
  misc_feature (2)..(2): n is a, c, g, or t
  misc_feature (36)..(36): n is a, c, g, or t
  misc_feature (97)..(97): n is a, c, g, or t
  misc_feature (272)..(272): n is a, c, g, or t
  misc_feature (334)..(334): n is a, c, g, or t
  misc_feature (358)..(358): n is a, c, g, or t
gntcgacctcagaaacaggatcccacccactctganggaatggaagagtgctgacaatattttcttgagcacaaagaagggtgaagaaaatattgantagcactcttccattccctcagaaaccaggattcccaccccactctgacatagctgttccacacaagaaaactaacatgtaaaccctaaacaaagagagtttgatgccaagggttactttttctctttattctgtaatatatttatacacttttgctcaatatcaaaagttttgnagtcattataaataaatccagaaatatgtgctttatagcctccatatgagcaaataccaggncagaactgaccaaatgcacaaacn

SEQ ID NO: 657586 - DNA, 605 bp, Homo sapiens
  misc_feature (19)..(19): n is a, c, g, or t
  misc_feature (123)..(123): n is a, c, g, or t
  misc_feature (168)..(168): n is a, c, g, or t
  misc_feature (207)..(207): n is a, c, g, or t
  misc_feature (218)..(220): n is a, c, g, or t
  misc_feature (274)..(274): n is a, c, g, or t
  misc_feature (283)..(283): n is a, c, g, or t
  misc_feature (327)..(327): n is a, c, g, or t
  misc_feature (344)..(344): n is a, c, g, or t
  misc_feature (387)..(387): n is a, c, g, or t
  misc_feature (391)..(391): n is a, c, g, or t
  misc_feature (393)..(393): n is a, c, g, or t
  misc_feature (400)..(400): n is a, c, g, or t
  misc_feature (465)..(465): n is a, c, g, or t
  misc_feature (483)..(483): n is a, c, g, or t
  misc_feature (551)..(551): n is a, c, g, or t
  misc_feature (571)..(571): n is a, c, g, or t
  misc_feature (577)..(577): n is a, c, g, or t
tagcacgtcattctaacantttaatcatggaattcttcaaatttgctctgttaacaaattgaagactttcaatcaaatatgtaacattgctgaaatgaagaaatatttccagtataaattggnctgaactgataaatcaatgctttctcctcttcagattcagatttnaaatgatggttgtttttccgggcttcattaacaaaaaantctgctaaatnnnatgcggttttcacagcattaggtgcatgggaaatgcgcatccaaattcttccantcataaggngctttctctggatgccactgggcaccatggactggatacttatntccttccgattgttganataaagctcaatcttgccatctgtatttgtagttaagacattnaaananttctttnacttttcattcattgtaaaattcttcacggagaggctccacttatgggaattggcagtgagaggntctactgctagtgacagngacaactcaggggaaagttctgggcattctgctgtgcaattgacctccagtgaagttcagcggcattnccacgtcaacagtatctgtngcagtnaataagcactctccactaatcagcagtg

SEQ ID NO: 657587 - DNA, 401 bp, Homo sapiens
agggcctggagtaggcggtgcgtacggttttcccaggcccggccaagggctgggcagggattccaggtgggcccaacaagcttctggggttccggccacctggggaaaccgcgcctgccaaggaggcccccaaagggcagtgcagggttttgcctgggccccaggccctgcctgtgtttaaaactttggggactgggccaaggaagctcctcctcagcttttaactgtgggtgccacccatgggggtttccttccgcctttcaagatccccccagcctgaaggggcgcttaccatcccctttgccctgcagagccaaccgccaaggttgacctcaggtttggagccccctttggatgaactgcccccagcccccgccccattaaagacccggaagcctgga

SEQ ID NO: 657588 - DNA, 1768 bp, Homo sapiens
ggcagcgtggtctgtgacagccacacagtgtccagatacgagggtacgagatggctgctttacagaactctggtgacagataactgtccttatacttactcagctacactggacgacatatatgcggatcctgctctcttattgcaactcacaactcgcaagacaactgaaaacgtgacacttgcatgacggtggcctctcacaagggaaatacgaaattcatggctccacactgctcatggtgcactgcacggcacaactggcactccacgcgcccactccgcaaccgcctactccaaacagcgacagcaagccacccaacgcgcacgggccccccccgcagccaccacccaacacacagataacactgcgcacaggcgcagccaaccttatccaggcaactcctggagatctcccaaactccctcaacaccaagaaccaccctacaccctaaccaccagcgaaccccaacacacctgaaatcgcactgcaccgaatgaacactggcgaaacccccccttgaccacacaccccgccccagcgagcgcactgcatgcaccctccaatgaccctaacacatcggcccccaaccccctgaccatgctccgcaacgccactgcacccactatcgctcccccccaccagctggctccccataccccacccaatatcccactcctacagcacgcacacccacccacctacacaagcgaaaacccccccaggcaacatacggcgcacgcagcacaaccacaggaggaggcactcggccacacccacagccagccacagggcactcacaacccggccgcccacggacccattccatcacgacgcacaacgcggaaaccccacgccgacgccccacccacaacctccacaggcacctccacaacccaccgcacacccaacacgcccccacctcacccacgccgccccaaaacaggcccccacacaaccacacataacacctaacgacacaacgtcccacccacccggacccaacacggacacccaccacacgccccagcacaaagcaacccagacccacaccccgacaacgcacaacatacccaccaggacactagcccaagcctggcgcaaccctaagccatcagcacggcacaagacacaccttctcgacccacagccgcacggcaacactcgccttgcaacacgccctatgcaccagcaccacaacacgacacacaccctgccacaccccaacgagagcgaccatccacccaccgtaagccaaccaagcacagccaccacgagaacacgaacgaagggccacaccaccacagacctgcgacacccccaacaagcccggccctcatcccaccaccgacgccacgaccggcagcgccccacccaaccgacgaaccctggcacccgaaagcaccgcgcacacatcgaaacccccgccacaccacgccgcctgccgcgacacgacacaacgagcaacgaccaccccgacaccaactacacgggcaaacccacccacacacccgaaccaccacgacaccagaaacgcccactcacgacccaccgccaccgcacctgcgggcacccacgcccacccgctagcgcgcccccgaccacccgacccccctacggaagcaagcgcagacacaagaacaggacaacacactcgcaccgcccccaaacaaacgacacacaacaccagaccacacccaccagacgcgcccccaccacacagacgacgacccactcgcccaccgccacaaccccacacgcaaaaccg

SEQ ID NO: 657589 - DNA, 365 bp, Homo sapiens
  misc_feature (30)..(30): n is a, c, g, or t
cagggaaccaagcagcctttggtccagtgntgctccttggaacagttgagtgtggcccccaaccattttcctgggtagctcagtcataaaaccccgaatgcctccctcaaaatagcctttgagggaagggagctgttgacaagtgaagcccccaggttgtgtgggattccaccaggttattacagcttgtggggggagggagggtccattcccccagctttgaatcccagggtcccctcagcttcattgggccccagtgtttgtccccggaaaaagcaaatggccagtgaggatgatggaaagacccccgcccccctgtctaaaacctgggatcttaaaagggttattttggcttttatttttta

SEQ ID NO: 657590 - DNA, 257 bp, Homo sapiens
cccccccccttctcgggtgtctagaggatctcccgccgtacagttgcggccggctgtgatagagctggacttgaaccaggttctctagtggcacagctaccactgtgattcagtgccttagaccatcacaccactcgggggtcccgaacgaaaaggcatttttaaacaaatgaccctgctatacaatgcattcgaaacgtgtgcttcccaaagagataaatatgcccgctcacgcaactggtacggcggggggtacc

SEQ ID NO: 657591 - DNA, 516 bp, Homo sapiens
gagtgtaatatgcaattggtgtgatcacgggtcaccgcaggttccagcctcccggttcacgccattctcctgcctcagcctcccaagtaggctgggattacaggcgtctgccaccacgcccaggtaatattatgtatttttagtagtgacagggttacaccatgtaggccaggctggtctcgaactcctgacctagtgatccacctgcctcggtctcccaaagggctgagcttccaggcgtgagccaccacacctgtcctatttattaataaatgaagagacaaagtctcactctgtagcccaggctgaagtgcagtgacacaatctcagctcactgcaacctccacctcctgggtacaagcgataatcttgcctcagtctcctgagtagctgggataacaggtgtatgccagcacacccggctaattaaagtataagaagtagagatggggtagcaccatgtaggccaggttggacttgaactcctgagcttgtgatctgcctgcctcagcctcc

SEQ ID NO: 657592 - DNA, 105 bp, Homo sapiens
tacttacttacatacatttaaattttgagcatcatctcggtccattaactcacgctgcactcagtcagagttacaattcatttcgcggtaggattatgaaggacg

SEQ ID NO: 657593 - DNA, 503 bp, Homo sapiens
  misc_feature (6)..(6): n is a, c, g, or t
  misc_feature (8)..(8): n is a, c, g, or t
  misc_feature (15)..(16): n is a, c, g, or t
  misc_feature (484)..(484): n is a, c, g, or t
cgcggntngccagtnncggccgaatcgaactcgctgctgaacggctccgagccgatgatggtcggaaagcacaggatctcggcgcccatcagcgcgaggctgcgcgccgtctccgggtaccactggtcccagcagatgccgatgccgatccgcccgaaacgcgtatcccacaccctgaagccggtgtcgcccggcgtgaaatagaacttctccgtatagcccggaccgtccggaatatgtgtcttgcggtagacgccgagcacgcgtccgtccgcgtccgccacggcgatcgagttgtacgcggcattgcccgcgcgctcgaagaagccgatcggcagcacgatgccgagcctcgccggccagcgccgcgaaccgggcgatctgcgcgttgccttcgaacggctgcgcgagttcgagatggcgcacgttctggtcgaggcagaagtacggcatcgcgaacagctccgggcacagcacgagattngcccctgcgcagcggccgc

SEQ ID NO: 657594 - DNA, 82 bp, Homo sapiens
gcacgagatagaattgattcaaaacatacccctacagaaaatcagcaaacaaaaaaggaagacagcaagagagagaggaaga

SEQ ID NO: 657595 - DNA, 877 bp, Homo sapiens
  misc_feature (743)..(743): n is a, c, g, or t
  misc_feature (750)..(750): n is a, c, g, or t
  misc_feature (815)..(815): n is a, c, g, or t
ggcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaaggtgatggatttaaggcaaatcttgttttcaaggagattgagaagaaacttgaagaggaaggggaacagtttgtgaagaaaatcggtggtattttgccttcaaggtgaaagatggccctgggggtaaagaggccacctgggtggtggatgtgaagaatggcaaaggatcagtgcttcctaactcagataagaaggctgactgcacaatcacaatggtgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctactttgtgaaacatcaagatgagatatatagatatatatccatacattttattggtcagaattttagactgaaactacacatgggcaaatagcgtgggatagatttgttcctaatgggtgtgaccaatcctggtttcctatgcctcggggtgaatagagcctgatggtatacaatggnttggcgnattggtacaactggggcttacaaggtaaatgggaaaatggcgggggaaagggttccgaaaaaatnggacaggtaatccaagcatttttaaaaaacttgtttgggaaagagtttagggatttgggaaa

SEQ ID NO: 657596 - DNA, 953 bp, Homo sapiens
ggcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaaggtgatggatttaaggcaaatcttgttttcaaggagattgagaagaaacttgaagagagaaggctgactgcacaatcacaatggtgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctactttgtgaaacatcaagatgagatatatagatatatatccatacattttattggtcagaattttagactgaaactacacatgggcaaatagcgtgggatagatttgttcctaatgggtgtgaccaatcctggtttcctatgcctcggggtgaatagagcctgatggtatactaactgcttgtgggggaatgtgcatacaatgtgtgcattacaaagttaatatgggtacattatggtccggggtaacacatcggagtttcagaataaaattaggaacagtaaaatccaaagaattatgtaaacaaaaaagcttggttgagcttacaaagtcatattcaaggattattctgctgaagattcagtcttaagagttttcctgtgggagaactaagtacagaaacacaatgccaacagctggccagtaattaggtgttgtgcacttcatggtcattaatccactttctcaatagttcttaaaatcagtgaagattaaaaactctaaaaatttctgcatttcct

SEQ ID NO: 657597 - DNA, 151 bp, Homo sapiens
agaggattatcctacccccgtcctcattcgagaccccagtcgatgatgtggaggaagagcccacctgcaagatggacacgagccacaagctgaactgtgaaccaaggcacatccgcgcagataccacaggcctagtgagtctcagaaggga

SEQ ID NO: 657598 - DNA, 1085 bp, Homo sapiens
ggcagaactctgctggcagctgagaggggaagccggaaagaggcaagttcctggtgcaaaggtggctctgcagcataatttaggcattggaggagctgtggttgtaacactctacaagatgggttttccggaagccgccagttcttttagaactcatcaaattgaagctgttccaaccagctctgcaaggtgatggatttaaggcaaatcttgttttcaaggagattgagaagaaacttgaagaggaaggggaacagtttgtgaagaaaatcggtggtattttgccttcaaggtgaaagatggccctgggggtaaagaggccacctgggtggtggatgtgaagaatggcaaaggatcagtgcttcctaactcagataagaaggctgactgcacaatcacaatggtgactcagacttcctggctttaatgactggtaaaatgaatcctcagtcggccttctttcaaggcaaattgaaaatcactggcaacatgggtctcgctatgaagttacaaaatcttcagcttcagccaggcaacgctaagctctgaagaactccctttggctactttgtgaaacatcaagatgagatatatagatatatatccatacattttattggtcagaattttagactgaaactacacatgggcaaatagcgtgggatagatttgttcctaatgggtgtgaccaatcctggtttcctatgcctcggggtgaatagagcctgatggtatactaactgcttgtgggggaatgtgcatacaatgtgtgcattacaaagttaatatgggtacattatggtccggggtaacacatcggagtttcagaataaaattaggaacagtaaaatccaaagaattatgtaaacaaaaaagcttggttgagcttacaaagtcatattcaaggattattctgctgaagattcagtcttaagagttttcctgtgggagaactaagtacagaaacacaatgccaacagctggccagtaattaggtgttgtgcacttcatggtcattaatccactttctcaatagttcttaaaatcagtgaagattaaaaactctaaaaatttctgcatttcct

SEQ ID NO: 657599 - DNA, 421 bp, Homo sapiens
ggcacgagcatcttacgaggtcaggttttggggtatttttggttggttttttttggaggcgtaatctcactcggtcacctaggcgggagtgcaggggcatgatctcggcttacggcaacctccaccttccaggttcaaatgattctcacacctcatcttcctgagtagcggggattacaggcacctgccaccacgcctagccaattttggtatttttagtagagatggggtttcaccatgctgggccaggcgggtctcgaactcccgacttcaagtgatcctcccacctgggcctcccaaagggcggggattacaggcactcgccaccacgcccagctaatttttctatcttaagtagagatggggtttcgccatgtgggccaggcgggtctcgaactccggacctcaggtgatccaccgg

SEQ ID NO: 657600 - DNA, 318 bp, Homo sapiens
ccactccatcctgggcaataagagctcctgagcatcagttatctcccacctcagcctcctaagtagcttggactacaggtacgcgtcacagcccccagctagttgcagtactttttttttttttttaaaaaaacggggtctcactctgttgcctggactgaaaagccgtggtgcagtcccggttcactgcagtcttgacctcttggcctcaagtgatcttcccaccccagcttcctgagtagctgggactacaggtttgcgccaccatgcctggctaattttttcatagagactgggttttgccatattgccccggtt

SEQ ID NO: 657601 - DNA, 185 bp, Homo sapiens
agatccctggagtgcatggcttgacacagctcaggctcaaactgatccttccacctcagcctcccaagtagctgggaacacaggcacgtgccaccacgcctggctgatttttttttttttttttttttttggaggagacgggtttccccctttttccccaaggggggtccaaaaccctggggccg

SEQ ID NO: 657602 - DNA, 292 bp, Homo sapiens
  misc_feature (231)..(231): n is a, c, g, or t
gccctaccagaaagggaggtttgttatcattgcttcctatgaggctctactactctaccctcatttcatttcaacaaagggcagcgacctgttccaatggctggcttggaggcaggaggagcggggtctctaattagtgctgattgttgggactgattgagcctgtatagcatgtctcctactcacgaagcctcatggtgctgggctctggctggctcactgccttgtaanttcgtagcacgtttgggtaggccgagctcaggcagcacttggtagcaggtcctgccctttt

SEQ ID NO: 657603 - DNA, 413 bp, Homo sapiens
gctcgacctgtgatccaccttctcttctccacgcgactgctacttccagtcaagcacaggtattaagacaactgctcaccttgctgttctctgcttccttcaagccgcaagtttatgttttaaaaacatgaatcctagtcgggtgcgatactcacgcctgtaatcccagcactttgggaggctgaggcaggcggatcacgagatcaggagattgaaaccaccctggccaacatggtgaaacccgtctctcctaaaacacaaaaaatgagctgggcgtggtgatgcgcgcctgtaaacccagctactcagaaggctgaggcagggtaatcgtttgaaccggggaggtggaggttgcagtgagccaagatcgcgccactgcactccagcctggcgacagagcgagactccatctc

SEQ ID NO: 657604 - DNA, 108 bp, Homo sapiens
cgatacgctcatagaccgggtgtgctctttacgctgttgttacgtgctcgtcgggtttcgggggtcttcgcttgggtctccttgcggtctaggagcgtactcggggct

SEQ ID NO: 657605 - DNA, 429 bp, Homo sapiens
aaagtgagctcacagtaagcacagagtttgcatacgcaagatcatctacacgtatcatagtccaccgacgttgttctaaatgagcgttagggtaaacgacatatcctcgagcagttggataccgtagactgctgcttgaccaacgtatgatctagcatgacggttcacatataggctgcaattgtacggctctcaaagtatgatgacatggcttctgagattggccatgaccgccaggagtcattctggattcattagacagcataggcctagtcgtgacccactagagctgatgcggcagtaacataagatcttcattctcagcacacatcacgcgcagtcaccctgaataaactgtacgcataactatggccgataatgagacgtatctgtaaatagagttagcatctccgctaagctattattcat

SEQ ID NO: 657606 - DNA, 221 bp, Homo sapiens
acatgagaaatcaactgatgagtggcttggatatgtacatctctggtttaagtggacatcataatatgtatctacaggagtccattaaactaggaaattcaatctgaacagcacttgcaagcactttttcttctcctgttaagcagttatagcagcttgtttccattcaacaagacttcttcctcactagttttcaacaagtcgaaggtgtctgttctcgc

SEQ ID NO: 657607 - DNA, 360 bp, Homo sapiens
  misc_feature (8)..(8): n is a, c, g, or t
gaatctcngggacaaagcaaaagtaatgttaagagggaaacttatggtgcctaaacagcccacatcaaaagttagaaagatttaaaattaataacataacatcagacctaggggaactgcagaaacaacagcaaagtatctcaacttcaaagctagcagaagacaaaaaataaccaaaatcagaactgaaggaactggggacacacaaaccataaaaaaaaatcaacaaaattaggaatttgttttttgagagaataaataagatggacaaacaagtagctacactaataaaaaagaaagactatccaaataaacacaatcagaaatggtaaatgggacattaccactgagctaacagga

SEQ ID NO: 657608 - DNA, 614 bp, Homo sapiens
taggacttataaaagaggtcgaagggagcactcgttctgcccttccacctcttctgccataggaggacacctagatggtacgatctatgagggaggggccttcgcgggacactgaatctgctggacctggatctgggaatgcccagcctccaaaactatgagaaatttcggtggtttataaattaccaagttacggtagttggttatagcagcagacatagactaagacaggagggaaaggagggtgtggctttgggcttaagaagacatgtggagtttaaaaggagggtggaacatcccagaggaagtgtctagttggtagttagagaataaagcaagcaagcaaagaaataaacaagtctgggaacggagtgtaggacatggctggtcagaacgggcggtgagatattcattgggagtaattagtcgggtaataataagggaatacatcagacggagttccatgagaaagaaaaatcaaactataaaaaagagcccagaattacggatcatgacttagaaattactcacacttttctcccaaggatggggtcctggatctggacggggggctcaccaagttcatcctcaactcctaaatctttcaaaggtgc

SEQ ID NO: 657609 - DNA, 1158 bp, Homo sapiens
  misc_feature (146)..(146): n is a, c, g, or t
  misc_feature (243)..(243): n is a, c, g, or t
  misc_feature (257)..(257): n is a, c, g, or t
  misc_feature (271)..(271): n is a, c, g, or t
  misc_feature (273)..(273): n is a, c, g, or t
  misc_feature (292)..(293): n is a, c, g, or t
  misc_feature (297)..(297): n is a, c, g, or t
  misc_feature (332)..(332): n is a, c, g, or t
  misc_feature (335)..(335): n is a, c, g, or t
  misc_feature (339)..(339): n is a, c, g, or t
  misc_feature (344)..(344): n is a, c, g, or t
  misc_feature (356)..(356): n is a, c, g, or t
  misc_feature (358)..(359): n is a, c, g, or t
  misc_feature (363)..(363): n is a, c, g, or t
ggatttgttttttttggcaaagttaccggggccaccagatggtgcaaagttcttacatccagccaaaaaaaggcttaagtaaacttcaacagccatttggatttccatgaaacagacctatcagtgagatgcagagcttgaaggancagttttccatagacttaagcacgtggtgaagcaaagtttacacttgcaggattagaagaggttgaccgaaagaaggaaggacatggacagctatgntgttgggagccgtnttatagtctaaccntnagtcaagtggtttgttggnnaganagagcttttgcctttattaagggaaggcccggacncanacancctcnaggcatttgttntnncctntcagtatcctttctcttaattatctcacctcatccatgaagctggtatgtacagatttttcctttctttctcaatcctttaaaaaattaaagctctaaatctcatttccacttagattttaatgttgcattgtaacttaagataaaaccttgctctgatgttaaaaatactaaagtaagaagcaatatggcatagtgcttatgagcaggactacatagttctttctgaatacaaatctcagataaaacactatctcagtgatcaaccaggttaagcaacctttttagtgcctcaattattccatttgtaaaattgtaataatgatagtactaacctataagattgtggtgaggattaagtcagataatacaaaagaagcatttagagtatttcctggcattatctaccatttattgaatttttatggttaagaagaataaggaaaagcagaagaaaaggaaaagagaaaaaatacataagaagaaggaagagtggtaagctctagtaaattacaacaaacggtaacgtagaaaacatttgttagcccttaatataggccaggcactgtgttcaatgcttaaacctcattactgttctttgaagtggataacattattccttccattttaaagaaaggaatactaaagacaactttgtcaatattattcatgtaataaatgacagaatttgaccaagacaatagagaatgaactcttaatcactatattgttttattttttgaaaatagattttaagttcttattaaatgttaatgactcacatcaaaataaagcc

SEQ ID NO: 657610 - DNA, 226 bp, Homo sapiens
atggtcttgctctgtcgcgcgggctgagtgcagcggtgccatcttgtctcattgcaacctaaagatcctcttatctcagccccccaagtagcggggactacaggcacatgccaccacaccccactaatttgtgtgtattttcccatgttgcccaaactggtctggaactcctgagctcaagcaatccaccctccttggactcccgaagtgcgggattaaacgcatg

SEQ ID NO: 657611 - DNA, 299 bp, Homo sapiens
tatagcatacaggaacaggccgcagtgaatgacagcgtgacaggcacctggcagcgcaagaaggattcaggaatgccagactccttgaaatcatgtgggctttgttttttttttttttcccttttaaacttcttctcttttagaagggtgctggccggggttcccaaaaaaaaaagggttccaaaattcctttaattgcccgtgaataaggggcactgctacagcacttagttaccagagattcctccttatctcagggttgaggcaaacccaggattagacattagagattaaaggga

SEQ ID NO: 657612 - DNA, 1206 bp, Homo sapiens
  misc_feature (146)..(146): n is a, c, g, or t
  misc_feature (243)..(243): n is a, c, g, or t
  misc_feature (257)..(257): n is a, c, g, or t
  misc_feature (271)..(271): n is a, c, g, or t
  misc_feature (273)..(273): n is a, c, g, or t
  misc_feature (292)..(293): n is a, c, g, or t
  misc_feature (297)..(297): n is a, c, g, or t
  misc_feature (332)..(332): n is a, c, g, or t
  misc_feature (335)..(335): n is a, c, g, or t
  misc_feature (339)..(339): n is a, c, g, or t
  misc_feature (344)..(344): n is a, c, g, or t
  misc_feature (356)..(356): n is a, c, g, or t
  misc_feature (358)..(359): n is a, c, g, or t
  misc_feature (363)..(363): n is a, c, g, or t
  misc_feature (1172)..(1172): n is a, c, g, or t
ggatttgttttttttggcaaagttaccggggccaccagatggtgcaaagttcttacatccagccaaaaaaaggcttaagtaaacttcaacagccatttggatttccatgaaacagacctatcagtgagatgcagagcttgaaggancagttttccatagacttaagcacgtggtgaagcaaagtttacacttgcaggattagaagaggttgaccgaaagaaggaaggacatggacagctatgntgttgggagccgtnttatagtctaaccntnagtcaagtggtttgttggnnaganagagcttttgcctttattaagggaaggcccggacncanacancctcnaggcatttgttntnncctntcagtatcctttctcttaattatctcacctcatccatgaagctggtatgtacagatttttcctttctttctcaatcctttaaaaaattaaagctctaaatctcatttccacttagattttaatgttgcattgtaacttaagataaaaccttgctctgatgttaaaaatactaaagtaagaagcaatatggcatagtgcttatgagcaggactacatagttctttctgaatacaaatctcagataaaacactatctcagtgatcaaccaggttaagcaacctttttagtgcctcaattattccatttgtaaaattgtaataatgatagtactaacctataagattgtggtgaggattaagtcagataatacaaaagaagcatttagagtatttcctggcattatctaccatttattgaatttttatggttaagaagaataaggaaaagcagaagaaaaggaaaagagaaaaaatacataagaagaaggaagagtggtaagctctagtaaattacaacaaacggtaacgtagaaaacatttgttagcccttaatataggccaggcactgtgttcaatgcttaaacctcattactgttctttgaagtggataacattattccttccattttaaagaaaggaatactaaagacaactttgtcaatattattcatgtaataaatgacagaatttgaccaagacaatagagaatgaactcttaatcactatattgttttattttttgaaaatagattttaagttcttattaaatgttaatgactcacatcaaaataaagcccgcagcggccaggntttttcattattattatttttcccgcgttctaat

SEQ ID NO: 657613 - DNA, 412 bp, Homo sapiens
atttaaaaattaaataattgcaaatgagtggataaagaaactgatatatatatatctgattatatatatatatatctgattatgtatatatatctgattatatatatatgatggaatactacccggctataagaatgaatgaattaatggcatttgcagtaacctggatgggattggagactattattctaagtgaagtaactcaggaatggaaaaccaaacatcgttatgttctcgctcataagtaggagctaagctataaggatgcaaaggcataagaatgacacagtggcttttggggactcagagggaaagggtaggaaggagatgagggataaaagactacaaattgggttcatgtgtactgcttgggagatgggtgcaacaaaatctcagaaattaccactaaaga

SEQ ID NO: 657614 - DNA, 293 bp, Homo sapiens
  misc_feature (52)..(52): n is a, c, g, or t
cccaaagtgcttttggtataaacaagtcagccctccccatatcccgtgagtncccaaatcccatggatccctgaattcatggatttaacccagctgcagataaaaaatattcagaaaaaaaaagatggttgcatctgtactgaacatgtctgtactgttttgcttgtcattattttctaaacaatacagtataacaactatttacatggcatttacattgtattagggattataagtaatctagaggtgatttaaagtatatgggagtctcttatatcccaggaagcctgtct

SEQ ID NO: 657615 - DNA, 309 bp, Homo sapiens
aaagtatggatggggctgggtgtggtggctgacacctgtaatcccagcactttggagaccaaggcagctggatcacttgaggtcagaagttcgagaccagcctagccaacatggtgaaacccatctctactaaaaatacaaaaattagccaggtgtggtggcgcatcttgttaatcccagctacttgggaggctgaagcagaagaatcgattgaactttggggaggcggaggttgcagttgagtgggggatttgcaccacttgcatttccagccttgggtaaaaaaagagcgagattctttgtcttcaa

SEQ ID NO: 657616 - DNA, 324 bp, Homo sapiens
gcaattccagcagcgcatgcatcattcatttattgtttgattaatgacaagtccttggctttgtctcacaagctgatatgcagtggtgcgaccacggctcacggcagcctcagccaaccagatgtaagcgatctggttcccacctcagcctcccgagtagtaagtatctgggaccacaggcggtgcccagggtttttttttttttttttttctccgttggtagagacggggtctcactgtggccaggactgctctgaaactcctgttttcaagtgatccctttgcctcctccccatttaggcctcccgctgttggaactgctga

SEQ ID NO: 657617 - DNA, 129 bp, Homo sapiens
cggtcacactcataagggctacagtcatcttaaaataggtcagctatctctagcaattataactcttaccatggataactttttctaagcaccttaaatcacatgaatattctgccttacataaatttg

SEQ ID NO: 657618 - DNA, 195 bp, Homo sapiens
aagcttgcggccgccaactttaccgtgcagttggatgactacctgaacgggcgggccgtgcagaaccgggaggtccagggcttcgagtcggccacctttctaggctacttcaaggctggcctgaagtacaagaaaggaggtgtgggattaagaattaagcacgtggtacccaacgaggtgggggtgcagagactc

SEQ ID NO: 657619 - DNA, 442 bp, Homo sapiens
  misc_feature (2)..(2): n is a, c, g, or t
  misc_feature (18)..(18): n is a, c, g, or t
  misc_feature (22)..(22): n is a, c, g, or t
  misc_feature (31)..(31): n is a, c, g, or t
  misc_feature (45)..(46): n is a, c, g, or t
  misc_feature (52)..(52): n is a, c, g, or t
  misc_feature (67)..(67): n is a, c, g, or t
  misc_feature (172)..(172): n is a, c, g, or t
  misc_feature (174)..(174): n is a, c, g, or t
  misc_feature (204)..(204): n is a, c, g, or t
  misc_feature (414)..(414): n is a, c, g, or t
  misc_feature (422)..(422): n is a, c, g, or t
cngaaagagtgaaacatncagnaccacaggnctcgcactgctganntggcanagtcacagctgcgtngtactgggtgcctgcgtgtacccaggacagcccaggaccgtgtattactcattagtgcacaagtattacttagtgcacaatatacagtctctagaagatgacttntngccttcagtcgccgctccctttgatgtatngttctaagggcagtgctcgttcctctgccctggtttagacaggtacctgatagcacactgtggtgcttctcaagtgggggtctgggggtcaaccagatcagaaacacttggatggggcctaacacagatgcccttcctgggccctgttcatgcagtagaacatgtaagaaagctttaatcctcccaacatgcctgggaagttaaggtggnattctccnttaactcacagagtagataa

SEQ ID NO: 657620 - DNA, 958 bp, Homo sapiens
gtacatccgagtggtgagtagctagctgatctggtagtgtggatctcgtcatcggtaataccgtctaaccagcattgcggtacttggcgtgcatccagagctgatcgtgacagtagcaagatatgcgaaattccatagcatctttaacactcatttgacaaatggcatggcgatgacatctataatgcaactaacggatctgggaactgtctctcagacctgcttggtgcgtgaaaatcctcgcatgaagtcaggtgttccagcaggaaccaatgatccagtgcaagatagaattgcctgataggtaactggtcataaattgacattcccctgaattttgctggacagatgactggtcctgaaaaatgctttgacaccagtccgttgcaagaaaggaatgttaggcagaaggcatacccggcgtgtccgatacaggagtggcaagaggtcattgattacgtggtctagcagatactagctgccattgtgatgactaaacctttgtagagacagttaactagttgttgaacttgcccatgatgatctgggatctcagctatcgactcgtgatgcgtcaagttcaactagttatgacgtttgtacaccttgatgaactggcagttgaatgacttgtcggaattgtgtaatctcgttgccaagtcgtaatgggcctttctcgggaggacgcctcggaacggttcccctctgcaagatatgcgtgacggaaaaggagcatgcgcaggtccccaagtaacggcagttccaacgctttgaaagtgacacacgtcgcggggacctggcgaataagcctcgattccaaaagcgccagggcgtgattccacatctaatggaggggtagaggttcctcccctctctccctcctcttttctgtctcccatcatcctatttggcaacacgacacagcaacgtgcacaagcagaaccagaacaaacaacac

SEQ ID NO: 657621 - DNA, 608 bp, Homo sapiens
cttggggccctcgcgtaggcttccgttgttcgcctgttaactggtcctcccgtgaatgttcttggtttttccggcccccctttatatccgaggttcccccccgtgggccgggtctccgcggccattttcgtcccccgggaattctgcgccccctttccctcgcccccggtgaattagtgccgtgggcctattcctcccgccgacttagccggtgattagccgccctctctgtggtggcgcctcatatttattctcataggcgcccaccctggctcgccgccccaatccccccgcgtgtgcgtttcgtgtcgcccaacccgctccgctttcgcaatgttcggcgctttgggggctgcccctctcgcgtgggcccgagatcccacgcctctggcgggccgcgtgtcccgtggtttaggcttgtctccccgcccgccaatgccgcggtcatgccaatatcttacctgtgaggcccacataaaggtttgccaccggagcccacgttcactcccatgtggagtatacaccccccactccctttttcttaaggtcctcaacattctcaacaccatataggggtttctcgcaaatctcccacaataaacaagaac

SEQ ID NO: 657622 - DNA, 339 bp, Homo sapiens
  misc_feature (43)..(43): n is a, c, g, or t
  misc_feature (158)..(158): n is a, c, g, or t
  misc_feature (160)..(160): n is a, c, g, or t
  misc_feature (237)..(237): n is a, c, g, or t
  misc_feature (243)..(243): n is a, c, g, or t
  misc_feature (330)..(330): n is a, c, g, or t
cttgggagggcccttcaggaagtaggagttgggggttggggantttggtagacccagaaacttctggggacgtcataatagttactaatatttggaggcagtgggagatgctggccccaaggttgaggtatcagttagagcagaacaattggacctananctggtttttcctttgggtttaggtgtaagtgaactattatcattggaaataaaaaaactggaaaaaaaaggttatanactgtncagcactacacagctgcaggcacacagatggtacacatttcccagaaagacacataggtagacacgtggctgtcacccatgacacanaaacaatca

SEQ ID NO: 657623 - DNA, 459 bp, Homo sapiens
  misc_feature (11)..(11): n is a, c, g, or t
  misc_feature (27)..(27): n is a, c, g, or t
  misc_feature (38)..(38): n is a, c, g, or t
ctggggaaaangcctccttactggtancctattactcnaaaatgaaacacgggaggtctcccactgcccatgcccttggccctaaaatggcccttggttttcccttggaaagtccatcctgcatctgccctctcgtaagactattaacttagtacttaaggtcccagaacaaaaatagaaaatgtttatgtgggccgggcatggtggctcacacctgtaatcccagcactttgggaggctgaggcgggcgagtcacatgaggttgggagtttgagaccagcctgaccaacatggtgaaaccccgtctctactaaatatacaaaattagccggacgtggtggtgcttgcctgtaatcccagctatttgggaggctgaggcaggagattgcttgaacccaggaaggggaggttgcggtgagccgagatcgcgccattgtactccagcctgagcaacaagag

SEQ ID NO: 657624 - DNA, 109 bp, Homo sapiens
  misc_feature (39)..(39): n is a, c, g, or t
  misc_feature (61)..(61): n is a, c, g, or t
  misc_feature (66)..(66): n is a, c, g, or t
ttatggagctctgagtgctggtggacagtgcccctcccnccttccttcttccccacaacanaaganaccagcgactcccgcaaagggactaggttcctccctctcctgc

SEQ ID NO: 657625 - DNA, 942 bp, Homo sapiens
  misc_feature (40)..(40): n is a, c, g, or t
  misc_feature (62)..(62): n is a, c, g, or t
  misc_feature (70)..(70): n is a, c, g, or t
  misc_feature (79)..(79): n is a, c, g, or t
  misc_feature (86)..(86): n is a, c, g, or t
  misc_feature (93)..(93): n is a, c, g, or t
  misc_feature (97)..(97): n is a, c, g, or t
  misc_feature (107)..(107): n is a, c, g, or t
  misc_feature (121)..(121): n is a, c, g, or t
  misc_feature (124)..(124): n is a, c, g, or t
  misc_feature (130)..(131): n is a, c, g, or t
  misc_feature (150)..(150): n is a, c, g, or t
  misc_feature (152)..(152): n is a, c, g, or t
  misc_feature (156)..(156): n is a, c, g, or t
  misc_feature (160)..(160): n is a, c, g, or t
  misc_feature (194)..(194): n is a, c, g, or t
  misc_feature (206)..(206): n is a, c, g, or t
  misc_feature (215)..(215): n is a, c, g, or t
  misc_feature (281)..(281): n is a, c, g, or t
  misc_feature (291)..(291): n is a, c, g, or t
  misc_feature (383)..(383): n is a, c, g, or t
  misc_feature (394)..(394): n is a, c, g, or t
  misc_feature (414)..(414): n is a, c, g, or t
  misc_feature (469)..(469): n is a, c, g, or t
  misc_feature (561)..(561): n is a, c, g, or t
  misc_feature (644)..(644): n is a, c, g, or t
  misc_feature (815)..(815): n is a, c, g, or t
  misc_feature (876)..(876): n is a, c, g, or t
  misc_feature (933)..(933): n is a, c, g, or t
aaaagccatgtatttcagggacctcagggcgcacctccgnctgcctacccctccccccaccncccctccnccccccccnccacccnccccccncccncccccctacncgcccccacccccnccncacccnncccccccccgccccccccncncccncccncccccccccccccccccccccccccccccccccncccccccccccnccccccccnccccacccctcccccccccccccaccccccccccccccccccccccccgcccctcccccccccccncccccacccncccccccccccccccccccctccccaccccctccccccacccccccccccccccccccccccccccccccccccccccccccctcccccccnccccccccccncccccccccccccccccccncgaccccccccccccccccccccccccccacccccccccccccccaccacctccncccacgccccccccccccccacctccccggccacccccccacccccccttctccccccccccccccccaacccccccccccacacccccagnggagcgcagccgtggggctctgccaagtgtgggcgctgccccctctgcacacaggggctcacaggggcagagcctttgctggnggtccaggcgctgtttggaggaccccgagggactgaggagcagccagggacccgcctgctcccgtcctcacccagatcaggaaccagggcctccctgttcacggtgacacaggtcagggctcagagtgaccctcggctgtcacctgctcacagggatgctggtggctggtngagacaccgcactgcacacgggaatgcctaggtcccttcccgacccagccagctgcagggnacggggaccttgatagttaagggcttttcaaacatgcatccatttactgacacttcntgttctttt

SEQ ID NO: 657626 - DNA, 350 bp, Homo sapiens
gtttttttgtggaaaagtaaggagttaggtggcttgataataggcagggaaacccgattgtcggggctatgacccttttttccagtatgctacctgatttgtttggctggcccctaggtggcagccttggttttacttctctgcttttttaaagaaatttcaggaaggatgatccttcccgttagtttggccttttttgtcgtttgtgcccataacttggggttatccctatgtcctcagattcctcctaggggagagtttttgtttttatttccaaatttaattttcccttgtttcccagaaatttgtggtgataaaaatggaaaaataaaaatttggggggttagtga

SEQ ID NO: 657627 - DNA, 1246 bp, Homo sapiens
ggcgatcagatcgatctaagatggcgactgtcgaagccggaaaccagccctagtcctaatcccgccgactacggaagacggggaccatcgggaatctgacttcgaggaggtagcataatccaagaacggacttagtatttacaacattgcccgtacagaaccagatgcggcactcggtggtccttgacaaaccaatgattagagagcaaatacctgtggggaaggcaaagccgggcggcgtgattctccaatgtcggactagcttgtggaacgacctttgtggcgctctgtacaaccattattccagtgtgtctagtaatttacatgcctggctgtgactaactcacttttaacagggatggtattggagccatatgtgggacagatgagaaaaaacaaaacgggggaggacgaatggcataagttacatttgaacaaaacagcagagacgaaagtggaccctcgatacgccttttggctagagaccacttctggggccttatgtggagaatctttgtgatgactaccagggatgatggtctgtggcgctgttggttcacactggttagagctaacagcgtgcatcaacgcataaggccacataatggcgactactcggacattgttggacaccccgaagaaacgtggtgaaccccattataagcggcagcggactcacacgggcaacgcgtctcagggactgttccttccaaaagactacggcggactctggcgaatccaggtcccaccgccaagaaaccacacgggtcacaaacaggagggcgacctccaccccttatcacacacagcgctgcggggggtgacaaagaagaacacccttcggagagccccacaacagagagaaccggggccaagagaccccaaattgtggcgcccgggtcccaaaacgagcttcctaacagccacgagaggggagacccaacgacgcgggcacccccacaggtgtgctcgacacagcaaaagaagacacaccccacctaggtgtcaaccgagagcagatcaactacaggtgggcggggggctacccttcaaaagcacaggaagcctgctaacaaaaagtacgtggccagatccaggtgagacacaacaacaacaggcagtcaccaaagccaccatgtaccacagtactccgtaaacaccggcaagaatcagtcttctgctttgttttttgtatataaggttttctgttgctctgtacactagacagtgggcgagagggagagag

SEQ ID NO: 657628 - DNA, 599 bp, Homo sapiens
ttcgtgatcgatgtggtgacgtcgtgctaaaaaaaaaaaaaaaataaaaaaaaaaaataaaaaaaaaaaataaaaaaaaaaaaaaaaatcaaaaagaaccatgaagagacctacaactctaaataaaaatttttaataaaaaaaagagtttttaattaaagaacataaaaattagttatagagggggccactattacatgtggcaacctacaatagattgacctacattcataactaaagctgaaaggcaacaaccactaaatgcctaaataagaatgatttttgaaaactccttttcttggcctcttttggcccgagctgatttttccctctcattggctttttctttaggcctgtataaggttaagattggccaactttctgttgttgtacggttatttcaagtcctgggccggcggtttttatttaggaaattgataaccctggcggggccccccataaagcgccttaaggaatatccccttttgcccaggttgggtataacaaaagggccccccccgaacccccttttcaaatgtttgcttatcccgaacgggataggtttattgataccccctattttttgctaaattccccgg

SEQ ID NO: 657629 - DNA, 644 bp, Homo sapiens
gggcacagcggacaccaggactccaaaatggcgtcagttgtaccagtgaaggacaaaaaacttctggaggtcaaactgggggagctgccaagctggatcttgatgcgggacttcagtcctagtggcattttcggagcgttccaaagaggttactaccggtactacaacaaagtaacattccaatgttgaccgcaagggggagcatctcgggggattaaccatggttgctgggcatgctaccgtgctctttagcctactcctttttcccttaacaaagcatctcaacgcaacgagcgggcttccggaaaattaccaacttgaagagggaacacacttcttggaagcccccccgcgaccccaacgacccttttgagccccggaagccccccttcccgtgacgcggaaaccacaaatcctccaaattccggttaggctggcaagtccctttttcacttattttcccttaacttcaaggcgaaactttttaaacgcttcccagacatttacagacccacttgaccgttgggagccacaccgcatcgcgcggagcagcgggcaaacgccgccaggcactagagctgactcacacacaaccactctatcgcagacgcagacgtcgcgtctcccctcagccgccccctccc

SEQ ID NO: 657630 - DNA, 881 bp, Homo sapiens
gggcctgtgccggccatcaagaccatcaccatcacggcgatgggcaaggtggacggcaatgtgcctagagcgggagtgctgcatacgtgggggcctaaactaacgtggacgtcgatgtcgtggcttctgtgctgggcgcccctgcttcgtgtacctgtttatcggcacgtcctttctggctggccggctttgtcgtcgctcttcggtatccgcaccatcatgaagcacgatcggcaccaagacagagatagctggagaagctcatggtgcgcattggcgtcttcagcgtgctgtacactgtgccagccaccatcgtcatcgcctgctacttctacgagcaaggccttccgggaccagtgggaacgcagctcgggtaggcccagagcgtgcaaggagcatacgcgtatcccctgccgctcacctccaggcgggcggaggcgcccagccgcacccgcccatgagcccggacttcacggtcttcatgattaagtaccgttatgacgctgatcgtgggcatcacgtcgggcttctggatctgggtccggcaagaccctcaactcctggaggaagttctacacgaggctcaccaacagcaaacaaggggagactacagtctgagacccggggctcagcgccatgcccaggcctcggccggggcgcagcgatcccacaaagccagcgccgtggagttcgtgccaatccggacatctcgaggtttcctcagctagacaactctgtatcgacaggctcctttgaacaaactcagctcacggcaaaagcttcacgtgcgtgaggcaaaaggacagagagggcccgagctgccagagggaggatggacagacctcttgccctcacactctgtaacccggagggtcgcttta

SEQ ID NO: 657631 - DNA, 883 bp, Homo sapiens
ggcctttataattggtctcggatgtttcgtgtcctctccggttgcatatttgtcctgggattcatgtccgcttctcggttttgcctggggtttgaataacttattcatcttggagaattagctttaaagtgggcttagacatctgaaacaaatttcagccagtgttgtttacgctcatctcttttcgtcttacgcctttagcacagtatcttacatcttgaatttaatagagtctacttgattaaaatgatgtgggatgaatgaatattagaagtaataatataaggaatcaatgggaaacgtaaactatttagtatgtaggttttgttattattcccagcatttgtcaatatttacttagttactctgtaaattactgtggctgcgtagtttatacatgcctgtgcactatattaattagaagaccatagaacatgccatgcaggttggctaatgctatgggggtttttaccacagttgcaattgtggaagaaattatttggtacattaaatcaaaaaagttggtaaaacatcgaacttttatacctcagtgtatacagatgtgcaagacagaatatgcttatttccttttctagcatataagtgatattatttggcttatgacactaacactattaatgacaggagtcaatcagcctctacagctatcacaatataatgagatcccaatgatgattctttatgtactttgaatgttaattagctttgggactttgattggctggcaaacattttatcattgtcagcatttaattcttagatttcaaaaatagcttacaggatttaaacatggtgtggtattctacagcctttgtgtctcatgagatctttttgagagcacaatgtacatcggagtctggga

SEQ ID NO: 657632 - DNA, 104 bp, Homo sapiens
aggaggcagaacatctggcttacctgtgttgaatactgtgaagggaggcaaagaacagacaggagcaacggcttctgtcatttatgttcctccgccttttgctg

SEQ ID NO: 657633 - DNA, 242 bp, Homo sapiens
tcgctaaccacttctttattggacgtcctgttacattgattgacagctttctcctaagatagagtctcgcggtcactcaggctggagtgcaggggtaacgatcacatctcattgtagccttgaactcctggccccaagcaatcctcccgcctcagcatcccaagtaactggaactacaggcaagcaccaccacgcccagacattaaaaaaaaaaaattgtggggagacagggcccttgctat

SEQ ID NO: 657634 - DNA, 424 bp, Homo sapiens
tgtccagcttcctgagtagctgggggcggtcaccatgttggtgcatggctggtctcaaactcctgatcttgttgatccacccgcctcagcctcctaacgatgctggtgattacaggcgtgtgccaccactcccggtcccaatcatacatttttatttagagtggaccaccagaagcgaacatggattcaaacttgcagctattggattcctgggccttacatctagtctggcatctcctcgtgggattccaactggcatctatatcaacatgagagtcacgagggacatcgcattgttttatgatgttctgtttttatgtatgttttctggatgaaataccagggtgaaagggagatagccaattggattagagctcaagtgccacgccaagtaacttggcagagtattcagtaatggtccacc

SEQ ID NO: 657635 - DNA, 660 bp, Homo sapiens
ttggtgcagtgggggcctgtccagccctctctcgccatgcttccccaagtgacgtccactgacttgtcaccagcgacctgctctgtttcatgcccaccccctgaggaatgacttatggggatcctaacaccctggtgccctgcaccagacaggccgtggtcagggccaggccatcagtgccgggttcttgcacacatgagtatcccacgtgcttgcctgactatgactgtgtgctcatgtgtttttggtgtcctgtagcatgtgtcgttgaaactgtgaccatcactcaggtccaaacaagtgatgtggcccatcgtaggtcacgagtttatgcaactttacagtgtgtgtcgataacaggtacgttctaccatgctttttgaataccatctcataactctttattttagtaataatgcctcagtgtaggtcctggtaagctacagcggacttgctcgaggtttaaattgtcctggctcttagaatcatgccagcacaattaggcaggcaccgagcccatggcagcagcctcggcatccggattgtgcttaggcttcaggcggtatatgtttatcacagatgaatatacaaatgttgtggtgtctctttgggaaaaaattccaactacgagggggccccacaagttccggacgataccca

SEQ ID NO: 657636 - DNA, 384 bp, Homo sapiens
  misc_feature (296)..(296): n is a, c, g, or t
agtccgtgcgataataaaaatgacggcgccggtaaagctcagggggttgggatgaaaagggctgtaacaacgagggctatgtggctgatggaagagtatgcaatgagcgatttaaggtctgttggtcgtaggcagatggagctggtaataataatgcctcatagggatagcacataagggggtatccttttgggttggggtgggcatcagaaatcagtaggggagagagatctaaagaaaatggtggatatgaagatgtatttatggtaagaaaggtgatgagggaaagaaaggtnatatgagagaggatctcatatggcaaagggtggtcctaaagtagaaggactaattacgaaagagggacagggagaaaacgagggtacc

SEQ ID NO: 657637 - DNA, 205 bp, Homo sapiens
ccgtaaatgggggggtagtggttaccccgggctgggcccctccaggagtcacaaattaggcccccgcaaagactggtgacacgctttttagcaggggcccctggggacttcaactgcccaacaacatggaggatggtgtcctgaggcctccaaggacggtccccccccctttacgtttccccaataaagcctttttaaaacctga

SEQ ID NO: 657638 - DNA, 277 bp, Homo sapiens
  misc_feature (94)..(94): n is a, c, g, or t
  misc_feature (235)..(235): n is a, c, g, or t
  misc_feature (270)..(270): n is a, c, g, or t
ccaagagacaccccccgcactcctgtgcccgagctgtctcatctgtgattcacagtctgctctttctggctgcttgtcgtgagaagtgattttnaaccccgaggttagaaagggagctatttttgagctgctttttgttaaaaggcaaattttctgctggggactggctttaccccgtctacctaaatcatttcttactgcctcctgtaacagtcgccttttgtgttctgctggnatttgtttgaacacagtccacaggttcagtggttncatctct

SEQ ID NO: 657639 - DNA, 968 bp, Homo sapiens
ggactggctctgttcggatgccggccgggggggacgaggtgcaatcctctcctcgcggctgggtgtgcttagcaatcacctcccacatctgccaaaggcaggctccgagagtgcttggcggtgacagagcgcctgcgacgcccatgtcgagatgctccgtgaggatggtcaccatgtactgaggaggtatgtgacggagcagcagctgtgaggagggaagtcttcccctctgggccatgtaactatctggcatcgttacctgtctttgcgtccccatccgaacaggcgctcttggagcatccgtgggatgcggtcgtgcaatgcttgctggcctcacaagactgcgtcgagacctatgtcccctgagcatcgaaaaatcgtagtagcgagtctacaggacgaccaactgctgatcatcatcctccgtacagattgtcggggactggagcagtgtgctagagtccatagcggacagacatctaagttgggaacctgtgcgtgcatgttgtacttgcacatgattttcggctggactcttcaattctgacacacggggtcatctctgaacccgtggaccggacaggaccttaggtgtagaaatagccatggcccagacctttgtggggaccatctggtgcctaaaggattcatagccgtgtggccatggtaaccctacaattccatgtagaaacggcgcaaagggccagtcgattgggggagcatgcagctgcgaaggaccatagggttgtcatgcgtccagttggtccgggggattgacgctcacagagaggctagcctaggccaggggaattcactgggcaacgtggcaagatgggacctggccatgagggggcactgacataggaagcacgatccgacacatctgccccacacagggaagaggccccaagggacacgcagcatcaagaacccagcatcacaggacacaacgggccccaaaagacccc

SEQ ID NO: 657640 - DNA, 148 bp, Homo sapiens
cagtggcgtgctacggatccgcactcatgttcattacagtagataactctgctgtgagatcccaaggatttgaagactggacttctggaagtttatggggacttagcagcaaattgcttacaatgaaacaaatgaactcttatttggg

SEQ ID NO: 657641 - DNA, 942 bp, Homo sapiens
gggtcatggcggctcagtgcgtgaggttggcgcggcgcagtcttcctgcttgggcgttgtctctcagtgccatctccccggtagttcgtgcacagccatgaaacaaaagaacagtggccagaagcctggaatgaggacatgggtcatgagtgaacagaaggcagatcctcctggctacagagaagaccctcctggtaaccagaaggtcaagattcggaggaagcagctgaatggagactgtggacaacacatactaacacgagctatggcagacggctgagaacttacggcgagaggagccagaaataggtggaggaggcaaaattatacggcattcagagccttctgctaggcacttgtttggaggtggcatgacgttctggatgaagggaacagcgagtgatgttccaccaatgaacgaaagttacgagacgaataaaccctcatcgtgaagagcctctatgaaagcggctggtcatgactgaatgtccagatccagaagagtgttcacaacagcactggcattgcttaatgttgaacccctgtcggagccaagttcgacccttatgagcatgaggccttgttccaccacaccggtcgaggggaaggagccagggcacagtggccctagttagccaaagctgtggtaccagctgcatcgggctgcactctggatacccggccgggtgtagggtggtgaacggaaagctaagcttatgatcgatgggggcgggctgtttgtaagcctccatggatgtaactctcgacgctgttcaatgcgcccaacaatcagtagtttgacgtctaccaaactaatgtgtaccttgttaccatgggttgtcgtcaagcggtgcccgatgatgatggaccctatggacggtcctttaggcccccgtttgcatccatcttagaggacaagcccgtgtccgagaaagaaggttg

SEQ ID NO: 657642 - DNA, 727 bp, Homo sapiens
  misc_feature (342)..(342): n is a, c, g, or t
  misc_feature (345)..(345): n is a, c, g, or t
  misc_feature (404)..(404): n is a, c, g, or t
  misc_feature (493)..(493): n is a, c, g, or t
  misc_feature (502)..(502): n is a, c, g, or t
  misc_feature (686)..(686): n is a, c, g, or t
gcatccgggaccggggtgtctgtggccggaggctgatcaggattattgcatcgagctttagtgtcttcttattcaacaccgaaaataagcttctgctacagcaaagatcagatgctaagattacctttccaggttgttttacgaatacgtgtggtagtcatccattaagcaatccagccgagcttgaggaaagtgacgcccttggagtgaggcgagcagcacagagacggctgaaagctgagctaggaattccctgtggaagaggttcctccagaagaaattaattatttaacacgaattcactacaaagctcagtctgatggtatctggggtgaacatganatngattacatttggtgggtgaggaagaatgtaactttgaatccagatcccaatgagattanaagctatgtgttatgtgtcaaaggaagaactaaaagaacttctgaaaagaagcagccaggtggtgaaattaagataacgccatggtttnaaaattatngcagcgacttttctctttaacatggtgggataacttaaatcatttgaatcagttgtggaccatgagaaaaatatccagaatgtgaatcatgtaggtaaatgattaccgaacaaatttatctgcttaacaaacttaagaatgactttttcctttaaatttagttctatcattactttatcattanttacgtcatcatcgtaccactccttatgtatatataccgat

SEQ ID NO: 657643 - DNA, 181 bp, Homo sapiens
  misc_feature (64)..(64): n is a, c, g, or t
ccttgggcgaggcagtctcaaaaataaaaaataaataaatgcttgggtagaacctagatggtgncacactgaggttcatttagttttacagtaaacacctatgaagatttagttaatgttacaaaatgtgacaccaggccctaccccaatagagtgaaggtatgagactgcctcgccaaat

SEQ ID NO: 657644 - DNA, 207 bp, Homo sapiens
caaattactgactcgttgatctgcttgtcttacgcctcccaaagtgtgggattacaggcgtgagccaatgcacccagcctttttttttttcctcaaaatagggttaaaaatggaaagcaacagatccagtcagattttttttttttttttttttttttttttttttgacaaccccccatataccccccgggggggggtgggaaaaaa

SEQ ID NO: 657645 - DNA, 207 bp, Homo sapiens
tagcaggatcgcttttacgcaggcacttttacgcgcgcactttttcgcaggccacctactacatgcagcctaattgtgaagcgcgaccctagcaatatcaagcattaacctttcctctacacttatcatcttccttttacgcagtgcgcctgggttcttaggaaataaatgggggaagtattgtagcgagttgaaagattagtgccg

SEQ ID NO: 657646 - DNA, 567 bp, Homo sapiens
gactctgtctcaaagaaaagcaaacaaaaaaaccacatacaatggaactccaataggtctggcaacagacttttcagtggaaaccttataggccaggagagaatggcatgacatattttaggtgctgaaggaaaaaaacttttaccttcaaatagtatacccagcaaaaatgtccttcaaacatgaaggagaaatactttcccagacagacaaaagctgagggatttcatcaacaccagacctgtcttacaagaaatgccaaaaggagttcaatctgaaagaaaactaacaaattctggacttaaattcaacacttgaccaattggacctgatatatacatctacagaacacgctacccaacaaccacagaatgcattcttctaatctgcagatagaacatactctaagattgaccacatgcttggtcataaagcaagtctcaataaatttttttaaaaacctgaaaatcaagccaagtatcttcttagatctcagtggaataaaaatagaaatcaataccaagaggaacactcaaaatacacaaatacatggaaattaaataattg

SEQ ID NO: 657647 - DNA, 483 bp, Homo sapiens
  misc_feature (16)..(16): n is a, c, g, or t
  misc_feature (61)..(61): n is a, c, g, or t
  misc_feature (73)..(73): n is a, c, g, or t
  misc_feature (214)..(214): n is a, c, g, or t
  misc_feature (233)..(233): n is a, c, g, or t
  misc_feature (306)..(306): n is a, c, g, or t
aggtttaacaatccanaatccctagggggcaaaacccattgggttttttgggaacctgttnaaacctgcggtnccccctaagcaaagtattaaatgtaggggatgtccacctcaggcctgcgttgcacgggggctgagttcaactgcgacgctctaactgacgcgtgcttacatgtgcttctcacttccggagcacaggcaggtggctgcgggnccccagctctgaatggatncccatgatgcaactggggcagcccttgctttttgcttgctctcccacagaaacctttggccttgcaactttancctttgtcccgattgggtcccagatacacaaaatgtacaaatgtaaacttgctcattttattaaaattcttttagttctttgttctttctgtaattttttaaaataaaaattgccttgatggagtgatggtttttactcgcaccatacctagtctaaataaagagttctagaatctg

SEQ ID NO: 657648 - DNA, 171 bp, Homo sapiens
tgggttctctagatgtgtgcctgcaggcgtgtccgctagacaggccgtcggtatacaagtgtcgtgacgtgggcggtgtggattggtactccgggaacttgttaaagctattttctctacgtggtacactttgaatatttctataacaaaaaaatgctagtggcatacaaa

SEQ ID NO: 657649 - DNA, 514 bp, Homo sapiens
atgtggacaagtacagtgcttaactctgttaactataaggaagtgaaaacttagtagtatgataggttatttagatgtaaagatgttgtggataccattatatgtaccaccaggttcagaggctcagatgtaatatgtaaatggtatgtcatacgatactatgatgtaattggaaatatggtctataggttatgaatcacttggcagcaccagctgagcaggctgtctgttgtattcattgtggtcatagcacctaacacacattgtagcctcaatcgcagtgcagcacagactagcaagttcctcagtgcatggcttcatgatcagcaaatggcctcatgtcaaatcatttagcatgtacattttgtgtcacagcaacatacagactggctgtaccaccaactcactcacctgtaatgacaggcctgtccaaccacatctcccttttccatgcactgtggtcagccagccatcggcaaagcaagctgatttaaagcggtgtgcattggctcag

SEQ ID NO: 657650 - DNA, 958 bp, Homo sapiens
gtgtagacggacagaggaggcgtagcggtcatagcgacttgagctgcgccggagtggccggaacacgtatgtcatgcatctcagtgcataattgacattgaataaaatgaatatattggcaaacttacttgtaaagaggccgaatgtacgtaaatcatttatgataaatctgttgtataatctttgtacagagactatccaataaggaggtcagacatattttttagcatagagcggtttgcaatgcaaacacttctttacttatgaatagatgatggtgttgaaagagattcgagagagagattaaacagaactatatagtagagagtggaatgtgggatgggaaagagcttagtaagtttatgataagtttcctctagggcaaaattacaggatgcttgtgcaacactatatcgacttgaatgaattttccgcataaccctaggcagaaaaactatttggaattcgatatatctaacttttgaatcttagactgattcagggccagcacgggtgaatggttatgccatccatggtgggttaaccataacgttctaactctttgcaagtggggacgatatctcctgtttgctgccaaaaaaaaatgctcctggagctggccctttgctagagacttgtaattcagggcgtgcatctgtctgttgccagtacggacgaccaagtatccagccaacttttggctgcggtcggtttctgattctaaccctgtgcaggtttagctatacgtaccgttgcatgggttatggcaggctcccctaattttcgcgtggtcctttaatgtggctcgagcctcttacttattgggcttagcgaaatggtttagcgtaattgggccgcctttacggccagagatgcctttccgggcatttttcgggcacctgttttttcccctttcttttcttggagtgttagaggacgctttttatccccttggggg

SEQ ID NO: 657651 - DNA, 134 bp, Homo sapiens
  misc_feature (84)..(84): n is a, c, g, or t
atagggaatgaagagggatgtcacacctgcttgggcctgatatggcgctggggatcagcacgcgagcgtgtggatggacttggncagccagcttgaagacctgggtctggaggcgtctctctaagaaatcctct

SEQ ID NO: 657652 - DNA, 928 bp, Homo sapiens
catgtgacgggacatgcacacgaagtgcccccgggtacagacaatgtctgtcccagtttaaaactacccgctgggtgtctgtgaggggcccgtatttcaaaagcgtatggggggaatttgtgacaacggggaggttgagcccccacggtcgtggcgcggtagaacacacccccccccggggaacggcacaagacacctccttccccacaatctcagaattaagaatttcaagtgcctttggtgcgcaaagaaagaatgtataaccttgtttccttggtgccctactcgtaagccccggttgagacatgctcaagcagtgtaagtgtacccagacaccggcgtacatttgaccaataattagtgtagtgtggagaaagcaacatggggtctctttgcaagggaggagaaccgctgcaacagcatgtcctcacggagcggctgatgttgctagctacaacaagggtgtaatgtggcaacaaataagcaacttctggaaccaccagggttagtgtcaaacgcaccaatgaactatgtgtcacgcccatcgttaatcatcctatttggtgtacttgtgctataacctcggcgacaaaaaatatggccgcttcaggctctacctcttgtcccccccccaccacagagggggagctagaagcagaagccaacttgttgccagaaggcgaggttaatgagctgtgtgtaggacacatgcgtcttattcgcggggtggatactcgccgcacaagtgtcaaaatagctgagcgtaaggaagtgtgtctattgacatgctattcttagcggacgtcgttgatgtttctttccaacaattcagatgatgctacgaatgtttcccgaggatgtatcggagagaacaagtattgcttttgctcaagaaacaggcgccaaaaattttccccccaacataaca

SEQ ID NO: 657653 - DNA, 513 bp, Homo sapiens
  misc_feature (1)..(1): n is a, c, g, or t
  misc_feature (98)..(98): n is a, c, g, or t
  misc_feature (104)..(104): n is a, c, g, or t
  misc_feature (111)..(111): n is a, c, g, or t
  misc_feature (116)..(116): n is a, c, g, or t
  misc_feature (119)..(119): n is a, c, g, or t
  misc_feature (121)..(122): n is a, c, g, or t
  misc_feature (125)..(125): n is a, c, g, or t
  misc_feature (127)..(127): n is a, c, g, or t
  misc_feature (131)..(131): n is a, c, g, or t
  misc_feature (135)..(136): n is a, c, g, or t
  misc_feature (138)..(138): n is a, c, g, or t
  misc_feature (152)..(152): n is a, c, g, or t
  misc_feature (154)..(154): n is a, c, g, or t
  misc_feature (162)..(162): n is a, c, g, or t
  misc_feature (165)..(165): n is a, c, g, or t
  misc_feature (181)..(182): n is a, c, g, or t
  misc_feature (189)..(189): n is a, c, g, or t
  misc_feature (191)..(191): n is a, c, g, or t
  misc_feature (213)..(213): n is a, c, g, or t
  misc_feature (217)..(219): n is a, c, g, or t
  misc_feature (225)..(225): n is a, c, g, or t
  misc_feature (232)..(232): n is a, c, g, or t
  misc_feature (236)..(236): n is a, c, g, or t
  misc_feature (253)..(253): n is a, c, g, or t
  misc_feature (256)..(256): n is a, c, g, or t
  misc_feature (259)..(259): n is a, c, g, or t
  misc_feature (266)..(266): n is a, c, g, or t
  misc_feature (273)..(273): n is a, c, g, or t
  misc_feature (279)..(280): n is a, c, g, or t
  misc_feature (298)..(298): n is a, c, g, or t
  misc_feature (307)..(307): n is a, c, g, or t
  misc_feature (318)..(318): n is a, c, g, or t
  misc_feature (329)..(329): n is a, c, g, or t
  misc_feature (344)..(344): n is a, c, g, or t
  misc_feature (355)..(355): n is a, c, g, or t
  misc_feature (379)..(379): n is a, c, g, or t
  misc_feature (495)..(495): n is a, c, g, or t
nagggggaaggccccaagtgggcccctgcctgttgttctctctggctccagagatgtctgcataggcctcagcttctcactggccaatctcctcttcntgggcnccagccnctgcnaancnnccncncccncccnncntgctgctccccctncncccctganccnccggcttgcccctctnnccctccncncccgggcccggcagcccccctngccnnncccgcntcctggngcangccagagcctcccctgnccnccnccctctnctgggcnctctcnnccccgcccccggcccccncccccgacnatttcgtgtcnccagtctccancctggcgaccaaacnctgcccttgtncgcaaggcaaccccaggagccccngggctgcctggtgggggtgggcccggctgtccgtaccacgtaccacccttgatgtgttatcccccccctagcaggcagacctttcccaaggactccgttcccagccacaccttctnaccttacccctgtcccat

SEQ ID NO: 657654 - DNA, 912 bp, Homo sapiens
aatgtctcaacacaccttcttcgacccgccggaggaggagaccccgattctataacaacagctattctgatctcggtcatcctgaagtgttatatcttatcctaccaggcttcggaataatctccgataaggttgtaaggttactactctcggaaaaaaagaaacattgataggtacataggtatggtcgtagagcttatgatatcagttggtttccgtaggggttatcgtgtgagcacaaccatatatttacgagtaggagatagacgtagacagcagaggatatgtcaacttccgtgatcataatcaatcgttgatcccgagcggagtcgaagagtatttagttgactcgatgaaaatccacggaagcaatatgaaatgatgcctgctgtagtgtcaagagcgctaggattcatcttacttttcaactgtaggtggtgtgaatgaatggtattagtaaatcataactgagacatcgtactgcaggatagtactacgtggtaactgcaattacactatgtcctatcaataggagctgtattggcatgcataggagggttcattcactgattgccctattctaggttaagcctagaacaagactaggtccaaagtcattgggtatcatatccatcggcggtacatgtactttcgtcccaaagacattctcggcgtatcgggaatggccgaggttaatcggattatccggtgcttaaacgaggtgaaatcttataattgtgggcatcattcttacagagagatgaaaatttcatgattggaaactgtcgaagaaagtctaatatgaaagcctaagggggttttgtgcgctcaaattaaacgttatatgaaaaggggagccccggggacggtcgtaaaaaaaaagcgggaaatggggggattgatgtacgaaca

SEQ ID NO: 657655 - DNA, 159 bp, Homo sapiens
  misc_feature (128)..(128): n is a, c, g, or t
cacggatcttgttggtcgatcactgtactccagcctgggctacagagcagactctgtctcaaaaaaaagaaaaaaacagagagcatggacttgggagatacattatttggaatttggaatctcagctntcatcactggcagtacagtggatcgaccaag

SEQ ID NO: 657656 - DNA, 288 bp, Homo sapiens
  misc_feature (40)..(40): n is a, c, g, or t
  misc_feature (46)..(46): n is a, c, g, or t
  misc_feature (56)..(57): n is a, c, g, or t
  misc_feature (60)..(60): n is a, c, g, or t
  misc_feature (75)..(75): n is a, c, g, or t
  misc_feature (264)..(264): n is a, c, g, or t
taaaactactgtatagtagatttccaacaaactatcgttnctaatnaacctttccnncanttccctcaatatccntttattccctgggctctctcctcctcttctcttaataaagcccccagacgtgggctgtgatgggacagcagctgcaggttgggaagtggggcgcgtccaggatacccaccacatgggtgttaattgccctttgtggaaattttggggggtgaggagggtcaggccctcttttgccccatcttttgtcanttcttaggtcattgtatccggggg

SEQ ID NO: 657657 - DNA, 116 bp, Homo sapiens
cacttatgcgtgggccacttatgcgtggccacttatgcgtcacttatgcgtggggaagatgctggaacagagtcatgagctctagcccggtaggcctagccccgggagatgcaggc

SEQ ID NO: 657658 - DNA, 873 bp, Homo sapiens
  misc_feature (45)..(45): n is a, c, g, or t
  misc_feature (270)..(271): n is a, c, g, or t
  misc_feature (273)..(273): n is a, c, g, or t
  misc_feature (278)..(279): n is a, c, g, or t
  misc_feature (288)..(288): n is a, c, g, or t
  misc_feature (295)..(295): n is a, c, g, or t
  misc_feature (315)..(315): n is a, c, g, or t
  misc_feature (317)..(317): n is a, c, g, or t
  misc_feature (319)..(319): n is a, c, g, or t
  misc_feature (323)..(324): n is a, c, g, or t
  misc_feature (333)..(333): n is a, c, g, or t
  misc_feature (335)..(335): n is a, c, g, or t
  misc_feature (342)..(343): n is a, c, g, or t
  misc_feature (345)..(346): n is a, c, g, or t
  misc_feature (351)..(351): n is a, c, g, or t
  misc_feature (359)..(359): n is a, c, g, or t
  misc_feature (363)..(363): n is a, c, g, or t
  misc_feature (375)..(375): n is a, c, g, or t
  misc_feature (385)..(385): n is a, c, g, or t
  misc_feature (392)..(392): n is a, c, g, or t
  misc_feature (410)..(410): n is a, c, g, or t
  misc_feature (415)..(415): n is a, c, g, or t
  misc_feature (421)..(421): n is a, c, g, or t
  misc_feature (473)..(473): n is a, c, g, or t
  misc_feature (480)..(480): n is a, c, g, or t
  misc_feature (483)..(483): n is a, c, g, or t
  misc_feature (489)..(489): n is a, c, g, or t
  misc_feature (546)..(546): n is a, c, g, or t
  misc_feature (555)..(555): n is a, c, g, or t
  misc_feature (589)..(589): n is a, c, g, or t
  misc_feature (660)..(660): n is a, c, g, or t
ccgccgccgcctgtaactgatgcagaggttaccccaccgcctcanccgccacccacagcccgccgccgccgccgcctcccgggcgacgccgggggccgacgcactgcagaggtgccggcaggttccgcccgcggaagtgtcctcggccggcgcaccgcgctccgcccgcgctccgaccccggcccggctggcaccccctcgacgcctccgccgccgcgctcctttcctcctcctctcctctggcgcgcccgctcgctccctcgctttttnncnttttnntcttccctnttccctntccttccctcacctcttttnantntaanntccctcttntnggttttnntnnccatncccttgantctnccctcccagccntcgctctctngctagcnctcagcgcggcccccgcnatganggaggngggtgccggtgccgttgccgccgctgccgtcgcagggggggagtcgggttancagaaantanattgangagtgtccaaagtagcagtggaagtttggaggggcagacatcttggtcccagctctncaagtctcnaaacccgggctcggcggcggcggccaggtccctnctgaatcacacgccgccatccgggaggcccagggaaggtgcaatggatgagcttcatagtctggatccaanaaggcaagagttattggaagctagatttactggagttgcaagtgggagcactggaagtacgggcagttgcagtgttggagctaaagcctcaacaaataacgaaagctctaatcacagttttggaagcttgggatctttaagtgacaaagaatcagagagtcttgctctgttgcccaggctggagtgcactggcacaatctcagctcactgcaa

SEQ ID NO: 657659 - DNA, 1300 bp, Homo sapiens
gctctccctacctccctcctcaggggcaacgagacaggagaatggggttcctgctgtggggcgaattcatctccactacaccgcgagcgttccttacgtcacatctgtgatttgagctcctcctggcgccaggcagacctggcagcgggcgaaagagctcccgaggaagcacagcttgaggtcaggttctatgcgctttcgttaagttttaggggactagagctaccggaacggacggggaatcaaaggagttctcgtatccgtcagtcccatattcccctacgcgcgcagccccacaagttcatccaggggaccgcgttgcgcttgctctgcctaggctggtaagcccatggtgtcctcgaagtagtacggcgcaagtggtgaccgtcaaggaccgtattaggtctcgttcagtgcatcacagcatctagaaccaccgaggagtcgtagcgatctaggttaggcacgtcatcctgtctcctgaaatacgctcagtgtggaaagaaatggtctgcacgaagcactttcccatgcaaccttcccgcttcgcaccatgtcaccaacttggccaacgagtggcacttggaacggctgacagcaaaagttcagagaggggacccgacgtatactcgtcaccgacgaaccccctggaggttaggcaggacggccagcgcagcaatgctaaatgatcctggcacgtgctggtctacgacgacgccatacgtggttgtgaagatgtcgcaatggtgagaacaaacgcacacaaggacagaagatgataagcacaaaaagaccgacgaaacgagacatgcagaagacgggaagagcggaaagcacggtaagcaggtcagaacaaggacacaggacccaaaccactcgacccatgtgagccaccagcaagccacccgcagccgtcccaaggagagacgcacaacgccaagcgcgcccgcaacaagaacacaccctgagagcatagcacaaacgtccgatggacccaaccagaccccaaccaaccacacatcaacccaggaagcacgccaaaagcaacccaacgcatgaccgatccaccacgcccccaagagcagccgaaggacagagccgacgagcgcacaggttgaggcggacaaacacacgacacagcccaaggtcgaaccagcaggaaacaacacacacacgcacacaagacagacacaaacagacgacgcaaccaacacagcacaagagagacacaacaagcaagagaacaagaacaacaaagacacaaacaccaggagaaagcaacccgtgaggacacgcccac

SEQ ID NO: 657660 - DNA, 552 bp, Homo sapiens
cgcctagctgttcttgatgatcctcgttgtccgccatcctaggtatccacgacgtagctaagaggagctggaaccaatccttatgaagcttctccaactcaatagaaaaagagggactcctccctaactcactttatgaggccagcatcatcctgataccaaagcctggcagagacacaagaaaataagaattttaggccaatatccctgatgaacatcgatgcaaaaatcctcaataaaatactgccaaaccgaatccagaagcacatcaaaaagcttatccaccacaatcagctgggcttcatccctgggatgcacggctggttcaacatatgcaaatcaataaatgtaatccatcacacagacagaaccaaagacaaaaaccacaggattatctcaatagatgcagaaaaggcctttgacaaaattcaacagcccttcatgctaaaaactctcaataaactagatattgatgggacgtatctcaaaataataagacctatttatgacaaacccacagccaatcggctgccattgggggtaccgagctcg

SEQ ID NO: 657661 - DNA, 194 bp, Homo sapiens
aggcctcgcggtgacttgatgggattcaaaaccttggttctcagacaaggcccacatttttgaactgaggatagaagtctggcgtttccgatttgcagaacataacacgcattcagttgggataagttttttcatcagtcccacagacagggtcatatatcttgagtgcatccattacgttcattgtgacattc

SEQ ID NO: 657662 - DNA, 4088 bp, Homo sapiens
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtg

SEQ ID NO: 657663 - DNA, 404 bp, Homo sapiens
  misc_feature (61)..(61): n is a, c, g, or t
  misc_feature (71)..(71): n is a, c, g, or t
  misc_feature (114)..(114): n is a, c, g, or t
  misc_feature (135)..(135): n is a, c, g, or t
  misc_feature (149)..(149): n is a, c, g, or t
  misc_feature (159)..(159): n is a, c, g, or t
  misc_feature (182)..(183): n is a, c, g, or t
  misc_feature (200)..(200): n is a, c, g, or t
  misc_feature (203)..(203): n is a, c, g, or t
  misc_feature (295)..(295): n is a, c, g, or t
  misc_feature (314)..(314): n is a, c, g, or t
aaatgatcggttccaaaaaattttaaatgttaagaggtttaaaacattttgctggctgttnatcataaaanttcatgaagtaaataattttgcagaaagtgcaataagccctgncttttgaactgaaaagaaggnaagtgtttttttgngcagtgcttntgaggttcatataatagtcttgnnctataatgtgctttacnacncgataaatgacaaaaacaagccctgtttcatgtttcatttagtgcaaaaagtcaaatttccccagtgttttgttgtctgttggacctgctgnaactacagtagttgaatantgcggtagcatttcagttctctttttttattaaagggctcaaaaattgttttttaaatgttttcaaaaacaattaaaaacattttatatt

SEQ ID NO: 657664 - DNA, 2114 bp, Homo sapiens
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatatctcctcggtacgtgctgtggctgtgtggggcattggcaccccaggtggccctcaggatcctcagccaggcctgactggaaggagctgaccatagtggcaggtgctgtttccaaccagctcttggtctggtacccagcaactgccttagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtg

SEQ ID NO: 657665 - DNA, 133 bp, Homo sapiens
agtaaactagtgtcacaccactgtactccagcctgtgtgacagaccaaatactgcctgaaggcaaaattttaaaataaataaattgcttggggaattctacttacacgtgagataagccactgttctaaatga

SEQ ID NO: 657666 - DNA, 453 bp, Homo sapiens
gctgagcccgcttcggccgggacgatggtaaagtatttcctggtgccagagcgtgctccggatgcttcctgggacctagtggttcgccgccttcttggcatgcgtgtacccgaatccctagtatgcaaacatgtcttgacgtgaagacatagtacaccgtggaggtgactccgctgcaccagcaagactgcttgttcccggctgactcgcttgagcaagaccaacaggatagccactgctgggccgagcgacctatttcctgccaatgttgctcactcggtgtaacgtccctggcagtgatctctacttgctggacccatcagaatcagaccatgactaccttcacctggaacatcaaccacgcccggctgatggtggtggcggaacgatgtatcactgtgtgaactctgacaacagtggctggcactgaaatccgccgggaatcctggtctc

SEQ ID NO: 657667 - DNA, 773 bp, Homo sapiens
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgcctttatacctctctgcacgtcccaccccgttttgctgtgtgctcacccccaggatgtgtacccggttgtagtaggagctgaaatccatgctgagctgtaccaggaacttgcatatcaataaagaatagagtgtagagtg

SEQ ID NO: 657668 - DNA, 236 bp, Homo sapiens
acatactattgagcgaaagtagcacataagacacccataaaagtagagatacatctgcctgtcacacaagtaggacttaaatatacacgtgacttgtcctcgagtttctacgctctacgaactggagaccgacaacatgtatcgaggctattctgcagtcttctctttctcaccgaatttagccccaattaattttttccgcttcaattactgtcacaaaagccggtggttatcta

SEQ ID NO: 657669 - DNA, 751 bp, Homo sapiens
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatatctcctcggtacgtgctgtggctgtgtggggcattggcaccccaggtggccctcaggatcctcagccaggcctgactggaaggagctgaccatagtggcaggtgctgtttccaaccagctcttggtctggtacccagcaactgccttagcaccccaagccgcctcgcctgccatgtcatgcacctttcgtcccaccggctagaatgaaggttaattttggggggggggaaacccccggggccaaaaccgggccaaaattcccgggggccaatttccgggggactttgggggttttttaacacaggggggtttaaggaaacccccccaagggaaagggaaaccccaag

SEQ ID NO: 657670 - DNA, 5654 bp, Homo sapiens
  misc_feature (5629)..(5630): n is a, c, g, or t
  misc_feature (5632)..(5632): n is a, c, g, or t
  misc_feature (5634)..(5635): n is a, c, g, or t
  misc_feature (5638)..(5638): n is a, c, g, or t
  misc_feature (5640)..(5641): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 657671 - DNA, 233 bp, Homo sapiens
gaaggacttgaaagctagtagctgcattctggtatatcaaaggctgatggatgatcctcgactgcggagtggagctgaatgatggcgtgatcattaccgtctgttgttgcagctgaatttgaggttgaggctagcgcttgtagcggagctgaagaataggagttgccctgcatgtgctgggaactgaggtggaagaaaccttgacttgcagagttgtagcctgtggggaggcc

SEQ ID NO: 657672 - DNA, 326 bp, Homo sapiens
ttagctcgatattcatatatggcataattttcgctatctagtatcttcaaatttgtagtctttgtaacacccacataaccttttgtggatcactgtacactcactatttggtagacagaatccatgtacctttgctcaaggttcagcactgaataatttcattgtcattctttcatttgcatgtttgtgctttttaaatgagccaagcactcagcggggaaactatcacctaaaatcagtgaggaaacacacgcactcacaaagggcaggggcatggggatcgtggcgagcagagtgggcgaggtgcctttacgacatggtgatta

SEQ ID NO: 657673 - DNA, 5583 bp, Homo sapiens
  misc_feature (5558)..(5559): n is a, c, g, or t
  misc_feature (5561)..(5561): n is a, c, g, or t
  misc_feature (5563)..(5564): n is a, c, g, or t
  misc_feature (5567)..(5567): n is a, c, g, or t
  misc_feature (5569)..(5570): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 657674 - DNA, 341 bp, Homo sapiens
tcgtgggcagtagacaccaccgatagatatcatacaatttctcaaatgacaaagatttgccattatgaattcctttgctatagacgttcaaacaccccaagccaagattgagcctcagtcccatagtcgtgacattacaagctgctcgcgatgagggtgtcaggcaatgtgcaagggggcgaggtgagaagcaagaaagcaaagtggatcacgtctaatctatgctgaaggagaacttcaagtaagggagctccgtggcccgggacctggctgtgaacaccctccgctgggagcctcagtggtcagcagtggccacagcagtgcgagccactgcaaaagcg

SEQ ID NO: 657675 - DNA, 5557 bp, Homo sapiens
  misc_feature (5532)..(5533): n is a, c, g, or t
  misc_feature (5535)..(5535): n is a, c, g, or t
  misc_feature (5537)..(5538): n is a, c, g, or t
  misc_feature (5541)..(5541): n is a, c, g, or t
  misc_feature (5543)..(5544): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 657676 - DNA, 5387 bp, Homo sapiens
  misc_feature (5362)..(5363): n is a, c, g, or t
  misc_feature (5365)..(5365): n is a, c, g, or t
  misc_feature (5367)..(5368): n is a, c, g, or t
  misc_feature (5371)..(5371): n is a, c, g, or t
  misc_feature (5373)..(5374): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcccccaggatgtgtacccggttgtagtaggagctgaaatccatgctgagctgtaccaggaacttgcatatcatctctgtgcgtacagcaatgtggagccccggggctgtgcagtccagcactgctgtccggctcagcagatccggaaaggggaggatactgttgaagagcaacaaccactcaccctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 657677 - DNA, 283 bp, Homo sapiens
  misc_feature (9)..(9): n is a, c, g, or t
tcctgatanctggcatttactcccatgagtctctgttgggtcagtgctgatgatcagaaacttatgatttgggatactcgttcaaaccatacttcccaaacaagcactcagtttgatgctcacactgctgaagtgaactgcctttctttcaaatccttatagtgagtcattcttgccacaggatcagctgacaagactgttgccttgttgggatctgagaaatctggaaaacttaaagtttgcattccttttgagttcacatataaggatgaaacatattccc

SEQ ID NO: 657678 - DNA, 5754 bp, Homo sapiens
  misc_feature (5729)..(5730): n is a, c, g, or t
  misc_feature (5732)..(5732): n is a, c, g, or t
  misc_feature (5734)..(5735): n is a, c, g, or t
  misc_feature (5738)..(5738): n is a, c, g, or t
  misc_feature (5740)..(5741): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctgtccaggctgggtcttgtgccagatccccaccatgcttcagtgctgaggccttgcacacctgggtatgccggaacctgtgtttggaagagaggaatgccagtgggcagggtcctgggtaaagagtcccccctcattaccctggcttaggttggtgttcctcccagcctcactcactcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 657679 - DNA, 5578 bp, Homo sapiens
  misc_feature (5553)..(5554): n is a, c, g, or t
  misc_feature (5556)..(5556): n is a, c, g, or t
  misc_feature (5558)..(5559): n is a, c, g, or t
  misc_feature (5562)..(5562): n is a, c, g, or t
  misc_feature (5564)..(5565): n is a, c, g, or t
tctcgcgagagttcagctcccttcttagccgtggctgcctcagcacctcgaggatcgacatggacgctctcgaggactacgtttggccgcgggcaacctcggagcttatactcctcccagtgacgggtctggagtgcgtgggggaccggctgttggcgggtgagggtcccgatgtcctggtgtacagcttggactttggtgggcatctgcggatgataaagcgagtgcagaacctgcttggccactatcttatccatggcttccgggtacggccagagcctaatggagaccttgacttggaggccatggtggctgtgtttggaagcaagggactccgagttgtgaaaattagctggggacagggccacttctgggagctttggcgctctggcctgtggaacatgtctgactggatttgggatgcacgctggcttgagggaaatatagccttggccctgggccacaactcagtggtgctatatgaccctgtagtagggtgcatcctgcaagaggtgccctgcacagacaggtgcaccctctcttcagcctgcctgattggagacgcctggaaggagctgaccatagtggcaggtgctgtttccaaccagctcttggtctggtacccagcaactgccttagcagacaacaaacctgtagcacctgaccgacgaatcagtgggcatgtgggcatcatcttcagcatgtcatacctggaaagcaagggattgctggctacagcttcagaagaccgaagcgttcgtatctggaaggtgggcgacctgcgagtgcctgggggtcgggtgcagaatattgggcactgctttgggcacagcgcccgtgtgtggcaggtcaagcttctagagaattaccttatcagtgcaggagaggattgtgtctgcttggtgtggagccatgaaggtgagatcctccaggcctttcggggacaccagggacgtgggatccgggccatagctgcccatgagaggcaggcctgggtgatcactgggggtgatgactcaggcattcggctgtggcacttggtagggcgtgggtaccggggattgggggtctcggctctctgcttcaagtcccgtagtaggccaggtacactcaaggctgtgactctggctggctcttggcgactgctggcagtgactgatacaggggccctgtatctctatgacgtcgaggtcaagtgctgggagcagctgctagaggataaacatttccagtcctactgcctgctggaggcagctcctggtcccgagggcttcggattgtgtgctatggccaatggggaaggtcgtgtcaaggttgtccccatcaacactccaactgctgctgtggaccagaccctgtttcctgggaaggtgcacagcttgagctgggccctgcgtggttatgaggagctcctgttgctggcatcgggccctggcggggtagtagcttgcctagagatctcagccgcaccctctggcaaggccatctttgtcaaggaacgttgtcggtacctgctgcccccaagcaagcagagatggcacacatgcagtgccttcctacccccaggtgacttcctggtgtgtggtgaccgccggggctctgtgctgctattcccctccagaccaggtctgctcaaggaccctggggtgggaggcaaggctcgggctggtgctggggcacctgtagtgggtagtggtagtagtgggggtgggaatgctttcactgggttgggcccagtgtctaccctgccctctctgcacgggaagcagggtgtgacctcagtcacatgccatggtggctatgtgtataccacagggcgtgatggagcctactaccagctgtttgtacgagacggccagctccagccagtcctaaggcagaagtcctgtcgaggcatgaactggctagctgggctccgtatagtgcccgatgggagcatggttatcctgggtttccatgccaatgagtttgtggtgtggaaccctcggtcacacgagaagctgcacatcgtcaactgtggtggagggcaccgttcgtgggcattctctgatactgaggcggccatggcctttgcttacctcaaggatggggatgtcatgctgtacagggctctgggtggctgcacccggccacacgtgattctccgggagggtctgcatggccgtgagatcacttgtgtaaagcgtgtgggcaccattaccctggggcctgaatatggagtgcccagcttcatgcagcctgatgacctggagcctggcagtgaggggcccgacttgactgacattgtgatcacatgtagtgaggacactactgtctgtgtcctagcactccctacaaccacaggctcagcccacgcactcacagctgtttgtaaccatatctcctcggtacgtgctgtggctgtgtggggcattggcaccccaggtggccctcaggatcctcagccaggcctgactgcccatgtggtgtctgcgggggggcgggctgagatgcactgcttcagcatcatggttactccggaccccagcaccccaagccgcctcgcctgccatgtcatgcacctttcgtcccaccggctagatgagtattgggaccggcaacgcaatcggcatcggatggttaaggtagacccagagaccaggtacatgtcccttgctgtgtgtgaacttgaccagcccggccttggcccccttgtggctgcagcctgtagtgatggggccgtaaggctctttcttttgcaggattctgggcggattctgcagctccttgctgaaaccttccaccataagcgatgtgtcctcaaggtccactcctttacacacgaggcacccaaccagaggcggaggctcctcctgtgcagcgcagctactgatggcagcctggctttctgggatctcaccaccatgctagaccatgactccactgtcctggagcctccagtggatcctgggcttccctaccggcttggcaccccctccctgactctccaggcccacagctgtggtatcaacagcctgcacaccttgcccacccgtgagggccaccatctcgtggccagtggcagtgaagatggatccctccatgtcttcgtgcttgctgtggagatgctacagctagaagaggctgtgggagaggctgggctggtaccccagctgcgtgtgctagaggaatactctgtcccctgtgcacatgctgcccatgtgacaggcctcaagatcctaagcccaagcatcatggtctcagcctccattgatcaacggctgaccttctggcgtctggggcatggtgaacccaccttcatgaatagcactgtgttccatgtgcctgatgtggctgacatggactgctggcctgtgagccctgagtttggccaccgttgtgcccttgggggtcaggggcttgaggtttacaactggtatgactgaggtatcctgcggtggctggcgtgctgggcatggggcctgctcacagacagcatggagcagggaagggctgtctgtgcccatgctcagcatgccttgaggggaggaggtggtggccgtgggttcctgatgtcggtgcaggagctgaaggtgagtggagtgctgccaagaatatgcccgactccccatgacaagacagaactttgtaacaaacagtaccaatttattttggccgtgggtttttgctttttttccagttgatgactttgtgaacattcccaggtattggagcctctgtggccttaaatgtggctcagtggagggagacccagcatagccaggccagtatggagcacctcacgcacagctctcagaagctgcaggcggacgaacatctgaccaaagaggtgtggtcgaggctcctgaaagagaaagggcctgctggtctcatcctctgcttcctttgcctttaccctatacctctctgcacgtcccaccccgttttgctgtgtgctcacccccaggatgtgtacccggttgtagtaggagctgaaatccatgctgagctgtaccaggaacttgcatatctagagacagagactgagtcactggcccatctctttgctcttgtgccccaggccagaataaagaatagagtgtagagtgtcctggttgtctatgcctcaccatctctgtgcgtacagcaatgtggagccccggggctgtgcagtccagcactgctgtccggctcagcagatccggaaaggggaggatactgttgaagagcaacaaccactcaccctgttggggagaaaggtgctgggaggggaagtccaggcctccttgtgccagctaccaggagggacactcacctcatcatgtagcagtgagaagtccagactgctcacaggaggaaaagtggggtacagaccttgttccatactacacttgtaactctcaaagagtgtggcaagacgggcacaattatacatgacaaaggtgccactctttgtgcccttcgtggagatactgctgtcagccagagccaggaagagctgactctgtggggctgtgctcagcatctcaaacttgatggtggccacagagagaacaccaaagatctctcgtagtactcaggggcagtcatcagagtgccaggtgcaccagctactttcacagggccacagatgaggtgcttctgtctgagtggagccttgtcaaccaacttccgccaaagcaggtccaacttctgttgctggaactcctcctcacagctaacaacatgtacaaccaggcagccgcctgtaccagtatctgaggccccagccaggcctgggtggctgtcctcgggccaatgccatagagcctcttgcagctcagccagcacagagaggagatcctcagtcaccagacagttgtccaggttggggtcatagccagctgtgcggccctgttcttccaccagctccttcagacacagtctgcctaggatgccaggggacagtgtcctcccgtcattagcagaggtaagttcttcaagggcgtggctcctcagggtgtgggaggaagctctctccgaggcagcgggccagtccacccgcagttgctgcaggaaggtcagcatgtgcggatcccgcacagctggcactaggcgcacgcacaccccgtgagcgcgcagggctcgcgccaggtgatcggccacgagcaccgtacgcagctggctcaagcggagtgcgcagggggagctgcgcagtgctgggcagtgtagtaagacgcgctggcccagcgaggcaggcgaggcgggcgtggcataggcggccacggcgctgaggacgcgctcgaagacggcggaccgctgcagttggagagacagacccgcgggggtcggcgcgcagcgcagcaccggggccacaccggggccctgcaggcaggcgagggcatggagcaaatgctccggaacctggccgtcatcgaagcgcgcctgcagcgcgcggtgcggtgccagaaagtctcgggaacgcaggtggcgggtgcgcgtctccttgatccacaccggaccgcctggccccagggccgcgttgagggcccccagcgtctccccgaccccaaggcgccctggtcgccatgcatnncnannttncnngccagtacagccg

SEQ ID NO: 657680 - DNA, 293 bp, Homo sapiens
ccatcaccccttaatgtatctttataacatcaccacgtcaccttataacctctttatgaccccttaatgtatctttataacatcaccacgtcaccttataacctccttatgtctcctttgtaggtacctactgcagtcacattccccctcaggacctaatgagtatctgtgacagactgagcctctatttcacctccaacaacaaggtggtggacaccggcttcagggccacctggaaggctgtggaccccagccagggtgagtggagctgggcttcagggcctcgtcgacgc

SEQ ID NO: 657681 - DNA, 149 bp, Homo sapiens
cccaactgctgactgcaaacagacgtcactgttcatctgattttgatgcgtgtctcattaccaaagctgggttaccagtgtatacacaagtgttggaagtttgagcattgcaatttcaacgacgccaccacctcctcttcggtttcctc

SEQ ID NO: 657682 - DNA, 686 bp, Homo sapiens
  misc_feature (312)..(312): n is a, c, g, or t
  misc_feature (427)..(427): n is a, c, g, or t
  misc_feature (686)..(686): n is a, c, g, or t
ggctgcaggttgtcacctagtccaagcttatgaaaactgtgagctgcttagaggtgaaatcttcaatgccccttaatttcttcacttaattacaaaaatataaaaattaaaaccatatgctttcaagcataattatgtggatttcacctctttcatctggataggtcagccttgaaacatctttcaaaattaaaatatataataattttattacagaattgtgagttttttattagggatatttatgcaataggcacactgtttttacaatggtctctgatctattaaatccaaacagatatatgtattagnttatatattggattttagaacttactttatcaaaaatatcctttcttttcattaaatgcaaggtttacttgccaaattcttttttctggcttctggaatctctctctctttttanacacacacacacacacacacacacacacacacacacttctattgttgcagaacaacttattccaaactttaacatcttacaacaacaaatacaagttattttagaatcaatgggtacatgtgcaagtctgttacatgggtgcaatgcataatgctaagggtttggcttctaatgaatctggtccccaataagggacatagtaccccacaaggaaggtttccggtacttcaggttttttcctttgccggaccaggggggn

SEQ ID NO: 657683 - DNA, 204 bp, Homo sapiens
ctcattgcatagtgagactctgtgtctacaaaaaaaaaaagaaagaaaaaaaattaagatactgcattgttttgggaaaatatttatgggtcatccctttgagctccatgttccacaaggcttgtctaaaattgcgcggagatttgggaggtaccgaagctcgaatttcgttaatctcatgtggctcatagcttgtttccctgt

SEQ ID NO: 657684 - DNA, 1038 bp, Homo sapiens
ggcacaacgacggcaaagaacgagaagaagtggtccatcagtgatgaagcgcatcctacgggacgtgtggtccacggcacgctatccagatgggacactgatagtttgtgtggctctgcgttactgggcgtcatgtatgagctcgatctggtgttggcagcgtactatatgtggctgtgagctatacaggtaggctcgcctcagacagcctggagcaaacagtacctaatgctgtccatgctctcgtaactctcgaaccagaacgcggcatgctttaggctccctcatcgatcgtactctgtggtacactgattgagtgcggacgctcttccatctggcgagacggctctgggttgaacctgcgctgcgtgatcggcatggctaagtgtacttgctacatcatcgtcttctcacgtacaacgagtcgtctctacgtcccttctgtactcatgcttgtagtaccaggtgttcacgggctaactgttccctgcattcgtgcgcgacctgactattctggaggttcgggactatggcagcggtccgatcgctcacatctgtctctctcactactttctacctgagctttcatgtgcctcaggaggaatacgatggggcacgtcattctgacgcctggtctctagcatgtgatggctgactgggtggccgcggtacgccgtgtgcccatgggcctgggccatgcatctcctctactatggtgtggagatatccagactgggtcctcgtctaccttggtccataagggtgggagcggtcttacgtctctcggtctgcgcctttgccttctggcgtaggcccttgcgggctcatgactacagtcagaccgtgatcagccccacggtacttatcctagaggacacgcgacaagccatgactgatcgtccgtgatgagctgcctgtatgcagggcacctcggaccctgaaccatggagaaggccacaaggtacagtcagcaaagaaccgttacttccttatacatcccacgttacagactgattcgtcaaggaggttcccacctgg

SEQ ID NO: 657685 - DNA, 558 bp, Homo sapiens
  misc_feature (23)..(23): n is a, c, g, or t
ctggcttgctgttcattacttanagctgtgcttgctctctgaagagcttcttgtacttcattctgaacagtagacagtgttttcttcaattcacttaattgctgttccatgctctcgatggctttcctcttatcatcctgaagttcttgcttttccttctctacttccatcaatttcttctccaactgtgtctgaaactctgctgattctttcaagcgaacttcaatgttcttatgaacctcctcagtcacctgtttctccttgttcagggaatcttctaagctggtcaccatggctcgatactgctccacattactggtacttgtcttgagtctctccttcaagtcattgacctgttcttcagcctgccttagctgacttttaagatcatcaacgtcatctctgtcaccaggctgacctttaccggctctctgtgtggactgtgaagcgagctgggcttccatattattaaggtgctgtttcagtgtagcaatgtccttctgagcattttttaacagttcttttgtgttaagatggagatttatttctggtcgacgc

SEQ ID NO: 657686 - DNA, 1865 bp, Homo sapiens
caagcccctgcctctgcctcgtcactgcctgggacctggggcccagattacccccccaagcccacgataccttggtcagtacccaccatcaccaacactcaccaaacaaacacaccgaagagcatgataggatgtagacgccataggtagggacaggacacatgcatagactgacatccacaacacacatcaaccacaagcagacacatgaccaccacacagaacaacacacgtgcatgccatctagacccatccggcaacatcgagaactgacctaggcagagctcagtaccaaacacacaataacacaccgcaacatccatggacatgcacacacatgacacaacatacatgcgaagagaccatcaaacacataggagcgaccatacacgaatggcgatagatcaccacacacaagaacgagaacaaccagagacaaggaacgcaaagacgttacagtgtagcacccagcaatggcacgcaacacctaaacacctgagagagacccacacctacacatgcaaaaagacacataaaacacatacacacacacaatacgttgaggcggcagcaccacctaagccgcgcattccacacaaatacccacccaaatacataccatccatacacgtatagcaaactaggcgacaatcacgaaataaacataaaacacccacaccacatcgaccgacgctccagacagctaaccaccgcgcccccctaagccccacactcaggaccacgcccgccgacccgcacccacacaccaccgccacccaaccaaaccccgacacacaaccaacaccacgccacacgaacgcgccgactcaaacacctggcgccacacgcacatacaccaccacatcccacgccccacccgataaccaccgcaagacccgatagacgcaaacacacccgataatgccgcgccacaccacacataccgataaccaccacaccacttagtagccaacaccaccatcaactaacgcaaatatagcacaccacacgacccagccgacaacaaagacacagaccgcgacgaataccacgacaacagcgcgcaaaggagccacacagaaaacacgaacccacccattacacacccacaacacacggcaacccacgcctccggcaacaggcgacgactcccagcacccgaccacagcacgcacacgcgacaccgcgaccgaactcggacacctcgacaccaccccaaccaccaaccaaccgcatgccacacacacccagacacacaacaacaacgaacgcacaacaacgacacccaccaccccacacccagcgacacacccacaaaccaaccgacgacgccacccgacaccaaccacaaccataaatctcaccaccctacaccagaaaacacccccacacaccacctatccacacaccatcacacacacaacactcacactccaacactcacaccccactcatcaccacacactacaagaacacactcaactacaaccactccacccacacaccacacacccaccccacaccaaccccacacccacacaccacatcgccaacacacaacaccaaccaccacaacaacacttcccaactcacagacctcatcacacaatcaccgcacaaacccccatcaacacacaacaacagtacaccaatcaccaacctcccccaccccctcaaccaccaccaacaacagaccctaccaccaccccactacccccccccccccacccccccacacaccacacacccacccaccacccacactccacccccaccatcaagacctcacacccacaacaccaactaccaccacactcaactcagcacaccatcctaacaatcccgccatccaccaaccaccccac

SEQ ID NO: 657687 - DNA, 132 bp, Homo sapiens
gtgcactgattttgccacaagcggacgggtacacacttcatgagagacgcgctataaacagtctgtaaacatagttgcagataccagtttcatggaagtgtacagacctattaaatgtaacggtgtctcacc

SEQ ID NO: 657688 - DNA, 351 bp, Homo sapiens
ctgcccaccgttcctgtttgcgtggagggtggggggagctcagtggccgggaatcaccggtccgtggggtcgtggggacgggaacatgtgcccgcccgccccctcccccccccccccttaggaggcatacccccccctgtctttttttttttaaattttccttcccgggagagggctctttggccataaaaacccctgaaaaattatttgtttgatgtttgagaagcccgggtcccccagttttgtttcttgttgtttgcctcccctgggttccccccgaaaccccctcttttttggtctctgtgcccttttaaatgcgtgcccgaagtggcccaataaagtggggaagaa

SEQ ID NO: 657689 - DNA, 202 bp, Homo sapiens
acttcatcaactatggtccaatttggggttgtaggtttaatttagaattggggtaaattgatgttttgcatttggcctcaattgacctttagtggagttaattatttaatttttggatttcgggattttaacatttactgtaatttgtaatataactgctgtgaaatacttgaataaagatgacaagaaaaacaaaaaaaaa

SEQ ID NO: 657690 - DNA, 481 bp, Homo sapiens
gagttcgtgcaggagtttatggaggcggcggtgcgccggttcggccgcaactgtctgatccagttcgaggactttgccaactcgaacgcgttccggtttctggaccagtaccgccacgactactgcacgttcaacgacgacatccagggcacggcgtcggtcgcggtggccgggctgctcgcctcgctgcgcatcacccgcaccaagctggcggacaaccgcgtgctgttccagggggcgggcgaggccgccctcggcatcgcccagctgtgcgtgatggcgatgaagcgggacgggctgacggaggaggaggcccgccagcgcatctggctcgtcgacagcaaggggctgatcgtgaaggaccggccgaccggcggcatcagcggccacaagcatctgtttgcgcacgagcacgccccggtcggtacgctgctggaggcggtgcgggagctgaagccgacgatactgatcggtgcggccg

SEQ ID NO: 657691 - DNA, 158 bp, Homo sapiens
ggcaacgtcgactacaaaaacatctgctacgtcatcacgcacggtgacgtttttttaccaggagtggggggacccgggggcctccggtgcccgaggcttctgttcggcccgggctccaccccggctcccaataaaatttagctgatctttgtttctta

SEQ ID NO: 657692 - DNA, 243 bp, Homo sapiens
  misc_feature (214)..(214): n is a, c, g, or t
ctttccgggattttatctctgcctcttctttacaatctattacacagctttcaggggcatcagaaactgaaacactatcttcttctgtttgaaacggttctaaaactactttaataatgacccaatcattccatactgtaagtgggatgattttaccctccctacttgcttggttttaattctttgccaattttttcccaatcttttagatatnaagttccctgtccctgtggataagtaggg

SEQ ID NO: 657693 - DNA, 373 bp, Homo sapiens
atgtgaaaagggtagctcaaagctaaaagcccaagaaggggaagcccattgcagtcgaaaccctgtcttgtaagaggaattggcaggtattcccgatctagcatgtattccagaacaggccactgtacaagcaggaagtactcagccgcctaaatcccaggttgaaaagacacagaaggagaaggttctcgcaacctgtttcaaaaccagcctggtggctgaccagaactgcggtacccgcggtggttaaacttcgccaaatggctagatattatcctactgaaagttgtgcctcgaaagctgttgaagcccacggcaaaaaaacctttcagtcagcaccctgagaacaactgcgaagccagcaattaatccc

SEQ ID NO: 657694 - DNA, 135 bp, Homo sapiens
gtacccctaccatttattaataatttcccatgtcccaagttttggctggatttgcaaaattaacccaaaatatcacaagtccaattaagctgataccaattaccattaggaaggatgggccctgtttggactctg

SEQ ID NO: 657695 - DNA, 550 bp, Homo sapiens
  misc_feature (20)..(20): n is a, c, g, or t
  misc_feature (44)..(44): n is a, c, g, or t
  misc_feature (66)..(66): n is a, c, g, or t
  misc_feature (83)..(83): n is a, c, g, or t
  misc_feature (138)..(138): n is a, c, g, or t
  misc_feature (189)..(189): n is a, c, g, or t
  misc_feature (542)..(542): n is a, c, g, or t
accaacctccatggccaggntcctaccccgtgacaaaatgtggnccatggtcaaaaaaatggcagnccattgattgaagcctnccgttgttgtcaagacctcccgatggttacttgcctccgtctgtcctgtgttggntttacctaaaaaacgcaacaatcagatacggaagccctcttatgctcagcnccaacaggtcccgccaatccggaagaagatgatggaaatcatgcccgagaggtgcagacaaatgacttgaaagaagtggtcaataaattgattccagacagcattggaaaagacatagaaaaggcttgccaatctatttatcctctccatgatgtctcgttagaaaagtaaaaatgctgaagaagcccaagtttgaattggaaactcatggagcttcatggtaaggcagtagttctgaaaagccactgggacgagacaggtctaagttgacgagctgatggatatgaccaccagtcaagaatctgtttaaagttcagacttcaaatagtggaaataaaaagtgctatttgtgncggtgcta

SEQ ID NO: 657696 - DNA, 89 bp, Homo sapiens
  misc_feature (2)..(2): n is a, c, g, or t
tncccactgtcctcacgccaatgtcctttcttccacgaacagatattatgtcattttatccaatgccgataaaggagaaacaacttgaa

SEQ ID NO: 657697 - DNA, 727 bp, Homo sapiens
  misc_feature (15)..(15): n is a, c, g, or t
  misc_feature (25)..(25): n is a, c, g, or t
  misc_feature (28)..(28): n is a, c, g, or t
  misc_feature (54)..(54): n is a, c, g, or t
  misc_feature (118)..(118): n is a, c, g, or t
  misc_feature (149)..(149): n is a, c, g, or t
  misc_feature (196)..(196): n is a, c, g, or t
  misc_feature (727)..(727): n is a, c, g, or t
cctggtggaagatcngtgaccatgnttnaaatgccaccaaaggactagaatatnacataaactagttgataaaccagcagcagagtttgagaggattgactcaattttgaagaatgtnccactgtgggtaaaaggctatccaacagcancacatgctacagataaatctttcggaaaggaagagtcagttgatgtngcagccttccttgttgtctcatttaaagaaatctctagagccacactaaccttcagcaaccccacaccgatcattcagcagccatcaacagtgaggcaagactgtcttccagcaacaaagactcactgaagacttagattatcgttagcatcttttagcaataaaatatttttaaattaaagtatgtacattgtcagatataatgctattgcaaacttaatagactataatatagattaaacataacttttataggtgctggaaaataaaaataattgtgtgactccctttattgtgttaaacattttattacagttgtctggaagcaaacctgcaatatctccaagatatgcctgtatttttcaaaatgtggtcttttaacattgctatgaagtttatcagtaataatatcttatttcatggttgtccagaagttacataacttgtcttaatctaaaaatcatatcatttaaaaagcctgatgatttaatatttttcataaagaaaacttttgacaatttgtttttaagn

SEQ ID NO: 657698 - DNA, 319 bp, Homo sapiens
  misc_feature (3)..(3): n is a, c, g, or t
  misc_feature (32)..(32): n is a, c, g, or t
  misc_feature (75)..(75): n is a, c, g, or t
  misc_feature (120)..(121): n is a, c, g, or t
  misc_feature (270)..(270): n is a, c, g, or t
ganttcggcacgaggcctcaggcaagcatgtntacaattccagtaaacacactgcgcatactcacctctaaagtnttagcaagctaccatgcatgtgagcagcccaccctaaggggctgnntcatggaaaaaggaacacaagaccctaagagaagaatcgtgggaaaaggaacacaagaccccagaagtataccaacatataaaaccacaagtcaaaggtgtgacactgcacttgatctccaaagtgcccactgtggtctcttccaagtntcttccaaggacttccaataaagtttcttcctttctttcctgctctctt

SEQ ID NO: 657699 - DNA, 695 bp, Homo sapiens
  misc_feature (284)..(284): n is a, c, g, or t
  misc_feature (385)..(385): n is a, c, g, or t
  misc_feature (509)..(510): n is a, c, g, or t
  misc_feature (518)..(518): n is a, c, g, or t
  misc_feature (527)..(527): n is a, c, g, or t
  misc_feature (544)..(544): n is a, c, g, or t
  misc_feature (547)..(548): n is a, c, g, or t
cggagtagacctaagtttttaagggacctattttaccttaaactgtttcttatctaaattcttgcagagtggcaatggtatcattgattctagaagaccaggggataatccctttatctctggcccctcaaatatgcagtgccaggagtgctaaacctagaggcccatactgatgacctggaagggggatccatatgattggcaccacaaagtgcttttacacaaaaacttgaaaatttgaaaaacatgatttttttaagtttctcatctcaccagtcttggtntttatattgcaaatctatcaaagtaagaaataatttgtgctgtatacaaattacatggggaacataaaggagtgagatccttctgtgataaaatgaattcnccactctggttacccaactacagaacctcctttgatcaggccagtaggttgtgatgcaggctggagcccccgaatgccccacacacactgcagcattgaccagaccatccgaaacctgggtccnnggtgatgntctcaagcntcggaagtggcaatggnaannatatggcccgttgcgggtgtggagagttgtgacttaagaggaagcgacctcccaagtatggaacgatttcaaggcaggctggcctgccaaaaaatctgcctgaataaaggggccggcaatcccgcgaaaaaaaaaagcgcgtaacaa

SEQ ID NO: 657700 - DNA, 696 bp, Homo sapiens
  misc_feature (284)..(284): n is a, c, g, or t
  misc_feature (385)..(385): n is a, c, g, or t
  misc_feature (509)..(510): n is a, c, g, or t
  misc_feature (518)..(518): n is a, c, g, or t
  misc_feature (527)..(527): n is a, c, g, or t
  misc_feature (544)..(544): n is a, c, g, or t
  misc_feature (547)..(548): n is a, c, g, or t
cggagtagacctaagtttttaagggacctattttaccttaaactgtttcttatctaaattcttgcagagtggcaatggtatcattgattctagaagaccaggggataatccctttatctctggcccctcaaatatgcagtgccaggagtgctaaacctagaggcccatactgatgacctggaagggggatccatatgattggcaccacaaagtgcttttacacaaaaacttgaaaatttgaaaaacatgatttttttaagtttctcatctcaccagtcttggtntttatattgcaaatctatcaaagtaagaaataatttgtgctgtatacaaattacatggggaacataaaggagtgagatccttctgtgataaaatgaattcnccactctggttacccaactacagaacctcctttgatcaggccagtaggttgtgatgcaggctggagcccccgaatgccccacacacactgcagcattgaccagaccatccgaaacctgggtccnnggtgatgntctcaagcntcggaagtggcaatggnaannatatggggggcttcggttgggggacagttgttatttaggccggagtgggcctcctcaaggaatggaacggtttcaaaggcaggctgccctggcgcgaaaatgtttgccatgaatgaaggtgcctgaaatcctgctatgaaaaaaaaaa

SEQ ID NO: 657701 - DNA, 170 bp, Homo sapiens
ctgtgttacatacacatactttcttgtgcttctgagtagctcaggtgtggcttttggctgcagagtgttaacattttgataccatgtaaaccttacccagtcgttctcagacttggagtcttgttttttgatggggaacaggaaggttgtttaaaagaaaagccttctga

SEQ ID NO: 657702 - DNA, 185 bp, Homo sapiens
cgacagagaatccttactctgtactcatagcgcacgtatagtaggccctccaggccctactgtttgcaggcacattgagttaggccaggttctctcctccagtcgctctgtaaagcattactgctgctgaagcctcttgttgcttcccagtcttactggcaacttctagataacaatttgtaaaa

SEQ ID NO: 657703 - DNA, 344 bp, Homo sapiens
acgaccgtcaactcgtgctctgtggccaccgccaacgtgtgtgtggtcgacggctggcaaccgcacgattgattaggacacatatttatatgagggaccctatttgtgacagctgcaccgcatttggtcacacactcattgaccatgagtagggcatgggagatgactggcagtgacagtgcgacctctattgagacaagtgtactgtggaaactgtgtactgctgcaccaagatgccaggataacaatgcacatgctggactctgaagagaagcacagttcacagacccacttacgactctgatctggacgacatactggtcgttgcctcgatgggcatatcc

SEQ ID NO: 657704 - DNA, 112 bp, Homo sapiens
cgtgctggccgatggcgcacatgtgcctgtcgcctggtcggcctgtcggcggtcacccagctggcggaaccgcgggtgctgagcctgatgatgggcacctggttcctcgcca

SEQ ID NO: 657705 - DNA, 331 bp, Homo sapiens
ttccaaagttgtaccctacaccctcagataactcggtagctctggacatcctgtcttgacctcctcatcctgaaaaccctttgcccacagtttgaccaaccaggccttgggtactacgctttggcatgccaaagcgtagtacccaacagctcattgagaacgggccatgatgacgatggcggttttgtggaatagaacagggggaaaggtgggcgaaaagatagagaaatcagattgttgccgtgtctgtgtagaaccaagtagacatgggagacttcattttgttctgtactaagaaaaattcttctgccttgggtactacgctttggca

SEQ ID NO: 657706 - DNA, 777 bp, Homo sapiens
ggttctccctacactttattggggtattgcgaaagtggtgttagccagatagtgttgatgaggttgcgtgattgttgtggtgaatggacgatagtcagtgtgattcgtgacgacagctagtgtgatgagtggaatagccgggataccgactagtgtagtaagtctttttaggatgattttgaagtttagtcgtgcgtcatgtgttctgatttctcatcattgggagatcgttagaatcgttgaggcaagcagtggagcaatattataagtgcctaagattccgagtgcaaactttgcaagttggagcaattgtctgtgtttgaaaagatgagatatagtgataatatattccagggcaaagctttgagtgcccagaagggaatagctgtaccagttgctaacctgtcttgtgcttcaggagccagccatgttattgtttgtgcagtgttaacaacaatcatgataatttaaagttagatacactagtgttgttcacttgtaggactgcagttctgtattttgggttaaaggttcttggctgctgtaagaatgtgaatttgaatgtattttcgaattgtaagagcaaaagaacgttttcgtacgattttttcttgcatttaacttggaatgatcttcaggtttctacaatctaggggtaattgtaatatttaatagcattacgcactttattggctgcagtaatgtatatatccccattccaagacatataacgtgagtgaagttgaaatagatcttttattaaccatctgccgtgtt

SEQ ID NO: 657707 - DNA, 1174 bp, Homo sapiens
acgtttcttcgatgggtggcttttttttggtgcggtggtgtctgtctttgggcgtgcttaccagggtgtttgccatgctggtgtgtcgcttttctatatgccaggtgttgttggtctcgtgctctctgcggcgtggggcccgttttctcgtatttgctcgttcccctctcggttttcggtttacgcttggcatgttgtagctcttggtcggccagtagtacccggtggctgattgtgatgccggcgtgtatgtttgcattcctgttttctatagtatggtttggtcctccttggtgtttgaaggcctacataaagtgtctaccatggatgttctcctgttcttcttagatatagggtactatctcctcatctctgttatatgtagtaaagggtttcatacgcggctatagtgagaatagtcaatgcgagtcctctcatgtgctctggaggcgggatatgagggagcacatagtgcgtgctgcgccctgctgtccttgaggaaggagagtggaatgcaagtggtgagcaggctgctgggctgctggaaggccgcaaggccacaatggagcccccaggtctgcgtcacactgcacccatagagtacccgctttgctggttggtattgaacttctaaggcgcatcacgttacctcgcaattgaggacacactcctcttgctggcactgccatactttctagggagcacttgtgactaacggtctggctaggtgccactgatggtactctcacgagttatctgtcttgccctgaagaactgcacgtcagacccgttcagtgacgctgcaagtcatcattgcggctggagatggttgccagacgagctggacgcataggctgaggaagaatgccttccgccagtgtcagtcctttatctggaaccaagcaactagcagactcgcagtttcctcggacgtctcgtggtccttccacgaggccatggagctgtgccttctgccgctgagtgccacgagttggcagcgtggacctacgacgtcatacacatgtgcggaaaactggatcctggcaggcgaggagacccagacgctaggttcgagagtacttttcctgggagggggcctatccagcagtgtgggcaaagccttcaatcagggcaagatcttcaagtgaacaataatttccccactcacctagct

SEQ ID NO: 657708 - DNA, 110 bp, Homo sapiens
tttttattgtttgccccgagttttcgtgggcttttttatcctcaccggtgtataaaaaatttttaattttttttaaacaataaattttttcacccatgaaaaggagaata

SEQ ID NO: 657709 - DNA, 577 bp, Homo sapiens
aaaggtgtttgtgcttccgtttggtttctgctcagtaatatagtcaagcaagtttgctccaagtgacccattgagctgtgtatgcattttggtttatttcaataaaatatatttgtattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaacaaaaaaaaaaaaaaaaaaaaaaaaaaagaagaaaaaaaaaaaagaaaaaaaaacgagaggaagggggaagaaaggagagagacagaagagcacacaacgaagagaagaggagggagacaacacaaaagatggagcgccaagaccacagcgaccaccgaagcaaagagggagagaaacaaggaggagacgagcgaaacagaacaaaaagagagggaggaaggaagaaaggagacagggcaagagaaaagtgcagagagagaaataagaagaaagacaaaaacaacaaacaaaagacgagaaggaaacaggaaaaaaacagaggcaagggggaggagtt

SEQ ID NO: 657710 - DNA, 899 bp, Homo sapiens
ggcgtacttacctcgactcttagcttgtcggggacggcttaaccgggacccggtgtctgctcctgtcgcgcttgcgacctcctaatccctagccatctatgcgtgagtgcgggtctccgatccatcgttggtccaggctggtgtccgagatgtggcaatgcctgctgggagctgctactgccctgggaacgcggtgatccagcccgagtgggcagatgccaagtgacaagacccatgggggcggagatgactccttcaacgccttctgcagatgggacgggggcgtggcaggcaacgtgcccgggttgtgttgtagagttggagacccgacagtcattgatggaagttcgcactggacatacgtaccggcagtatcgtgaccagcctgatgcgagctcatcacacggcaaggagagatgcgtgcaataactatgccctgagggcaacgtacaccattggcacggacgatcagttgaccttgttgttggaccgaattcgccatgactggttgaccagtgtacccggttctctggggcattcttgtggttccaatagcctggtggttgtggttgaatctgtattcatgggtttcggcctacacctgcttcagtggaaaccgtcgctctcagtgagttatgagcaagtggattctgagctggaggttcctccaatttgacccggtgacccaaggattccacacggctggaagtgggatccctacatgtctattctttagcaacgcgaaagagcgccgggaagccatcggttgtggcctcatggtgaacagagaggctcgatggactcggaggaaaaccacgaattagagggccacacttaaatacatatacgcgttatagacaatatgggtctacataatgatcaggatttgggaccttatt

SEQ ID NO: 657711 - DNA, 223 bp, Homo sapiens
cgcgggtatacagtgcatgacagcacacctggctaacttttgtacttttgtagagatggagtttcaccatgttgctcaggctggtcttgaattcgtgagttcaagcaatcctcctgccttggcctcccaaagtgttggaattataggcatgagccattgcacccagggtttttggtccattttgagttaatttttccaactttattctttttttttttccttt

SEQ ID NO: 657712 - DNA, 1227 bp, Homo sapiens
  misc_feature (426)..(426): n is a, c, g, or t
  misc_feature (994)..(994): n is a, c, g, or t
gggaactgatgcccgacagtcagattgctgctatggagtgagaatcagttaactgtttctccacgcttgatctcctgcgctatgctgttggccgtctgcacttgggtggccccgcgaggagagccattgtgctcgaacgagccgtagtctcacgtgatacagaagcgcgtaaccacaactgcttggatgtagcatcgtttcatccgacagccgctggtgaacggtcgagcaggcagacatatctgtacacttggatatcatcgcgagagtggaccggtactgtgcacgctgtgtcgttctgatgcgtcactatgaagccgcgcgggtctaggcatgtaacacctgtgggccgtacattaatctatctctcgaatgtgcttgcaacataacgcgtgtgtaattctacattaatggcggacaatgagnccgagccaccgtgatgaatggcacttggagcggcgagctgaggcccggtgggggcgatttcctcggcccacaaggcgcagaacctccatggacccgaagtggaacacgcataggcctacttgaataagagaaatagccatatgcaacggcacccaacttgttttagttggcagacatcgcgtgccgaagcagagttgtctcgtaagacgccacgtgtataggagttggggttacctctgccgaaccaacattggacaggaagtgggaatacctttttctcaccgggtaacgtacacattcgtcgcagcacaaagcaacatcttatgaggcaggaccaaccctatgtggaacgtacccagtgaagacctgtgcagataggtcactgtttgtatgaacgccgtgcgggagtgctgcctgagtatggggacatcccgttgtctgtctttcaaacactttaattccgaggggtggcatcccgtttggaagagttccgaaatggaagggctcacacatgaaacgggtccatctccaccccggggatacgaaggttcagcttatgggataaccntgggaaatggacagcacccggatcctttgcttggagggcctggggggttcggtgaacacataagcctcgtgggagttcttggggtaccctaggttgccgcctacttgatttgaggaacggcacgtcaaggacggcagaggacctttcatgacgattccgttgggctcacgtgcccctaggacccattgtaacgagggctattttgttgtgctcccctttataaaaggccccgg

SEQ ID NO: 657713 - DNA, 330 bp, Homo sapiens
cgggtctcttccggacatgtacatcaccgattaggtgcacaacacgtgagctagtcaaggtaaggttgcaaaaaaaggcctgaagacggtccctcagattttccaacctaatgagatagatgaatgagtaaaagagtgacaagtccaaataaggcaactgcttcgctgcagaccaatcaagcattaatctggttggtctccgcacgtaacttataaaagcttacccctaaacgggtaaactgaaaataaaaagatacctcgggcccggcgagatggctcacatcggtaatcccagaacttggggaggctgaggtgggtggatcacttgag

SEQ ID NO: 657714 - DNA, 324 bp, Homo sapiens
taacgtagtgtggtgacaagcactaaaatcctgattaaacagaatagtagtaaaaatagcctcagtgatttaacgttcgaaagcagtacacgggtacatggctctggttacccagtatcaggaagtgtacaaatgttttttatccaaaaatacaaaataaattatctgtaggcttggacaatgacagcagtaaaccattatatatttggtcacctgaaaccagtaactgatggtaatagtgattttcagccagccgttttcttcattttctccaactgacttctctgaagttatgggtgaggaacactgccttgggcttcctgt

SEQ ID NO: 657715 - DNA, 160 bp, Homo sapiens
  misc_feature (115)..(115): n is a, c, g, or t
gagatccctgaatcgacggtttctcagccagctgcttcaagacctcagcttcatgggactgcgtctttcttctgcagcttctaatttcttctgaatttccaccagggaaagatcncttcttcttgggaggggaaaagggggaattctgggaacagcattc

SEQ ID NO: 657716 - DNA, 290 bp, Homo sapiens
  misc_feature (22)..(22): n is a, c, g, or t
  misc_feature (167)..(167): n is a, c, g, or t
  misc_feature (169)..(169): n is a, c, g, or t
  misc_feature (178)..(178): n is a, c, g, or t
  misc_feature (195)..(196): n is a, c, g, or t
  misc_feature (206)..(207): n is a, c, g, or t
  misc_feature (209)..(209): n is a, c, g, or t
  misc_feature (212)..(214): n is a, c, g, or t
  misc_feature (257)..(257): n is a, c, g, or t
  misc_feature (267)..(267): n is a, c, g, or t
gggggacgcgcaagtgcgcgantttttctattttattaaaaatatagtagaaagacaactgtacaggttttttctcccagctcccgggtgtgaaactaagtactagccctagatatgtatatatacacaaacacacacatgcacactgatcttagctctgtaaaacnanttagcaaancccaaatcgactgccgnncgtcttactnnanccnnnacgcccactccccctccccctcccgcagcttacaacttacttnttatagaggnctcaaaaagagatcgggaggttt

SEQ ID NO: 657717 - DNA, 139 bp, Homo sapiens
gcggccgcctactactactactactgctcgaattcaagcttctaacgatgtacggggacatgggggctgtatttaaggacacccgtgccccaagcccacctggggccccattaaagatggagagaggactgcggaaaaa

SEQ ID NO: 657718 - DNA, 467 bp, Homo sapiens
ctcgtttcctgcacttcaaactatactacgaggctacagtaaccaaaacagcatggtactggtaccaaaacagatatatagaccaatggaacagaacagaggcctcagaaataacaccaaacatctacaaccatctgatctttgacaaacctgacaaaaacaagaaatgaggaaaggactccctatttaataaatgatgttgggaaaactggctagccatatgcagaaaactgaaactggaccccttcctcttaacaccttatacaaaaattaagtcaagatggattaaagatttagatgtaagacctaaaaccataaaaaccctagaagaaaacctaggcaatcccagatgttcaggaggctggggcaggaggcacacccgagcccaggaggtcgagtctgcagtgtgtcatgatcacaccactgtactccagtctgggcaacagagacagtgaaaccctgcctat

SEQ ID NO: 657719 - DNA, 236 bp, Homo sapiens
  misc_feature (26)..(26): n is a, c, g, or t
  misc_feature (83)..(83): n is a, c, g, or t
  misc_feature (186)..(186): n is a, c, g, or t
  misc_feature (193)..(193): n is a, c, g, or t
  misc_feature (224)..(224): n is a, c, g, or t
gcctcctgtctccagctctctccagncaggcccagtcctctgaggacggcggctctgttcaagcactttatgtggcaggggantccgcctggctgcagcactagacttgtagcagcctgggctgcaggttccccccgaccattccctgcaccatgcggcagagcttggcatttctcctcagagaancgttgtnttaaggtgatcgaggaccagacattaaagcngtgattttttta

SEQ ID NO: 657720 - DNA, 113 bp, Homo sapiens
tctccccacatatgctttagccctaaacctcaacagttatagtcaacaaagactgctcgcctgaacactacgagccacagcttaaaactcaaaggaccgggcgtccctcgtga

SEQ ID NO: 657721 - DNA, 820 bp, Homo sapiens
ggcacgaggctgcgtgcctggccatataaacccgtgcgccgccaggcgctgtggccgtccgggtctgtgactcctcctttcccccgccccgcctccgttcggagagcctggtgggcgggcgcctctcggccaggaatgctgcctcttggacgctgtgtgaccgatgcccagattgccgaccacttctggagctgctcctgtgcagcacagcagctgaggctgcctgatggcccccacggcgagccagctgcctggggggtggctggccaagtgttggggagatgatcaacagtttccagtgtccgggccctccctgctgggggccatcggtgccccggagcgctgaccccgcgcccaggggccgaaagtgatgagagagagcggccaccgagaccaggaagacccacttacaacaaagaacctgtgaattcatctgactgttgcatgagtgatgactcagtgactcattactcgagattgggggatgggtccatagacacattggatgctcaaacattgctgcagatccagaggagattgacaacatctatttgccccgagggagggtagatcgagcaacaattcttttcctcacgcattggtggagtccaaaccacattgcttgaggggaaccgcaagaatgcgtgtagaagggacatactgtacccccttgtatccggcatgtcaacatctgagagaacccacaaaatgttaacagaagaatgggccagatgacatgcgctagaatacacaaggaaggaggacttaaccaacacaaggagcaatggagtttgcatatgtacagtgtcctgaattagag

SEQ ID NO: 657722 - DNA, 213 bp, Homo sapiens
ctgcttcagtctcctgaatagctgggactacaggcacacaccattatacctcactgcattcatctttaaaattaaaaaaaccccctgaaggggaggacagtaacaaagacagaaattaccacaactccaaagcccaaactacctaacactcaaaatacaatcctgggggaagatagtaaatattttgacccagaggacaaactaggaaaggat

SEQ ID NO: 657723 - DNA, 161 bp, Homo sapiens
attcattgacctcgcttcgggcactttcggatctaccatgaacactactggtttatggaggatgattcctggctagcgagtgtgttcgtgcagaccgatgctgcgcagatgggttcggtacggctgttgcgccagggtggtcaatgaagcgcagagctgta

SEQ ID NO: 657724 - DNA, 310 bp, Homo sapiens
tagcgactacaccgccttactacgttggtccagatcggtctatcctcaggccgggcctggcccagtagcaggcatggaaggtaatggccccgttgctgtccactaccagccggcagccccccgcggacgcctggtttacagcaagctagtactgtgaagaaaatattgggaagctctgtgaatacatcaaaaaccatgaccagtatcctttagaagaatgtgatgctgtcttcatatctaattgagaggaagatgataccaatctggaaacaacaggcgagaccttggagatggacctgagatctgggta

SEQ ID NO: 657725 - DNA, 747 bp, Homo sapiens
atatggactagaatctcagacgttgaaaaacatggcagaatagtacaaggagtttgcctcgggtaaataatttaccaacttgacttaatttaatatatatgtaccatctataatatatgccatagatttgaatatgataccagatatttgcatataatgccatattttttccggaattatgggaaatgtatagacatgaatgttctttatccctggaagacttcgatgtgtactttctggaaaatgcatttgttacataagcactatgttaatcatcaaaagtgggaaattaacattaatacggaatattacctaatctacagactcagttgaatttcaccaatggttccagtttagatgctatatggtaaaagaaaaactggatcacggattgactttattaggtgtctcatctttttaaatctggagcagattttctgtcttttatgacaatgacattttagaaaagtactggtgagatgtgggcagaagtgttcttaatctgagattctccagtatctcctcatggttagattcaggtcatacattttcagctggaatatcatagaagtgatgttatgtcctttgtcattcattatgatcaaggtggcatgatgtcaatttccctcattattagtgaatgtgactttattggtgaagatggtgttgacagttacagtaaaatgctgccgtgaaggggttcaacgttccttggtagatatagtatctaagaagattgattaggta

SEQ ID NO: 657726 - DNA, 407 bp, Homo sapiens
aagacgttctttccttgtataccatgcaagggagcctgctcgcttaggtgaagcaagttacgctagggctgtggccaaatttgttctctaccaaaaccgccaacgggttggcgtgatcgctaaatcgctagggtttgtacgcaggtcatctacatccgtgggctcaactggatggtggtcggttctcccctctctgaccgttaccgggtctatcaagggaccggcctggtcttttcaactagtccccttgaagacaccggggggctctaccaagcagttcacattgccgaccaagacgagaacccctcgccattttagtggccaccatcttaaaccactgggcacaccgtcccgatcacgaactagcggttacctggcacccccgaaggcggattgattcccacccg

SEQ ID NO: 657727 - DNA, 250 bp, Homo sapiens
ggaaaaaaccggtggccccctctccaggggggggttgggggcccctgggcccccccggttccccctggcccccctggggggggtttttttatgttgggggatgggggagggggggcccccccccccctgggggggggccccccgggaaccccgcctttttaaaggggggggggggttttttttccccccccccccccccccggcccccttgggcccctccataaaccgaaaggggggggttttttttcca

SEQ ID NO: 657728 - DNA, 317 bp, Homo sapiens
tagttcttgtatgccaacatgtcaggaaccgttaattataagttgagagacatgcgtggcagaagagttaaactctgtctagatatcagctgtgctcaggccatcactagtttcggaggctatggaatttactgttatctgatgattacaatgttccaggaggcaaaagggaagcaagcaatccaaataaccacttgcttgcccagagacctttccctcaaacagatgctttcaagagctgcgagagagtagggcatcccttgtggtggtacctctatgtttaaagacagaagaaaaaaacccattctatggatagt

SEQ ID NO: 657729 - DNA, 300 bp, Homo sapiens
taaatataggtcacacccccaagagcaatatagtcacgagatatcacaggtcctggttccccattaaaaatcagacctctcaggatgtcgggagcccatggtcaacctgaaggccttagattccaacccctcaataagagacttccttcatttaacaaagagccttgttcttatccctcaagaagaaacccaccataaccagggcaactgtcaaccctaatttacagacagcaaaaaaggcctggaagtgctacttaccggaccccccaagtcatcctcacctactgtcacctcaagaaa

SEQ ID NO: 657730 - DNA, 405 bp, Homo sapiens
atctttgaagtttattctgttacacagaaaaaaacatacatctaaatgactattgcttttttaaattcttttagctaatacttttcagtcgcggacacaccgtgttctcagagttttaaaacttctttgaaattttttttggtggccaattttgcagacacacaaggaaatcagtacctcagctatttattcaggagtggagtctcactctgtcacccaagctagagtacaggggcacaaccatcatagctgactgcaaacttgaactcctgggctcaggccatgctcctgccccagcctccccagcagctgatactacagctgtgcaccgccatgcccagccagtacctcagctttcatatacatactttcttttcttttagagactcagaggcagacatagaa

SEQ ID NO: 657731 - DNA, 137 bp, Homo sapiens
tctaggtgtgaaccactccagtgtcacagagtccgttgtgttggcccgaacttgtgggggcgagggccacaggcgctggtttcctgtgagggctggcagacctgtgtagacacaggttcaggataacacgtggattc

SEQ ID NO: 657732 - DNA, 161 bp, Homo sapiens
  misc_feature (1)..(1): n is a, c, g, or t
ngaggcaggaactgcaaagggacatgcataggataatctggcgtgtaggacaggtgctggttgacgggcccagctgaccctactgagatcggatgtgacatgagcgctgcagactagtcctgggcagtttgttgcccacttttctttggttcttctcacta

SEQ ID NO: 657733 - DNA, 382 bp, Homo sapiens
gaaatagcttgggggtttttaaacaaattttttgttccctacaaggtttaaatattttacttttttccctaaagggttggcccaaaaatgcaaataaattaataaattttggtggtgggtttatctgccggtatatgtttatcatttttttggaattaccttatggaaaaattgaggggaccaaaatttttaccccttgcacttaagtactcctggtttttaacaattttttttatggccccaaggcaacccaaaggttgccaagtaatttaaaattttttcccccttttttaaaattttacctttgtttttccctgccgggtttattttggggttctttaaatttatggccataaatgggttaaaaatttttttcttggga

SEQ ID NO: 657734 - DNA, 141 bp, Homo sapiens
ccatgcttatggagccttacctggtgacagtgcttatgggccagtttggatgatgctctcataagtctccgataatggtggtgaaggtggtgcatgctgggtcttggtgtcagtgactttgaatttggagtagatcccagt

SEQ ID NO: 657735 - DNA, 224 bp, Homo sapiens
  misc_feature (24)..(25): n is a, c, g, or t
  misc_feature (98)..(99): n is a, c, g, or t
  misc_feature (149)..(149): n is a, c, g, or t
ttctgggtgtttcgtgtgggcttnntgccgtgtctgttggtgtgtggcctcggtggtgggggggttgcggggggcggggctccgggcgcgggcctccnngtttttcggcggggcgctctgcgtcgctgggctggggtcggctctgcggnccgtgcgtggccgccccgcgcggcgcgtgctgtggcggtggctgggcggggggtgtgcgctgttcctgggtgttg

SEQ ID NO: 657736 - DNA, 105 bp, Homo sapiens
  misc_feature (10)..(10): n is a, c, g, or t
atagggccgnctactactactatgctgcgaagaagacgacagaatggcgcggcccatttggtcagcttccccgccagggcacctcgttcttccacacctgtcctg

SEQ ID NO: 657737 - DNA, 678 bp, Homo sapiens
tttttttttctagggagaaaggtgcttaattctggggatctgcgtaccaggcgggctggggtggtggattgggaaggggaatccaaggaagcaaaccaaaaagtgtcctagggccagcctaggcctccagcggcccggccgtgtgatgacgcggagtggtggcggatgacgtccgtggagtggcttcagagtgtggtgcccgtggcccccgattgtccggagtgtgcatctgttaggacacaggcaggctcggccacacaccaggcccgtgccacccccgcgtggtggtcctccgtgggaagcgtgtgcaggaacgtgggaattgtgccacgagggagggcaagtgtggtcaccagctataaggggccagaaaacagtgggcgccagaaatccagtatacacatccttccccgtggggtgccgtgggggcgcccacgagtcgacattagacgcgcggggagccaaaaccaggagaagcggctagccaaggggggagaaaactgggggccggggcggaccaagcacaggggtaacagtgtcgccgaaggggagaaccctacaatattctacatagggtcccagggggtatggcccagggaccaagccttaaaccggagatgggcgagggcgggcataaggaagtggcagcctaaagaaggctgggggaacagcacagcc

SEQ ID NO: 657738 - DNA, 365 bp, Homo sapiens
ctcccgggttcacgctattctcctgcctcagcctcctcagtagctgggactacatggcgcccgccaccacgcctgggtaatttttgtatttttagtagagacggggtttcaccgtgttagccaggatggtctcgatctcctgactccatgatccacccgccttggcctcccaaagtgctgggattacaggcgtgagccagcgcacccggccaggggctgacctttaaccgagggtccagaagccacggtcaaaccctgcccgggtgccggtggctcatcatcactatttcagtgggcctccatttttcttcccctctatctcaaacgcttgaaagctagggtaacaagaaccagggaacctttgt

SEQ ID NO: 657739 - DNA, 613 bp, Homo sapiens
taagtagaattatgaataaatagaatactaaaattccaaaatactcaatgggaaatgactagtaagtataggctttcaagagttggtacctttagctatatgcagatctctgggtattaaggaactgagaaaacagcaaagttgactaaatttcatatttcttgtcctctaaatattttgataattatctggcatgtgatgcagtcgatgtctctcgttccttccgtatttataaatgaaacaccttttttagtgtttctaaacctaaaatctacttggtttgaaatcaagtggttggcaacactgtttgactttatttgaagcatgttgtgatcgacaatctcattgacggaagttttcaatcaggtgtgatcagttcgactcctgtaactgagcacaggacctaatattattgacggagctctgttttgaggaaccactgcttaacggtggactatgttccgtaaagcaatatccaatagattcgtctgacttgaggtctgcgtccggcctgttgttagtcaggtccgtcccgacgggttccactacaatgtacgacatggcaacgcggccaacttggcacctcttcatgccacaaccctacaaaaacaag

SEQ ID NO: 657740 - DNA, 1619 bp, Homo sapiens
gggtctttcccttcggtgtgccactgaagatcctggatgtcgccatgggccgacgacacgcccgttgttaccggtattgtaagaacaagacacgatacccaaagatctcgcttcatgccgaggtgatccctgactgccaatgactacgcactatttggacactgtgggacggaaacaacggcaaacacgtggactgacgatattccgctaattgtgagccaccatggatgtcagactgacatactgacgcagatggtcctctgacacaccctggaacgagctggcccgacattaggatgccacaaatacaggtaccaatgagataaccacacagttagtggagacacacagcactaggagtatcccactaaatcccggggaatgcgtgaatacacaagcacccatatacccaccggtcaatcacggacactcaaaaccacagcatgataggtcccatgatagacatgggagcttgactcagagagtccacaacacccagggccaatgcagacacgagatggcacctacggcgacaccagaccccaccaagggaaccaccttgacggagcccacacggaatacacacaaacggagccccaacagcataacaaccacctggtcccacctcaacggacaacacccaagctgtcggcagcaaaccaaaacgggacgagcactaggtgggacatagggaccgcggaccccagatggacgcaccaggggagccccaaagggataaccacaaagtagtcccacatgggggacacgcgacccagacacagacactcccacacacaatacgacacaacaagccaacagacgggagggcacaaaccaacaccaaacacgggatatcaaccaggccatggacaacagcacacactagcatcgtaccacgcacaccattgagatctgggccacagtgaaacaacagacgcggggactcaacacaacaacacacactcgaggccatagcaccgcacgagccaaacaagtaaacaccaataccacaccaaacgtaaataagagaggagaccaccggccaagaggaacaacaccaagcatcggggcaagagaacagaacaagagcaagacaacaaaatagagacaggaggcaaagacaaacaggagacggaaagagccgcagcacacacataaacaaaaaacacgaacacaaataaaacccgatagcaacaaaacacggagacacacaaacaaataacaaaacacaaacccagcaccaagccaaacagtagaacacacaacgtattgacagcacacgcacacgaagaatacaagaaacaagagtaaacaccacaaaataaggaacaagcacacaggaaccacacaagcagccgatagagcaacagcgtgatactagacagacaacacacaaaccaatacaatcaaaccatgggagagacacaagcacaacaaacacgaacgaagcaaagcaagaacagaaaaacataaagccatcacgtgacacggaaaacaaacaagcgacgaccacaacagctagcaccagcaacagacatgaaacaacacagacagccaactagcaacacagagacaaaagagggtgttctacttcggtgttcacacgcagccgtgataaa

SEQ ID NO: 657741 - DNA, 822 bp, Homo sapiens
tgagaggagtctcgctctgtcgcccaggcttgagtgcagtggcgcgatctcggcttcatctgcaagctctgtctcctgggttcatgccattctcctgcttcagcctcccgagtagtcccaggagtagctgggactacaggtgcccaccaccacacccagctaattttttggtatttttagtccgacgatggggtttcaccatgttatccaggatggtttgatctcctgacctcgtgatccgcccgccttggcctcccaaaagtgctgggatcataggcgtgagccaccgcccgggcaaatttcggtatttaagtagagatggggttcaccgtgtggccaggatggtctcaatctgaccttgtgatctgcccacctcggctcccaaagtgctaggatactggcgtgagccaccatcctagccttaatgcatattcttcaatatacaaaggtagatcgtcatgaacactgcttgggggctctaattacctaccttttaacactgacaacctggggcttaacgggcgttccgtatgaatcaggaatgaacccatccgattatggctggacttcctgctatttcataacgggactcttctgaaatacgcgataggcattacagccccagccatctccgtgtcaaccatatatcttgaaccttaccttctgcgggaacttatgccacgtttaacgaccgcggttcggacatgcctcccttgtgcccgcctgactttcattccatgacttccccacgacccccccacgctatcagtttcatccgccctcctctctctccaccctctccgtaaccctcactcacttccc

SEQ ID NO: 657742 - DNA, 329 bp, Homo sapiens
gagctcggtacctgtgtatagcacaataaggaagggtcccaggtggggagaccccaagtagagaacaataatgaacaattattgtatgaacaatgttagagacagctaatcacaaacaacctgcgggcacaatgacctcattccacacgtaacacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 657743 - DNA, 488 bp, Homo sapiens
ggtggagaatacaggtcacagtggtgctctggatcccaagtgactggttgtctaaagcgtgtgcattagaatcgagccactcgcttggtgaagtcacaacagagtgcaggctacagagtatgtaggggatcgtccggctagcgcaatgctatagaaggggggagccagcttactagggccctagaaactctgacaggtgccttagtcgagcgacccccactgtatatgctgcaggacaagaggcagctccgagtgaggactagctacgacagcaaagtgattgaagtaggatcctgaaagtaagattaggagtctttagggtgagtagtgagggtggcacctagattcggacattatgtgtgcaccttggttcgttatgagggaggtggtggtcagatgcaggagcttcggagggtccgtgctggagtcatgagtgacaaggaccacatggtgacaatgcatgatgtgctagatgctcagtggctgta

SEQ ID NO: 657744 - DNA, 249 bp, Homo sapiens
gaggatccccctgtcctttggacgctctgagctgtctttgtctacctatgtatctccatccagtctgggtgtctctctgactctggtttgccacaattctccttgccattttaatagttttagcttccctcacctccaggacacgttacctgctcctagagattcgtttctgctgcccgttgggtgacatgcctgagcttccctctgtctcgttaccgctgtgccttccgtcctcactcctccgtgttt

SEQ ID NO: 657745 - DNA, 116 bp, Homo sapiens
ccttaacatctgtctatcttacctggatctattagagatttcagagggactgtgaacctagaagggaagaaaactgatctgtagctcaaattggtatttccttcaataatggatgt

SEQ ID NO: 657746 - DNA, 153 bp, Homo sapiens
tgaccgtgaccaaaaaacaaaaacaaaaaaccatacacacacacacacacacagcaactcagcatcataagggaatgtagccttccaacaggagatgatgctgttcggtatgttcagtctcagagacagatatttcaactagatgttggcagg

SEQ ID NO: 657747 - DNA, 784 bp, Homo sapiens
ccgaggactgtgcgtgggggtgagtcgcggggagctcggggcgcgcccgacgggtgtctgcggacgacgccccgggggtgcttggcgccatctagccctagggagtccctggtcgacccccgtgtcgcctcttgtcccgttgacccttgtaggacgacggtcatgcctgggccgggcggaggcgtgggtgaggccgaggagtgagtgcctggggccggctcggggtcgtgagtgcggaggaggacgcgctgtgggatgcgaatcgtagggcgttccggcattcggtctggctctgcgccctgatagcccggtccaagtctcacgccgtatctgcgccattgccgggtcatcgaggagcaggagcgaggatggaggtgctgagcacctaccgtttcccgtggcgcgtcaaccgggatcgcgggcgcctgatggacatcttgcgctgccggtggcaagaggggctagtgaggccttcctggaaggccctggagttcgtactagccccgaacacttcacgctgctcactgggccgaggaactcgcgcgctagcgctgcgtccaatgatcctcgatgaggagtgggccgtgagggcctgaccctaattcgttgatgacgagaggtgcgactggcttgctgggaagctctgcaagagccagctgcagcggtgagcagcaactgcagtgcccggggccgggtgctcgaggaggagcgggcagggctggagcagcggctgcagggaccagcagcaggctcaggagcgctgacaaaggctgcgggaggactg

SEQ ID NO: 657748 - DNA, 121 bp, Homo sapiens
actaggtgcatgcatgtaggaagactctcactcttcttcgtcgcgctcccggggtggcagtcagcatgtgttgcatgtgtacctgaagtcgcaccacggaggagcacgaggagaccccgag

SEQ ID NO: 657749 - DNA, 856 bp, Homo sapiens
gcccagatcatgcggtcttagaaatgaaagccaacttcacgttgccagatgttgggagacttcctggatgaggttctgttcatttgagctgcaagcgggaggaagcggacaagctagtgaggcagtacacacgaggaaaggccgcaaggctgggccaccacccatgaaaagcgcatttgacaacacgatggtggatgggtgcgctatacccggggaccagcgagagggctggttgcgtcgcgcttcccaggagcctaatgaaaaagcgaggacccccatggaaagggcgaaacacgatgagacgggcatccccatcccagcacacaaagtgacactaccccctcatgaaggtgggcctatcaccttcacacacttcccataagcggaccaagcgaaacattcattataatacgtgcggattcaaaaactagagcaaagcaaactgaggcaattaatattattatcgttgatttatgatcaccccctaaccagttaccccccagagacacatatccacaaacattcacgatggatgccgtttcccttacacatttcgttttacccgtaatatttaagaccctagaatattaaaagttccaacaatagcacagtcggccagttagtggacttcgatttaacaagggtggaagggggcattagcaaaaggataggaaaccggttggacagagggtggaatagaaaaagttacaccaccggtaagcgcattggatatatccaactccatctcagtttacacgccaaaagaagccccgtatgagagaatgaccgagaatggagcagagacacatattacaatggggacatatattaaccagccaaaaggtaacaggagcca

SEQ ID NO: 657750 - DNA, 257 bp, Homo sapiens
  misc_feature (38)..(38): n is a, c, g, or t
  misc_feature (230)..(230): n is a, c, g, or t
ggtggaacctggtaggaggtgattggattaaggttggnagtttcccccatgctgtttctcatgaatagtgagtgagttctcatgagatctgatggcttcaaagtgtttggcagttccccatttgcttgctctctctcttgccaccacgtaagctgtgcattgcttctcctttgccttccaccataattgtaagtttcttgtggcctccccagtcatgtgaaattgtgagncaattaaacctcttttgtttgtaaatt

SEQ ID NO: 657751 - DNA, 216 bp, Homo sapiens
ggggtgttgaattgctgccagtagaggtcgtgctgtgcggctggagcggtggagtgtgcccctgctgtagtgctctgctgttgcccctgcagcacacccaggagcacctgtcaggtccaaggtcagcttctcatgtttgcaggtcctgaagagaacgttgagcagctccagtggaggacagtgcctgctgatgctgcgccttggtctgcgcctccg

SEQ ID NO: 657752 - DNA, 511 bp, Homo sapiens
gggcagggcccactgagcccatggacacgagtgaggccactgtttgccactcagacttggagacggacaccaccccatgacatgcacaggtcgccccgacaagggaccggtggccccgtagaagccggcccactgagcatgtcccatggaggagctgagcatcagtgcccggggacatgcacgggccgaggcggtcatgcaccgaaagggacgggagtcggatgacagacgaagtgcgcaacatctgcagcaagtcgaaacaggacgagcaaagcagagcgagcaacgcgccggcctggcaggcacaagccgcaggacaagacaacgcgacagcaacgccaagaccgcccaggaacaccacaaacccaccaccaatcacccagcaaccccagcagcgagaccccctccagcccagcaagtccaacatcccctacatgccacgcaggcgaccgacaaccacaacacacgcacacgcgaccgcccatccacggacccgcccggacaccacaac

SEQ ID NO: 657753 - DNA, 923 bp, Homo sapiens
  misc_feature (574)..(574): n is a, c, g, or t
gattgacgctccggttgcacgcggcgtgggtgccctgcgtggcgcccctcgttggctccttgcgtgcattggaggaatccagtcgagtggtcgttccgccgcgagggttttctgggcacggtggtcagtcgcggtagaccgggcgggtacgacggcgctgttggggatctgaagggcccagtggggtcagcgtaagggaccagtcggtgatagcgtacgccagggaaggggaccataaaggtcaccgaaagcgcaataaaaagtggaatgttagtggagatagccccccgaatctgagccacaagaccgctatagtgagctcccgctgtatgcggtcagaagagagacgactccgcaacagaggattcgaaagctccccatgaagtgagagcacgcactcatagatcatcaattgtccatcgctcgtgtcaccataactgtcacagtcgcacaactcgatagctagcaatcttgatctgcatttctactttctctccgtcgcgttggcgacccacttcatatcctcgcaagagcgttgaatgccagtcgatctttctgcaaagtcaatttaaantgccccagcttgtccacagaaagacccagtaaacccctgctgcccctggtcacgaagctggcgcacccagaggcgttctcaaagagccacattatagtttgcgtgcatcacggtgggcacgtcacgcaattggcgcctcgcactggtccggggctcctcggaggtggtttaccttttttgcttccccacatgcgtaatgcgtttcgcccactcatgcccagatccccgatgggagcggcccccatcgcattccctttcgggccgtaaagctgtcttgcccgatccgggtcccccctgttggctcgcaaggtgcataccttggggcggaggagacgatagcatccgtgca

SEQ ID NO: 657754 - DNA, 250 bp, Homo sapiens
cgagtttaagcgtgcagaagaactatgagtgcgtggtggggtgaaggggcggcagaacgggggtgcctgcggtgcggttacaacagcagcagtgtgcagtgccaagaaggcctcgtactcctatgaaggtgatgagcatggtgacaccgagctggacttttccgtggtctgggatggagacttccccatagacaagcctcccagcttccgagccctcctgtacaagtgctgggcgcagtgcgccagtttg

SEQ ID NO: 657755 - DNA, 438 bp, Homo sapiens
  misc_feature (51)..(51): n is a, c, g, or t
  misc_feature (98)..(98): n is a, c, g, or t
  misc_feature (100)..(101): n is a, c, g, or t
  misc_feature (210)..(210): n is a, c, g, or t
  misc_feature (295)..(295): n is a, c, g, or t
  misc_feature (304)..(304): n is a, c, g, or t
  misc_feature (307)..(307): n is a, c, g, or t
  misc_feature (314)..(314): n is a, c, g, or t
  misc_feature (316)..(316): n is a, c, g, or t
  misc_feature (418)..(418): n is a, c, g, or t
tttctggagctccctccattctattcctgtggggcaggaacatgccagggntgctggtaaatggcaggggtcacctttaccagggcgcaggcatagtntnncccctgcctgccctggggccaccctggaacagtaagaccctctgggaagggaagaaaccagacccagccataagctttctccccttctccctcaaatcgccccttcctnctccccaaaatcaggctatggcaaaagggctggcaacaagggaatggaggttttggaggggaaggccagccattctatagtcaanttagaaaantangatggananagccccatccatccccattttccttcctctgcctccgaggggctgcttctggatttcactttttttttgtgacccttttatgtttgcaggaggcgggcaaangggcaccagacagggaacat

SEQ ID NO: 657756 - DNA, 303 bp, Homo sapiens
  misc_feature (52)..(52): n is a, c, g, or t
  misc_feature (95)..(95): n is a, c, g, or t
  misc_feature (131)..(131): n is a, c, g, or t
  misc_feature (160)..(160): n is a, c, g, or t
  misc_feature (163)..(163): n is a, c, g, or t
  misc_feature (212)..(212): n is a, c, g, or t
  misc_feature (215)..(215): n is a, c, g, or t
actaaagaggatgactaaacttgtcagttgaacaaacgggaagattccgagncagaccaactcagcccccacagccactcccacagcaccttcgnccctacaggccacagctggaccatcttatccccggnctgtgatcccaccagtatcaactcctggncancccaatgcagtgggcacattcactgaaattcctgccagcaataattcgnagngtcattgccatgagattaactgaatctaaaaagtacttgtacctgatgcatatgctacttgctgttctgtgaccttggtgctgttttt

SEQ ID NO: 657757 - DNA, 387 bp, Homo sapiens
gttagacggtggaatatcatgaggttgatctggacactatacagagaaatatgatggcactacagataaaggcaggagaaaagtcaaaattcattcagttcctcacagatccctgtgtccaccatatatatgaaacacaagaattcaaagcaataataccaacgggtttggaaagctttatcctacaacacatggttgcatgacttcacctgaaaaataacaagaattaatatctgtggagcattaagcacatgcccagatactgcactgaacactttacacaagtgattacatgtacacaactctactgcattaaagcacttcaatctcatctccattagtaaaactgaggtacagagaatgtataaaagttggttaagttgcagc

SEQ ID NO: 657758 - DNA, 721 bp, Homo sapiens
tacgaccacagtgacatggagctttacatcttaactttctttgtcactttaaatgcgaatgtataaaaggtttagttgccgctattgtgaaaaactagatgtcaaggaaatcacctacttgcatgcagggtgatataatcttgaaaagggaaaagatggcttccattgttgaagcccagattttctgtagtaggaagctttcaaattatgtaatgtttaaaacgaaatatgtatataaatcatctctatacttctgtgggaatgagtactaaagttctctggggtctaggaccagtacctttatataaagggtataagagaccatgacgatgtctgaaatgtggaatagataatgatgccttgtatattgaaagtgggccacataatagtacgatgggtacctccagtcgtctgccgaaatgtatttccataatgtgttgaaattacactgctaagcattgtatgattttaatacttctgccgaatagagtagaatcagatgaatgtctgtgtgtctgtgcaaaagagtggggacaagttgggcaggcctatgaagtgcatagggagtgtatgtctgctgaaatggtttgatgtgttctagtaattctagctttaagaaatgttaactgggagggtgcttggggacaatcacctgcattaatttgcgagtggttaagagttcttgttgtcaaaaagaaaacttatgaataaattattgtgc

SEQ ID NO: 657759 - DNA, 397 bp, Homo sapiens
  misc_feature (292)..(292): n is a, c, g, or t
  misc_feature (345)..(345): n is a, c, g, or t
  misc_feature (363)..(363): n is a, c, g, or t
cccaccctctccccatctgctcggggaatttttgtttttgtttagttttaggtttacaacaaagaggaattaatttatcaccagcctaaaactgttgtgttttttttatggtttaaaaaacgccatgtcattgataaccccctttctcccttcccttttcccggtttgctgatccctttttcaagcctgtgtatccagggtgctttgtttcccccccgttcccaggtgtacaaggcaaagggccgggacagctttcctttcagtcattgttccccccccttgaaaattcagncaaaaaaactttgcttaaaaaatttcatgtgtgggaaccccagttcctggctncctttttcctgggtatgngtaaattccttaataaatattgcagggaaggcca

SEQ ID NO: 657760 - DNA, 205 bp, Homo sapiens
ctgcccagatcaaggctgcccacagatgggtcactatgctgataagtttgccaacaatacaagtgtggagccacagaagttcttcctgaacacaggagaagccaagaactttgcacgctggaggtaccgtgtttccttgacattctctggaaggacggtcacaggccaagtcaaagtgtctctgtttggaagtaacggcaatact

SEQ ID NO: 657761 - DNA, 403 bp, Homo sapiens
  misc_feature (22)..(22): n is a, c, g, or t
  misc_feature (34)..(34): n is a, c, g, or t
  misc_feature (83)..(83): n is a, c, g, or t
  misc_feature (100)..(100): n is a, c, g, or t
  misc_feature (112)..(112): n is a, c, g, or t
  misc_feature (367)..(367): n is a, c, g, or t
atttgggatttaatcacctcantcctgaagcaantgcctgatttgggttggccttggtggttcctcaaactgactgaaggttnggacctcactctgggancttttaaaaaanattcccatggccgggcttggtggctcatgcctgtaatcccagcactttgggtggcagaggctggcggatcacttgaggtcaggagttcaagaccagcctggccaacatggtgaaaccccatctctactaaaaatacaaaaaaattagccaggcactgtggcacatgcctgtaatcccagctactctggaggctgagacaggagaatcacccgaactcagaaggcggaggttgtagtgagcccagatcacaccacntgcactccacctggacggcggagtgagactcagtat

SEQ ID NO: 657762 - DNA, 246 bp, Homo sapiens
  misc_feature (14)..(14): n is a, c, g, or t
  misc_feature (111)..(111): n is a, c, g, or t
tggcatctgaatcngccaatcttcattcacaccaaagtcctcagatcggtcacccttagcaagagaaagcaaagcgttccgaaaatctccagatgtgtctgaggttatgtncttgggccagatctctcttcagttcctctctgtagacccggttaatgtctctgattgcttggttagttctggatgccaaaatctcaattagagtatcttcatcagttccacgcccctgaagggagcccaaagggt

SEQ ID NO: 657763 - DNA, 148 bp, Homo sapiens
tcccttacttgaaaagtgggggaagggggtgctctatccattaccgtggtaaggaaagcaggtactcaggatcccgcctctacccgtgctccccactttccctgccttaatacttatacagcagttccctgtaactccccactactgg

SEQ ID NO: 657764 - DNA, 265 bp, Homo sapiens
ctctagatatcccccccgtacgcccaatgtgacttcttaaaagttttattaaaggggaggggcatatattggcaattagttggcagtggcctgttagcggggttatttttgaagtgggtccagccaattgtttagtttatgattgcagataaactcatgccagagaacttaaagtcttagaatggaaaaagtaaagaaatatcaacttccaagtttgcaagtaactcccaatgatttagtttttttccccccagattgaattgtt

SEQ ID NO: 657765 - DNA, 359 bp, Homo sapiens
tctgcaggatccccctcttactttgctgtttagccaggcacggtgacacatgcttatgtcccagctactgggtgcagcctcgaactcctgtgtctcaagccatcttcccacctcagtcctcattgcttgtagtgaactttgttatgcagtgtctcctattctacttctgcaggagtatttttccatgtatgtaccttgagtggaattgcttggtcattgggcatgtgtgtgttcagctctattgagtggcatcatactgttctccaaggcagttgtaccaatctacaccctcaccagcagtgaatagtcttcccattgttcttcctcaatgaaactagatattcacagccatttaggta

SEQ ID NO: 657766 - DNA, 409 bp, Homo sapiens
  misc_feature (42)..(42): n is a, c, g, or t
  misc_feature (400)..(400): n is a, c, g, or t
  misc_feature (406)..(406): n is a, c, g, or t
aaagttgttgacttcgtctgtatactcctttgatgaaaaatngacttttccatcaaactaccaagccaatatgctgtattgttttatttctttgttctttttttcttgttgtgttagtcaattttgtgctgctataacagaatacctgatgctggataatttataatcaacagaaatgtatttggttcatggttctggaggctgagaagtccaaaatcaaagagcagcatctagtgagtgccttctcgctatgtcatctcatggcagaaaggcagaaggtcaaaagagcatgcatgcagggagaggaaagggggcccaactcatcctcttctcagggagttcacttcctcaaaaactaacccactcctgaggatgggtagccattcatgagggacagttntcatgnacc

SEQ ID NO: 657767 - DNA, 230 bp, Homo sapiens
cctttgaagttttccattttcaaaagttttgaggcagacccaactcctgactttgaaaatgtcaaagggtttttgaggtagtcgaaaaattattttataagctttattattgaataaatattaaattaggagccccaagccaaagttatgtaattaaaacccatcaccaactttgggcaagtttttaaatttttttttcaatttccttgttgttgggaaaaggcccccca

SEQ ID NO: 657768 - DNA, 250 bp, Homo sapiens
aagacgggcattacagggaccaaaagtctgaaaggtgacttttattaccaacacactggctggaaaagggacaaaccaccatcacgggggagtaatacttttcagtttttcccacccacccaaaaaaggaaatgggggcgggggcatattttttttttcatttaaaactggaaaaatattgaagagcatccatgttcacttatggctggttttgctatagaaattggaaaataaaggccacttttttgaa

SEQ ID NO: 657769 - DNA, 214 bp, Homo sapiens
ggagggtcctgggaagtctgagggctgagtggggaggcagaggtccagcaacattgtcaatggcaggcagcgcaggaggggcgatgcgtgggcgagtccatgagtccagtgaggcggcgcgactcaacttgagggcggtagacgaaccttgcgctgcaattgcgatgcttggatctcgctttcgcggaagaatgaggctgaagccaccttgtgg

SEQ ID NO: 657770 - DNA, 152 bp, Homo sapiens
gtgacagtcctttctagagctctgtacactgggggtgtgacctactttggacagagtctccacgggagaggtccttgatgcaggtcagccctcagtgacagaacagctccactgctgtcaacatgcacgcgacatcgcatggtacgagctcg

SEQ ID NO: 657771 - DNA, 247 bp, Homo sapiens
  misc_feature (2)..(2): n is a, c, g, or t
ancccacacctgcacgtagtccacacctgcaccgggtcaaagtatttagctagactcgcacactccacggaagcgatatgaaatgatctgctgcagtgtctagagccctaggattcatctttcttttcaccgtagtcggctgactggcattgtattagcaaactcatacatgagacatcgtaactacacgacacgtactatgtagtagctcacttccactatgtcctatcaagtaggagctgtattt

SEQ ID NO: 657772 - DNA, 1664 bp, Homo sapiens
  misc_feature (76)..(76): n is a, c, g, or t
  misc_feature (1139)..(1139): n is a, c, g, or t
ttgcgcctccgcgcgatgtggttgtgtgtcgcgctgatgttgctcgttgctttgtggttgtctgtctcttgggcgnggggtgtttagtatacaaccgcgtgcgctggtgcatcacatgtttgtgtgccccgccacttaaataaatggcccgtgctgttgtagtagaatgttcttcgtcccgtgttccttgtggcaccctcgttgggggaggaaacaccgtatgggggttttgtgcaccgcatctttgcggtggggggtgccgccccctggtgtatgtttggcgttgttgtggggcgtgcccccgcggacagtccgccccaagggtgtggggcgcgcagcgttgtagatgtatggcgtgtcggcgctatccttgtttgagagattggtgtctccgcccacggtaaagtcctttggggtttccttcccccagggagttcgccccctttgtgtaggagcccctatgccccaccggggttctctgtgtgaagaaaacccacccgccatgtggtgtatgtatttatatgtgggcgcccactatccagctcgcgcctaaagtgtcgccccccaaagactgtttattgaatataattttggtgttaatggaaaagagggttaatcgtctcgggggtttaatagatatggttgctacccctcatataatataataacgggagtacagcgggggaaaatgtggtgagtatttgttgccgcacatgttgctgagaaaacagagtgttcttttggggagaagagaggggcgggaaattatcccacagggcctgatttttagaaagggtttcaccgtattaaagttgtttttcctaaagacagataatagggtgccgcacctcatgtgccccgcactgtctcgcacaggcttcatcaacagggggagaggtggtgtttcaccggccacagtgatatgtagtgtgctccccgcggtctgtgcacagttctcgcgcgctctgcccccagagtctctcttagactctctgtgtgagaggaagagtttctgtgtgtcccgacactggtgctggtctgcacagagtgtgggaataccccctctgccgccgcgcctttggccccgacaggactgcgtgctgaaacgctcgtcgctgctcgtcgacagctctcacgangcgtgtcgctctgtttccgcccctgcggagtgctcacagagagagaaatagggcgagtctcacaaagaggggtctctttgtggtagaggggcggggagataaagagagagaccacacggcctctcggtgcgcctcatagagacctctccacgagataacgctgtctgtgtcctatattgtcccgcaccctgcttttctgtatacttcccacacaaaaaggagaatgagaccacacccccctcgagactctctgtgagagtggtgtgtaatatctgcgcaccacatccacgtggtttgagagtcacgttccccacagagaggaagaaggggggaaccctccctcccactcttttttgcacacactctcactttcttccctttgctgttgcttcccccctcaccaccacacttggttttgttctatcctcacactttgagagtttctattttatgttgaaacttgctgctttttttcatattgaaaagatgaccttgcccccagagcccaaaataaatgggaattga

SEQ ID NO: 657773 - DNA, 554 bp, Homo sapiens
acacattggagcccaacactgttgctgatgaaaggcgccccagaaaggatcctagcacgttgcagatctatcctcctccacggacaaggagcagacccctggttagaggagctgaaagacgcctttcagcaacgcctcattttgagctaggggggactcgagagaacgagtcctaggtttctgccacctctttctgccagatgaacagtttcctgaagggttccagtttgacactgacgatgtgaatttccctatcgctaatctgtgcttatgttgggctcatctccatgattgaacctccacgggcggacgtacctgatgccgtgagcaaatgtcgaagtgctggaattaagtgtcatcatggtcacaggagaccatccaatcacagctaaagctattgccaaaggtgttgggagataacatccccaacaccactcagaaatagcttcctcttgggtcatataatcaaagagatacggggaagaaccatccaattacaaaatatcttctcactcattgtaaccttgtggagacatctatcctcacaccctaca

SEQ ID NO: 657774 - DNA, 359 bp, Homo sapiens
tctttttgtctttttgttaatgttttgcgcttgcctaccatagacacactccaatcattctaatcttataacaagtatagcacagacgcacggataaaacaaaagacaccttaacagcgccttaatactttcttaactattcaatttcataggttgctagaagtttctcgttgtcaaactccacatttgtagtgtttccttgctactgtatacccattggcgtgttcgtatggatcattaggcttactgttccaattggtgcatacagcggcgtcagtgtctgccagcttttctgtatgatactggcactggcggcatcggtatttaggcggtggcaatatcactaactcattggcaac

SEQ ID NO: 657775 - DNA, 1323 bp, Homo sapiens
  misc_feature (393)..(393): n is a, c, g, or t
aaagatcagagcctcctaagaaatatccaagaaggtcaagccatggatccacctgcacataaaaaaaaaaaaaaaaaaaaaaaaaaaattttttggcgcgcgcgccttcgggcccttgaaaaagttttttaaaccatttcggtttgggcgcgcgcgcgggcgcccattgggtaaggtgagaaattggggcaataggtggctgcctagagggacaactcggggggcgatgacaaaaggtgggtgggaacttctcccaccaaattaaaaaaagcccgggggcggacaaaccggaagaggttttgtgaactataatctccgacaagggcgattctcgcgaagggctccaatacagggaggactcctacacaacacacaggggggagctccaagagngagagcgcgcccgagaaatattcaaaatatattagagcgcccccgggctcgggggggtagacaagacaagaaagaaaggaaacaagataagacgagcagaagaacgatacgtagaaggaggagaaagaagaaacaggaagcacgaaaggacgaagtcacgaacaacaaaagaacaacaagaagaacaggagcagcaacagcatacagacgaagacgaccagccaagaacaagcagaagaagaaacaacgaaccagagagaagagagaggagaggcgaagggcaagaagaagggagagaaagaagaacaaggagagaagacaagagggagagagagaacgcgggcagagaaaggagaggagcaagaaggaggaggaaagcgagagaaggaggagggacgcagggaggaggagcagagggaggaaagagaggagacagaagacagagcagacagaggagatgagggaagacgcgagaggagaagaagagaagaaaagggagaaaagagagcggcggagacgaggggagaggagaaaagaggagcgaaagaacgcgagaagacacggacagacgaaagaggagagagaaggagagaggagaagaaagagacagaaagaagcaaagagacagagaggaagagagagaggcaaagaggaagagggaggagacaaggaagagagcgaaagagaagcgagaagcgaagcgagagaacgagagtgagaaaggagaagaagggagggaagaacagagagaaagagcagaaggagaaggagaagagacgagaaggaggggagggagagaagaatgggagagagaaggaaaggagaggaggcggagaacgaagcgaggaaggcggaagaagaacgagagaaggagaaaaggggagcgagaggaaagaggcaaggagaagggcaggagaaggaggaagagaa

SEQ ID NO: 657776 - DNA, 180 bp, Homo sapiens
  misc_feature (68)..(68): n is a, c, g, or t
gtggagaactctaatacaaagacatttgaagattgagagaatgcacaagatggcccccgcagccattngtactagccatctcattttatatcacatctaagtatgccttgaatttttttagttttatgtacctggccttattgtgctcttatcagtatgacttctgggtttttggaaatg

SEQ ID NO: 657777 - DNA, 1566 bp, Homo sapiens
agcggacttccagtcacgtgactacgcaggagctggctggcctgctggctcaaactggatcctgctgcctgctccagaagataaatgcctggcaaacgtaagcaacggggcaggatacatataaagcctgtgacaatgtccgacctatcctgcgatcccgatgtgagcttggaagacaataatggtaggagcagaagagcacgggcagagacgaagcgaccgagagaagaggagccaggcagaaccccatccacacaatccaaatcgacgcccaaaacccggaccgggacggagtgaaccgagtaagatcgccaccggaagaccacgcggaagacccgaaggacacccccacagacaaaggaaaaacgtaaggaaggactcatcaccgggcccaatacaaagaacaaacgagcgagcccataagggagccaagtaggaggaagctatccagtccaaccggcaaagaagcaaccaaccagtagaaagacgcaatgggcggaccaaccgagccgaacaaaaacagaccaaaaacgggaagaaaaccgagaaaccaccggaaaacaagacccaaaacgcaggaaagagagcacacacagcacccaaaacgccgggccccaaaatacaggcacgcactaccacccaaaaaccataccccggcacagggaacacccccaaggacgaaacagagaacacagaaaggcgaacgcgactccgaaaacagaggagacaacccacgggcaaaggcccgcataaaaaagaacacacaaagaaaacacccaaaacggaggacaccacaagaaaaccaaagacacagaatcccaagagagcggcatacgagaacacaagaaggaaagcaagagcaacagcgcccaaaccagagaaaaaaacaatccacaaggacacacaaaaccgggaaaagcaccgcgcggacagacgaacagggcaacgggaagagaaacaacaaagagaacaataccgcaccccgatggcagcccggaaagagcgaaaagaacacaggagacaaaagagcagacgacacacacaaacagaatcgacgcgccaaaacacagccacgagatgaggcacacgagaccaccaagaggcacaaagaaaacgaaaggaacacaaaccagaaaaacacacagaaacaagcagagggcaaacaaggaaaaaagtcgaagcaggcacagcatagaacagaaacaccccaggacacacaagaaacgcagaagaggagcacccgccgagtggcgagaataccaacgcacaaataagacacaccccggggaaacgcaaacaaaccaagggggccccagacaggaagaccaccgcgcgcgacacaagtacacacggaggagaccgaacaaccaagcaacacgcgccacacacaagacgaacaagagacaccatagtaaacaaagaccacacaagggacaccccccaccaacaagtggagacacccaaccagacaaaagaggaaacaagcgagccaaacaacgacacggcaccacatgggagacacagacccaatgggcgagcgcgcaaccacaaccgacaaacacgccc

SEQ ID NO: 657778 - DNA, 112 bp, Homo sapiens
tagccaaagcgtagtacccaaatatatgtataggcagatagaaattgaaaactggctgcaatagatatatgtacctgcaaggtgaaagatgaaaaattataacgcaagcata

SEQ ID NO: 657779 - DNA, 1026 bp, Homo sapiens
  misc_feature (523)..(523): n is a, c, g, or t
taattttggggggggactatttccaaaccctaaataaaaaatttccccccaaaaaagcgggaaaaaaaaaaacaaaattttcggaatttaattttttatttgttgttggtccttcatttgggggacaattatttgtaggagaatgtacaatattattatattaatatatataacactcattagtggttatatgataatgtgttgtcatgtgtcataaaaagtattatgtgtgcgcacttattattttatatggctatatatattttctctaaagtgttaaatatattgcggtccatgtcgtggataaaaaatatttagtaaaaaagaaaatatatattattcttataaatttatatttcaacacatttatgatgcgtcgccatcccccatatgtggtgaaatgtgtgttccctaacacaactgtgggtgggagaaattacatccgtcggtctataattcacccttcttatgtgggggcgctgttccaacaaacgcgccgtcttatatgtgtttgtgcgtctanaaatatttccctctaatacaacgtggtggcgagcaaaggagaagatatgtgtcctcgtgtgttataatgacgactctctgcggcgtgagttgttcctccccagacaaaagaagggcggacaacaaacacatgctgtgctctccacacctatgtatgatcatccataccaaatgtaggctgctccactttctaccacctactctattcgtgatgtcttgtatatacaaacctctttgatagcgggtgtctttttcaaccgacaagagttggccacgggctcctagcgtccgacagacagttctttttgcggtccggaaaaacagattattctcagcaccattggtgcgcgccacacaatcatagcgggcgggggcgaaacacaatcctcctccgtggcgtaggaagcaacaccgcgggctacgaagaaaaaatcaagggtcctattcttttctttgttggcccccccccaaatataaattctttttgtttggctgttctgctac

SEQ ID NO: 657780 - DNA, 171 bp, Homo sapiens
aagacacaccattacacaccacactccacatagcgcacaccacactccccgatgacacacctcacacccaccacatccataccatacacacacacctcacacacacacacacacacacacacacacacacacacacacacaaagggcgtggatcatttctcccactcgagc

SEQ ID NO: 657781 - DNA, 704 bp, Homo sapiens
  misc_feature (205)..(205): n is a, c, g, or t
  misc_feature (254)..(256): n is a, c, g, or t
  misc_feature (293)..(296): n is a, c, g, or t
  misc_feature (298)..(298): n is a, c, g, or t
  misc_feature (349)..(349): n is a, c, g, or t
  misc_feature (362)..(362): n is a, c, g, or t
  misc_feature (364)..(365): n is a, c, g, or t
  misc_feature (370)..(370): n is a, c, g, or t
  misc_feature (373)..(373): n is a, c, g, or t
  misc_feature (381)..(381): n is a, c, g, or t
  misc_feature (423)..(425): n is a, c, g, or t
  misc_feature (458)..(458): n is a, c, g, or t
  misc_feature (475)..(475): n is a, c, g, or t
  misc_feature (500)..(500): n is a, c, g, or t
  misc_feature (677)..(677): n is a, c, g, or t
gatattcacatcaagtacatagaactttttttgccttttatataatacagtttttaaataactttacacagaaataaatttcttcaatctgaatttcagctatctttttttattctccatgctttctatccaaactgaacaatattttctgttatacaaatttacatgagaaaaactccaaagtacaaatgaagggccctgagcnggaaagagaacccaagtatcaggaagtgggtatgggggagaattaaaannnataataaaagattcaagcgaacattgagaataggggnnnngngggggccctcctccctttggctggcaataaatgtcttttttatgaattganaaataagctttancnntagtnacnccattgtnatttttgcgaagcggggatggggggggcggggggcaattacnnngtccccatcttttcactgggcgcgccccaggcnccacggggcccttttcnatgcgtgagtgggctggagtgtacnaaacccgcgacctttggcggtggccggcgagagggatgtgggtgtgggtgcgccagaagggttggggtggtgaaacaggaaccgtgaattcactgcagttcaaacaggaagcatctccctttcctctcccttacaggagtcatgtcctcaaaccaaggaatacatgaaaaggggggntttcctttttcttggtctaaaccaaag

SEQ ID NO: 657782 - DNA, 239 bp, Homo sapiens
ctgagcagctaaggaaaagcaacactgggaaatctatcttacctagagcttaaagcaattgtatgttttcacatttctcatttcagctgtccagtaccttgccgggtatccaatgaagctccttttactacggatagagctagtttcctttctctgtttcagcagtcgtgaaagatacagagaagtaacatatcgtgggagatgtatttgcagaaaagcttcagttggcccttatcgag

SEQ ID NO: 657783 - DNA, 169 bp, Homo sapiens
aaccactactgccatctgatctataaagtgcggtggcatcgacaaagaaccattgaaaaatttgagaaggagggcgctgagatgggaaagggctccttccagtatgcctgggtcctggttaacttgaaagctgagcgtgaacgtggtatcaccattgattattttcttg

SEQ ID NO: 657784 - DNA, 105 bp, Homo sapiens
agcccgcatgctggtggttgagcccatctgtcccagctcctttcccacccaccttcgtatgcacccagcatttttctgttcccatctgtcctatttgttcttcat

SEQ ID NO: 657785 - DNA, 276 bp, Homo sapiens
tgttgtaccgttgttgccatttggactctcatagtcacttgcagcaagtagaggggcatcagctcgcattcaggatgccctgcattacagtgttgcaattatgcagaggatgtactgtctggaaaggtgtcagctcacaatactgtgggccgcttcctgtatcagcctggttaaccaagtacctgataatagttcccgatcactttcataccattctcaacagcaacactcatcaccttttgatggttacctacatagtcactacgtacaacacgt

SEQ ID NO: 657786 - DNA, 349 bp, Homo sapiens
caccttcatgaacaatggatggggtgacgggagattgaggctcctgtgtccagtggggatagatccaagcactgcggagtgattgccttggactgggaagaagggaagcctttgaaagaggattagaataggacagcttgggcctgggaggggctgcacattccaggactttccatcaagagtttctgttttttcaagaaagtggaaggtgaggtcatcttctgagtgtgtgggggagggaggagtactattttccttgctaagtgctagaaactgggctaagcactttacctgataaacctcatttgataccttgagaatctcacgaggcatgtgcttcatgttggtt

SEQ ID NO: 657787 - DNA, 297 bp, Homo sapiens
ggtaagaggatatggtgagtagtgtcaggtgggtcaggtggaggctgtaggaggagatgttatcagagggtaaatggaaagggaaaacaatttcaaatgtggtcatggtgagcagtaacatcttgggcaacagatcttgaccagggatcattttgcacccgatgggatatttgacaatatctggagacacgctggtggggaataggtgctagtggtactactgggtagaggccaggaatattagtaaatctcctacagtgcaaaggacagctctgcagaacaaagaattacccagtc

SEQ ID NO: 657788 - DNA, 126 bp, Homo sapiens
tgcagacggcggagtcggagaccaaaaggatccacaaagcaagactccagtctcctgttagaattccattcctccaacccccactgtccttgttattcctaccatccccagtattcctatttccaa

SEQ ID NO: 657789 - DNA, 670 bp, Homo sapiens
atgtgagggcgatctgctgcgattctgtcaccccattgatcgccaggttgatcggctgatctgctggctaggcggttgtccccttcctccctcaccgtccatgtgcgtccctccctgaagcttgcgctgctctgtccgaagatggactgaccatcccgggatagaggacggacccgctcttcggccagggggtatacgatgtagctggtgctccctttgtaagaactccaaaaaaaggctctcaagtgtccatttgtgtacggaagacccgtaggggtagtcaaagcttccaaagattccagaacttccaaatttgagggggcttgatttgttgccagttcttggccttttctcctaactacgaacagaacacgaacatgtagaccacacaacaaaacgtgttgtgggcggccagccgacccagggaaaaaagttttagaagaccacacattggctgtgtggcgcgcgagcggcccgccagatagtgtaaggatgacacacttgtggcccaaaccgtgtgcgccccagaagaacaaccccgtgggtcgtgcgcagttgttggctgtgtcttcctcccaccaaaaagagacgccgcgggcggcgacagcggacgtgttttgggaaccaacccccaagggcgttgggggcagcagcggctcccaaacagagg

SEQ ID NO: 657790 - DNA, 442 bp, Homo sapiens
  misc_feature (419)..(419): n is a, c, g, or t
  misc_feature (427)..(427): n is a, c, g, or t
tgctaaagcaacatgcattacatgatgtatttttcgagtcacaaagcaaaacctgcctgtgataaatagagtgtatggaccaaatatgcgcttagcggcggccggcacctgggacgtgacggcccttacgctcaggcatttgctgcgacgtcacaggagctgtaacagtcactggaaggttgtcaaagccaagactgtgaatcatctcctccgtgtcggggtcaatctcaagaggagcaaccgacgggtcaagagccgacacctctggaacatattggtccttgcgctcgcgctcttcttcttgaagcttgaacgagatgccacgaacagggccacgctggatacgcctcatcaagtgtgtcgtgaaaccagcgatcttgttgcgcagacgctttgaagggacaatggccacctcatcnatcacctncttgttggtgtggaa

SEQ ID NO: 657791 - DNA, 591 bp, Homo sapiens
  misc_feature (105)..(105): n is a, c, g, or t
caattaaatactggcgtgggggcgaccataattacccccatactccttacactagtgcttatcacccaactaaaaatgttaatcacacactaccacctaccttcntcgacaaagggcataaaaataaaaaattgcaacaaaccctgagaaccaaaatgaacggtttttttggtgtggtgaatcattgcccccacaatcctaggacgtacccgcggagttctaatcattctattcccccttatattgatccccacctgcaaatatcttattaacaatcgactaatcaccaccgaacaatgcttaatcaatactcctttatcatccctaaacattccaatgggcacaacctacctccttgcacctgagcctaagacagttacaccctctcccatctttgtactattcttacccaggcttcatcagatattattgagttgcagaggtcttatgtcccccacttctagtctagatggacctaatacacttcactccactcgtctcttcctcgctccttaaactcgactagtataatggatttctttgtgtctacctttaatataattgtcttgacgctagtccattcaaatataa

SEQ ID NO: 657792 - DNA, 379 bp, Homo sapiens
  misc_feature (4)..(4): n is a, c, g, or t
  misc_feature (17)..(17): n is a, c, g, or t
  misc_feature (74)..(74): n is a, c, g, or t
  misc_feature (134)..(134): n is a, c, g, or t
taanaacgtggtggttnaaagcatctccttatgtgaaaactccgtcctaagcatgacatactcccttgcagttncctagtgatagaaaactcactataccggctgggcatggtggctcatgcctgtaatcccancgctttgggaggccgaggcaggtggatcacatgaggtcggcagttcgagaccagcctggccagcatggtgaagccctgtctttactaaaaatacaaaaagttggctgggcgtggtggcaggtgcctgtggtcccagctgctcgggaggctgaggccggagagtcgtttgagcccacgagtcggaggttgtagtgagccgggatcgtgccattgcgctctagcctggggaacaagagtgaaacaac

SEQ ID NO: 657793 - DNA, 132 bp, Homo sapiens
cccctcaagggggcttggaacccggggttggggtcatgctgcctccgtggctccaaggtgagggtctttttcacgagcaaagagaaccaataaagtgacaaggaaggtttggggtttccagccctcccccca

SEQ ID NO: 657794 - DNA, 1170 bp, Homo sapiens
  misc_feature (46)..(46): n is a, c, g, or t
gttcctcggcgcccctttgcctacacttgtcctcttctcgcaccgnatcggaggagccagctctttccgcgcggagcattctggggcccgaggtcgagcccgccgctgccgccggtcgcctgagggaaggcgagaagaggccgggaccggagagaaaaagcggagtcgccaccggagagaagtcgagtccctagcagcagccgccgccagagaggtcgcgcccacacagttcgcgccgtctccgctctgccccgttcacaatggctagccgtgcttctgctgatagtggtacgatcgaaggggagtatgtcttcatggaattaagtgtgaagacagtaaggatgtggaatgtacacattttgaatacatgccagaattacattcagtggtctcgagaggagagtgatcatttgaagcatttaaatgagattgatctttttcactgtatgggatccaaatgattccaagcataatggaatggacagatcaattttacatggttgttaacgagataaggagaagtcttggccagatcagtgtgcagaggtttaagatagacgaaagggtaaaggttaagtggcttagtgtcgacttccataattggaaagactgggaagatgattcagatgaagacatgtctaatttggatcgtttctctgagatgatgaaacacatgggtggtgatgcggatggtagactttacgcagacagtagatgggagcagactgatgattccacaagacacgggatcgctgacaacaatggcagatctcggacacagggaccactgggcacacaccgggctcgtggggaaaacacacagagccgctggagaatcacaactgagagaatgcggacgtggatcgcctaagcgcgacattgtcggaattaggccacataaacgcgagtgttaaaccagagtgtgggttaaaaaagggatacaacaagggagttattgtacaaggaatgtggaaaaaataaatgagataagcggacacaactgtagaagatatcagaagttagacagtgggatagagaataataagaagtgagatacaagaaaatacttctttagtaagtagagaagatgcagcaaatactcatagattagagagaggaaatggagcaggaataataggatattgattgtttttttatattttcagctag

SEQ ID NO: 657795 - DNA, 1099 bp, Homo sapiens
gctcatcgcactgtctctatcggtgttcttggacattgtccttccacctgtgcacaagcattggtgaacttatttcggcatactacttcaggggcctatatggcgaacaatacaacatgtcctttctcagtggtgggtctggatcgctgacccagtagacaaccgctcatcctctagcaagcttaaacagtgtcgagatggtgaatcaacagaatacccaaaacatcagggcatatcgatgcgattggaatatacccgtagtgagctaacacatgtaaaccacttcagacttatcacctggtgtcgcgagacctggtagcgagttttgggatcatagtacaccaggaattcctctggtccacacctggaaggggcgccccatcttgagctttacgcatggaactacgacaaagggtcgtgaatcgttcggtctgtaagaacgagtcaatgacatatgagtcgatggtgaaacggagggcccgtgcatgggatgctcatgactgatagctggccgaggacgcaggctctcggtgatgctgtacctcctggtgtatcgggcaataagtcaggacctccctcaagcgccatgaatgcggccgagtatcacagacaatctgggggctgcatctcactacgactcacaggaactggtgacattcgggtcagctgcaccaccagcggagacgggctctatgaaggactggagtggctgtccaatcagctccggaaccagaagtgaacgtagaccccctcccatctcactactctagacctctgattattctcatgttggcaacacgtgcggctcgtaggtttgagtgtcagaaagctggctcagtggttaggtcgaccttgtgcatccgcacggtcctgtaattggtggagacgcacctgggccagggttaatttcatggcaataagtttcggttcgcaagaggcacttctcgggactccatgccaatacacacggtttatcgtaaagcaaaaccctcgggtcgcgcgacgggtttcggcctggccgcccgatcttttttgagaacaacctcgacactttcacactggggttcccaccgttcacaccacccaaaaccacacccct

SEQ ID NO: 657796 - DNA, 203 bp, Homo sapiens
caattccattccagcgtagggggggaatgacaacggcccaagcgggaacactatagacccagaggagagggaaaggcgaccagacggcatgaagatggagaattcgggatgtctttcagtgacttccggaggcactattcccgccgggagatctgtaacctgaccccagacactctcaccagcgatacgctggaatggaatgg

SEQ ID NO: 657797 - DNA, 100 bp, Homo sapiens
gggggcccttttgggggggtttccccccctttttttttttaaccgccggggttcccccctgggttttttgtaggggaaaacttaaattgccccccctcca

SEQ ID NO: 657798 - DNA, 116 bp, Homo sapiens
ctaagggggagggatcattagcattgagacaatatttcctgtacttgtcagtatgtcaaacacactccatccaaaaaatcagcttaactcgtaccactatattccccttcctccca

SEQ ID NO: 657799 - DNA, 566 bp, Homo sapiens
  misc_feature (54)..(54): n is a, c, g, or t
  misc_feature (493)..(493): n is a, c, g, or t
aggcacaacatcgagcgcatgaaggaggagaaggacttcaccagtactttcagnacacgaaacagccggtacaacaggagaaggagtgctcatgtccaagctggtggaggcggaaatggatgggctgcggtgcagcagtcatggcttgaaggatacatcggagctgaaacggagaacaatgactgcacgacatcacacctgacagcaaaggacttctcctgcagaagctgagcacatttgaggagaccaaccgcaccctccgagaactcctgagggaacagcactgcaaagaggattctgaaagactaatggagcaacaaggagcactgctgaaacggctggcggaggccgactcaagaaagcgcgcctgctgttactgctgcagacaaggacaaggaggtggaagagctccttcaggaaatacaatgtgagaaggctcaagcaaagacagcctctgagctttctaaatccatggagtccatgcgtgggcatntgcaggcacagcttcggtccaaagaggctgagaacagtcgcctgtgcatgcgattagaatctggacgcacggg

SEQ ID NO: 657800 - DNA, 211 bp, Homo sapiens
gtcttgaatattttacttctagaaatgactgttagtcttgttgggaggtgagcagtagggaatgttgactgtgctggagaacatagtaactatcatcagttctcacccctcataatcagaaagcccattgtctgtgccgtgaaaagaggactaccttgtcaggaacgattttacttactctctacaacgatcaaaggatctcgttacttca

SEQ ID NO: 657801 - DNA, 286 bp, Homo sapiens
  misc_feature (227)..(227): n is a, c, g, or t
  misc_feature (244)..(244): n is a, c, g, or t
tagaggatccccgaggggtgctgatgcgggtgtgcgggtacatcggggtgggtagagtgagaggaagatattgaccttagtattcctagcctgggaggagccatccttcttccactatataataatcctgcttagttcatgtggtgctgacccatacttctatccgcgctctggagcatcagcgaggcaatcgaaagcgtacaagacaaaatacttcagtttccggngccacttgtgttcatgngatgggcagactcgtaactcacggccaagtcagagttctccc

SEQ ID NO: 657802 - DNA, 804 bp, Homo sapiens
ggttgttctcttcagagaaatttgtggtacagaataattgctgtcgggactgaagctttgcagccttgcggtccttgtacccagttgttctcttctgtgagcagcatgtcttcgcgtttcaagagtggccaacgttctagactgctcttcctagaacctctaggcaagttcaaggttctacatgaatcttactacaacatatgagattgttctctggcagccggtaacagctgaccttattgtgacgaaggagacaagtccatttttctgtagatgcatcgtgagtgtcgacaatgtgaaagcccatttacatgtgagcggaattccatgcagtgtcttgctgggcgagatggtggacgatcttattcaagcagcagatttccagaggacgacagtcgagtcgcccgagcctccgcatcgtacgtagtgaacagtatcactcactaaattgaaatcgtagttctgtggactcgaatttatagactgagaggcatcctgatatgcttacaaaaagtccacattggatccgtcattgtgagaagtacccactctactgttttacaaggtttctggaaaagaacaagcagccgaaaatgccatatggattgactgtggaatccatgccagagaatggatctctcctgcttgtctgcttgtgggatccataggccatataacctcaattctatgggataatagggcaatataacaaatctcctgaggcttgttggattctatgttatgccagtggttaatgtcggatggttatgactactctggacacaagatcgaatgtggagaaaa

SEQ ID NO: 657803 - DNA, 109 bp, Homo sapiens
gctgctctagaggaccccgtttcgttcacaaaaatcggaaaacagttagccagaagaagagtataaaatggccggccttctcatggggtagtggcagtttcttggccaa

SEQ ID NO: 657804 - DNA, 796 bp, Homo sapiens
  misc_feature (22)..(22): n is a, c, g, or t
  misc_feature (64)..(64): n is a, c, g, or t
  misc_feature (538)..(538): n is a, c, g, or t
gctcaacccaccttctgcttcntgggatcaagaattttcctgcccagcctcccaagtagctggnatacaggcatgggcacatacccagctaatttatgttttagtaagagcggggtttctccatgttggtcaggctggtctcgaactctgacttcaggtgatccacccgcctcagcctcccaaaagtgctgggataacaggtgtgtgccactgtaccggctaatttctgtactttttagtagagatgagctttcaccatgttggccagcggggtctcgaactcctgacctcaggtgatccacccacctcggcctcccaaagtgctgggattacaggcatgagccaccatgcccagcccactctgcagtctttacagcctttttatgtttcttgagttaccctattgcctagatccttttttttttgtttgtttgtttttttttgggttggggttgggtttttttttttgagacaggatttctgtcacccaagctggaatgcagtggtgccatcacagctcactgtagcttcaaccttncagggttcaggtgatcctcccacctcagcctcccaagtagctgggacaacaggcgtgtgccaccacccctgctaatttttgtcttttttgtagaaatggggttttgccatgttgcccaggccagggttcttaatatttttttaatgtatctgataaagccttaggatcatttctcaggctaatgtatttttcatttgttttctttttatatataacagctttattgagatataaagtgtgtaatacagtgaaaaaaaa

SEQ ID NO: 657805 - DNA, 325 bp, Homo sapiens
gagaggagagagagggagagagaaacggacagatcgaaccggaggacacagagcggagcgagaagaagaaggtaatatatagtacggattaagagaagaggaagaaggggaacaatgtagaggaggagaaagcatgtaaccgaggacagagcggtgcggcaagagcgacaggacagagacaactagagaacaagatgagcaagagagagatcagtgtggctcagtctctctgtctctatctctctatctctctatatctctctctctctctctctctatctctatatctctctatatatactatcgcgtgccgaagtccagcagc

SEQ ID NO: 657806 - DNA, 402 bp, Homo sapiens
ctgttcagagtattccgcttctacgtatatgactgggtaaacttggtggtgcgctggaggaacccgtccgctctgaggacgggagacagaccacaggacagagttggagctctagctcctggtgctgttcctgcattcacccactggactttcccacctctgctcaccttactgttcacctcatcaaatcagttctgacctgtgaaaagatccagccttccctgccgtaaaggatggcgtcttactcgggattcctgatgttgttgtggccttgggtaaagagctcccctgagaacacaggacaggcctgatgacaaaggctgagtctaactatggaaaagaccaagatataacttcctgggcacactgggaaatctgagcagtgatgaagacgtaaaaggg

SEQ ID NO: 657807 - DNA, 495 bp, Homo sapiens
agatctctacagcagctatccaagctttatgatttccttgaggttacacgtttgtggctgctcttagtgtatattcagaaaaaaacagattgcgaagatcggcttacagacgtggatttctacactgagcgccagggttgactacgctgaatttaaaaaccgagccctagcgccagctcagcaccctacgctcaggaagcggattttgcacacacactactgcattcatacagagttcactgaagtctattaccaagtgtcttttatgaataaacaatacaaagtccaattttgatggctgctataaaatgcttaggaatctctgcaatactttactacaaatacaaatgccccagaggtcagggaaatcagcctgaagaactgggtacaggttctatatcttttgtggaaatatcagcctaggaatgttattcccggtacagatgtacacagtcaaaaaggcttatcgagctgtttgacgagttctttgagtgt

SEQ ID NO: 657808 - DNA, 269 bp, Homo sapiens
tgaactctagcgcgactagatgctggtaggcgcgcagaggaagtgttcattattggtagcttggtcgctactcttttttgagcatcaccgccagctcctggggaagtggcgcaccttcaaatacctttacctggcccttgtcccggtcccggtaaagaatcatcggagttcttcgaaaccccgcctggcggaatagagccaggttgtccgcaaggttttggcgaatgtcttcggtgactgtcgccggctgcagctgacgcttcgccatc

SEQ ID NO: 657809 - DNA, 108 bp, Homo sapiens
ccgtcgtcggtcattccgctccatatctgctacagtgtaggacggcattcacagcaagtctcagccatctgtcggtaatgagctagttgacctagtgtggagcccagc

SEQ ID NO: 657810 - DNA, 110 bp, Homo sapiens
tattgcggatattcagactgagcgtgcctaccataagcagccgaccatctttcaaaacaagaagagggtcctgctgtgagaaactggcaagggagaatgctcccgcggta

SEQ ID NO: 657811 - DNA, 185 bp, Homo sapiens
  misc_feature (22)..(22): n is a, c, g, or t
  misc_feature (45)..(45): n is a, c, g, or t
  misc_feature (56)..(56): n is a, c, g, or t
  misc_feature (154)..(154): n is a, c, g, or t
  misc_feature (170)..(170): n is a, c, g, or t
  misc_feature (181)..(181): n is a, c, g, or t
ctcagtgcagggacgtcacccntgccaggcaagcccagggacagntgccaggatgntttctccctctcagtgcgaggcttcacccctgccaggcaagcccagggcatagatgctgagacagcctctccctctcagtgcagggacgtcacccctnccaggcaagcccaggncacacaggccnggat

SEQ ID NO: 657812 - DNA, 111 bp, Homo sapiens
tctgacaggggcggagccacacagtatgctctggcaggaggcggagctcacacagtaatgctctggcaggaggcggagctcacacagtaatgctctggcagtgaggcggag

SEQ ID NO: 657813 - DNA, 171 bp, Homo sapiens
gtctgtgggcacagtggtctgtctggctgtcagtgctcctgagtctgctaggaagtgacgcgtctgttcccacaggggtcatggaggacctcccgccatcactgctgactcacccctgctggcgtgcgggggaggaagccctagcgggtacctccggtgagctcgtgccag

SEQ ID NO: 657814 - DNA, 330 bp, Homo sapiens
  misc_feature (50)..(50): n is a, c, g, or t
  misc_feature (176)..(176): n is a, c, g, or t
tcttgttacagtgaaaaagcagtctggatcccgaggtcacccttattgcncaagtccagattgcgcgcaacgtgggtgatcaacgtagcacagattggtcttctcagtacagcattgtggctggggcaggccgagagaatggcatggagacgccgatacacgagaagccggagtgngagaagtgccgtcaggccctgtgcagcatcagcaagtcaggagctgccggcggctctgccaagtccagcagcaatggtgctgtggccagtgcacagtacgtgtcccaggcagaagcctcagctttgcagccgcagcagtactagccatggtacg

SEQ ID NO: 657815 - DNA, 1417 bp, Homo sapiens
gcccgcgggaaaaccgggcgcgttgcatccgactgggtgtagcccgtggggatggcaggttctggggagggctggtcctagcgtgcccctggatttcgtggagctgattctggggtcaggagacaccctccgagtccacgaagaccgggcagctgctatgagagttactatcattggacgccgatggccgtggatcgcggcgccgcatcccaagcccctggatacgtcctgactgtcaggggtccacgcttgacttgtgtctgacgggacccgatcagtgatcctgagtgcgctggctgaccgtcgggagggccctgagaactactcgtcgagaacttgggacggacgaagtgagttcgggcgttacctggagggaacaggagggggccggattgcttgcttgccttgcaagtgatctggcgcggcgttctcattggtccaagagtacttgcatgaagcgtgctggacgactgccccgcataagtcttgtaattcgtccgaaggctgggaccctgggattcatgctcgtgccttgccacaaacggggaggccaagcccccgggggtaaacagtggattgccttgggtattgcacatccgaggggaatgtgtaaggactagggtctccaggacaataaaggcttcttactgaacgtgggcccgttgaaggggagggctacacctttattcatgaagttaccgacaccttcacttccacaaagttgtgcaggctgcgccattacttcattctgggaattcccacatggcctttgcctgggaattgaacaaattgtcggcgaggcatgggtaaccccaggagaagtaccatccttagtgggggaggtcaacatacgtgctgattgccgccgttggtgcttgggaacacaatcgctttgtcccttgaacccattcttggcgaagggggacaccctttatggtgacaagtagaaacacccacactggtttcacggccagagcgtgggagcctgggtccttcaagagggagatggctagcatggtccaggacgggggaaggaaatggcttgggtgttagcaacttggtatcgcacagagtcatctagggggtcatggtagctagtactccgtgaggaacattggacccagaggtaaaattccttgaagcctcatctatagggcccccttggttcatgcacgggacgaccaatgggggccccctagaggtctgtgcacccccaacacaaggaaagccagggggtctggcagggaaccctaattcttctggaccccttcattaggcctgcattccttccgttatcgttaacccaggttcctccatggaagccccccgggctatacaccggggcacacgttggttcatccgaaggacaagtgggcaccaggcattcaggcctttcttgcccttgccctggtccctg

SEQ ID NO: 657816 - DNA, 282 bp, Homo sapiens
  misc_feature (162)..(162): n is a, c, g, or t
attgttgaccttcggggactcgtgagtgccggcgggcatcggtggctggattgggagtgacctcctcagggggttggagctggagttggggcctccccgttccccatcccttgccaagactcccggtgctgggggttgctctatgaagagggaacgcgtagncttgcagatcgtgacacccgctcccagcttgagagtggctgcgaatcggtgcgccggtgctgactgcaatgacggtctattagggtcgcttgccgtccgtctgcttgccatctgtatcgc

SEQ ID NO: 657817 - DNA, 106 bp, Homo sapiens
actaatacaggaaggcgcagtgtcctgtctcgactcaggacgaagatctgattggtgtcagagatgcctccaacctgaccagtgtcgtatccgaggatgcctgtca

SEQ ID NO: 657818 - DNA, 374 bp, Homo sapiens
ttgagggtaaaacgctgagcgcagcgagctgctgatgttgaccatggctctttcctggatctaaaagtcggcaaacacacacctgtattaacggcggggcgtcctgctggagctaaggtcagcgttgaatccaaaggactcgttgacgggcagataggccttgaccacaaacatgggtgtgccgccacctgttactcctcgaacacgtggccccgtttactgttcaaaaccccgtagatgccaccgtccacctgctttggacactgtatctccacaaggtagatggtcttcatgaggcgtggctgggcgttcagcacactggcatagaggcagcgccgtgctgtggggatgatctggccccctccgcggtgtat

SEQ ID NO: 657819 - DNA, 127 bp, Homo sapiens
gctgaggtgatctgtgaaatggttcgctattcacttgaccggagaaccccacgaatcatgcaatcacgaggttccatcttcgtgttcactttaaggacaatcgtgaaactgctcaggccatcaaggg

SEQ ID NO: 657820 - DNA, 261 bp, Homo sapiens
  misc_feature (99)..(99): n is a, c, g, or t
  misc_feature (174)..(174): n is a, c, g, or t
  misc_feature (203)..(203): n is a, c, g, or t
  misc_feature (211)..(211): n is a, c, g, or t
  misc_feature (249)..(249): n is a, c, g, or t
atgagttattcctcagtgtgattgagtccaccaaaatcttaagctaaatttatgttgtttcatggtagctgttatgaaaatgggacccatctaaggagnaaaatcccattgttttctcaaattcaaatgccattctgtgttgacctagggtttgtttccccgttggattaaatngcttatggtggaccattggcctggtttcntcctttcntaatttcaaccccaggtttttgcccctttcccctaaantaaaccccttct

SEQ ID NO: 657821 - DNA, 182 bp, Homo sapiens
cgccattattttcaccatcattttctttaacctatacttatacctacgcctaatatactccatcttaatcacactactccccatatctaacaacggacaaataaaacgaccgtttgaacatacaaaacccaccccattcctccccacactcggcgagggtcaacgcagctgggtaccgagct

SEQ ID NO: 657822 - DNA, 910 bp, Homo sapiens
  misc_feature (18)..(18): n is a, c, g, or t
  misc_feature (23)..(23): n is a, c, g, or t
  misc_feature (25)..(25): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagagtcccttaaggttataaaattgccttcatgttggtcttttagttgcaacataatgtacttgtataccctatcctaattatgggatcatttgaagagcttttcccaaattgatggctgtgctgcgttctccccatccccgggggtttccaaaggtgatttcaaactggaacctagttttagaaccactgtctgggtagtgcgatactgaaggctatggtacttattctacttgtatgtgggtacttctaagatagcattttcccgaccaggctgtcacatccgtgcccttgcatctttacctttcggacaccgttaatgttctacacaatacctgggcctcaaggaggcagaagggggaggcttagccggcacaacaatgatattgggccacaaaaggctgggaccacaaattactttggccgcggggaaaaactgttgacatttttcccacaag

SEQ ID NO: 657823 - DNA, 401 bp, Homo sapiens
tgggccagaaattcctcagtgctctattactacagggcgggtatatgaaaataagacacacatagccaatttgccattctgcattcaggcgaacattacataatcaaccacggtgctaccgtttaccccttccttattcaggggaggcattgtacatcaatcacaacactggttccactagactctcccctcctgcatccataatacaggtagacgtatttcttatctaaaatgcttgggaccagaagtgtataggacttcacatatcatcagatttcggacctttgccttacttaccagttaagaatccctaatttgaagatccaaaatgctcctataagcattttccttgagcatattttttggtggtcaaaaagcttcaatttctgtgcccatttcaa

SEQ ID NO: 657824 - DNA, 310 bp, Homo sapiens
atggatttcaggatcagagatgtcctgtgaatttccaaaaatagagtgggctgcttttggagctttttgtccctagaggtctccaagcatagactcaattacttcccagggttgaaaggaagatcaaggtataagtcctttataaatgctgaagttagcacagtaccagtcccaagctagtcacgcagtccatcgctttttggagtgaaatatccagtaccttcttgtattttcctctatcaaggaggggccctatctcccatatccaatcctagagtgtgaaagtgaaaattatatgggggtaaggggt

SEQ ID NO: 657825 - DNA, 331 bp, Homo sapiens
  misc_feature (25)..(25): n is a, c, g, or t
  misc_feature (31)..(31): n is a, c, g, or t
  misc_feature (46)..(46): n is a, c, g, or t
  misc_feature (50)..(50): n is a, c, g, or t
ggggctttccaactgggacgctgcnaatggntcccgcaaagaaggntggngagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggactccagatgtccgcattgcaaccaggtctcacaaagcttgtctggccaaggataaggatgtcccatcccgatccgttccgctgtccagaaccgataggtggagtccccataagctatacttgtaccttgac

SEQ ID NO: 657826 - DNA, 112 bp, Homo sapiens
  misc_feature (89)..(89): n is a, c, g, or t
agctgttcatgctgggactgtacagcctgcagggttttccttgggcgtcggcccaaaattgccttcaaaacaaacccgggacggttganagccttcgaaccgtgcaggggat

SEQ ID NO: 657827 - DNA, 397 bp, Homo sapiens
aggaaaaacatttttttttgccctttcattcatttttttaaaagttcacaagcctttccccttttttttagggcctccgggcaagttttatcattaaaaacaattttttttaaagaccggcatttccatttaaaacgatttggggggctggtttatttgcttagttttaaggggatgtccctgcaacaggccccatggatttaaggaaaaaaaaatccctagggatcctttttttttttgagaagcaaaaaaacatggtccccttagatgttaaaatgttaaaattaaaaattaaatgttaaaaaatggggaaaatgcagattttagaacgagggaaatttttgttgggaatttttatcctcccaaaaaacttcagaaaaaaattggttttccctga

SEQ ID NO: 657828 - DNA, 309 bp, Homo sapiens
cgggaaggaattataaccgaaagcaccacacatcagaccgggtagaattttttgctattttttccgccgaatacaagaagactaataatggataggatttttacaaacacagagagaaatgcttctcttctgctgcggcttctgctcgattatttgcgagcagaggatacacacacaacaacaacccacacagcagagaagtatcagaaaacatagaaacatgtgaaaatgcgcatttttgagaggagtgagggaaaggagtagaggatgcgaaaaaaaaataaaaggaaaccataagaatatccttga

SEQ ID NO: 657829 - DNA, 441 bp, Homo sapiens
cgagcggccgcccgggcaggtgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 657830 - DNA, 332 bp, Homo sapiens
gattgggggccctggggtccccaatccctgtccatccccagttgggggtgggaccgccagattttcccttaaggaattgacttcagcaggggtgggagggtcccagacccagggcagtgtggtgggaggggtgttccaaaaaaaagggctggtcagcaaagccgccccgtgtccccccagggggtgggggcagacttgagggccgaattgtttttagttaggccccggtcctttgttcagttgcaaaggggaacactcatgggggccagccatgggccctttgagcaactggggaggccccttttcccccccatttaacccagaacccctga

SEQ ID NO: 657831 - DNA, 612 bp, Homo sapiens
  misc_feature (54)..(54): n is a, c, g, or t
  misc_feature (69)..(69): n is a, c, g, or t
  misc_feature (204)..(204): n is a, c, g, or t
gggctcataatggagcaggtgaaagttcagatccccgtggccaacgccagagancttcttcaaaggatnacggcaaagtgtttccggaagtgtataaggaaacctgggggctccctggcaactccgaacaaaagtgcatccccatgtgcatggaccgctacatggacgcctggaacaccgtgttttgcgcctacaacttgcggntgcaacgggaacgaaccaacatgttcccggcgagggcgggccaccccccccttttattttccataacggtttttaaaaggggggggccgcatgtacgtactgcctgcccggggcttaagagggtggccccggtgctgggacacacgggaatgtgtccttgcccccccccgccctgccccctgccaaccagtgcagcttggatttcgggggtgtggggccctgtgccttccttaagtgctggcagcccagtggcccctccttcaggcctttggggtattcccctagtgggcccaagtcaacctcatattttgggcggacagcttgtttggactttggagttgggggtggtcaaaccccccaggagctgtcccctccttcggatgggcaaataaattggtggagggcgga

SEQ ID NO: 657832 - DNA, 326 bp, Homo sapiens
ggtcgacttttttttttttgagttttctaaatatcagggtcttaccccttcacttttactataagtttattttcctttgccttgcataggcccagcattccatcctttgttttcctttcctcactatggggctacactttccctgccagactctgattggagttttgtttctctcacttagaagaggctgtttccatacgaggatccataataacaacattgcctcatatttataggattctttggaatgcacaaaatacttgcatatatatttatgaacttctttctgattgaaggcaacatttggtgatataattagagtcgac

SEQ ID NO: 657833 - DNA, 489 bp, Homo sapiens
tagtaaaagaatttcttctttaaagctttaaaaaaaaaaaaaaaaaaaaaaaaaaaaaaaaaaaaaaacgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 657834 - DNA, 140 bp, Homo sapiens
  misc_feature (64)..(64): n is a, c, g, or t
gtgatgcacatatgagtgcgaattgtgtttttactatctacttataatctgttcttatacgcangtatttatttgcgtacatttgactttcatttgtttaaatagaagggagaggaaatttgtagacatcattagacaca

SEQ ID NO: 657835 - DNA, 486 bp, Homo sapiens
tgggaggaaggaacttggcttgagcttgttaaactctgctctgagccctcccttgtcgccctgcatgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 657836 - DNA, 236 bp, Homo sapiens
  misc_feature (31)..(31): n is a, c, g, or t
  misc_feature (49)..(49): n is a, c, g, or t
  misc_feature (55)..(55): n is a, c, g, or t
  misc_feature (62)..(62): n is a, c, g, or t
  misc_feature (119)..(119): n is a, c, g, or t
  misc_feature (140)..(140): n is a, c, g, or t
  misc_feature (162)..(162): n is a, c, g, or t
aagacctaggctcatggacgagatgggaagncacagggagaagggatanccctanacccagntcccaggctggagcatgctgactgtcctcttgccctccagcctttggccttggcttntctagcctatttacctgcagnctgagccactctcttccctttncccagcattactccccaaggaagagccaatgttttccccccataatcctttctgccgccccctagttccctctg

SEQ ID NO: 657837 - DNA, 1093 bp, Homo sapiens
  misc_feature (88)..(88): n is a, c, g, or t
  misc_feature (222)..(222): n is a, c, g, or t
  misc_feature (339)..(339): n is a, c, g, or t
  misc_feature (478)..(478): n is a, c, g, or t
ttatttctgcgcgcacatgaggagcagatttggcgtcgtgcgcgatgacaggcctgagcaaacgagaagaacgaagagcgcgaccgtngcggagtatacgtccgtatcgcatcaaagcccactgagcgtgcacggtatcttatctcttgcctcacatggcttgggcaacagcctgcgcttttatggcgctctcatttttctgggacattgttcttccgacangacgcttcgcagagtaccaatatgcgcgtcggcggagaaaaaagaaggcggcttcgtcctgtgtctcctagtccaagaaattgtttggggcgcgcgccttttttacatacggggacncagagaaccgttttgtgatcaaaagtatgggaaacccactagggcgcaacgtagtattctgccaactctcttatcttatggggacatctggttaaagaagcaccggagagtgcctgggaccaacaagaggagacccgtntgggagcgacacacgatgggcggttcaagtccttgcaggaaaacggtaagcgtgggggtgtgaagaccaaagaccagcgaggtctgggacgacccagcgcctgtcttataaggcctctcaccgcttttttggcgccacaaaatcgtaatcagagacaagaggaagagtctcacgccccctaatgtgcccgaggtaaaggtgcactacgctgcttacacacgggtaagatgtcggggcgcaaaagaaaaaactgccgcgaggagacaacatcagttttaaaatttgcgcggcgatctccagaaatccggtgtgagaaataaacaaaaagggtgtgtttattggctccttgtagacacctgtgaacctgtatgacgctagcttattcagaggcaatactgctgtgcaccacaccatgtgagaaccttcttccccttgtcacacgcaatgtgcgtaaaggcttggcagagcacgcacacgttgtgtgcagaaagcgctggaacaccctagcggacaatgtgccccggttgtaacacgatgtataataggggaggagttttgggggaaaccctttctaaaaaaaaattttcttcaagcccccccagaaaaacaaaaaca

SEQ ID NO: 657838 - DNA, 1018 bp, Homo sapiens
  misc_feature (18)..(18): n is a, c, g, or t
  misc_feature (23)..(23): n is a, c, g, or t
  misc_feature (25)..(25): n is a, c, g, or t
  misc_feature (527)..(527): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaaaaaaaaaaaaaaaaaaaaaaaaaaaaaaaaaaaaaanaaaaaaaaaaaaaaaaaaaaaaaaaaaaaacaaaaaaaaaaagaaaaaaaaaagaggaggggaacaaaaaaagaaagcgagaggaggaaagaaagaaaaaagagaagaagaagataacaaaacaaaaagagagaacacaaaaaaagacgagaaaacaaacaaaaaagcagagagggaaggagagaacagaaaaaaacagaaagaaagagagagaagaagacaacaaagagcaagaggagacatcaaagaacagaagaacaaacaaaagaggggaaaaaacagaaaagaacaagaaaaaacacaagaggagaatagcaaaaagaagacgagcaacgaaacgaacaaaagaaaaaatagaaaagaaaaaaaacgaggacaaacaaacacaaccaagagacagcacaagagaaaaagaaacaagcggaacggacgacaagaagaagaagaaaggaaaaaaaagagaagcaaagaaaaagggaagaaaagggaac

SEQ ID NO: 657839 - DNA, 434 bp, Homo sapiens
  misc_feature (26)..(26): n is a, c, g, or t
gtacctccggtaccaaccaaatattngactcaaaataaaatgttccagtccatgtcattaaaaaataccatgtataaaaaaccgcagcatttcctacggggctcctaatgatctgatatatactcagcattcttccaaagtttccatatttattttagattttctatacttttgtttctacttttaaaaataatcacgttttttctttatatatgatatttatattttacagaagagcacaattagtcacaaaaagcttcagcaacattgattattaatggatccaggttttagaactggacagtccgaatctagagtcctccctcttaaagactacaggataccattaaggaaaattcactgtgaatgttatcagatatatttacatattaatttgtgaatgctgtttgatatttaaccctccgaggctagag

SEQ ID NO: 657840 - DNA, 735 bp, Homo sapiens
  misc_feature (18)..(18): n is a, c, g, or t
  misc_feature (23)..(23): n is a, c, g, or t
  misc_feature (25)..(25): n is a, c, g, or t
  misc_feature (720)..(721): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaaaaaaaaaaaaaaaaaaccttggtggccgctttggccaattcaacttatgaatgaggcaagctttatcttccggccgaatttgaggctcactgggccaattggcccattagggagcgaattccaatcatgtgcccgcggttttaaaccgtctgacttggaaaaaccctgcggttcccaacttaaatggtttgaaggttcccctttggcaagttgcggaattaccaagcccnncggacggctttccc

SEQ ID NO: 657841 - DNA, 292 bp, Homo sapiens
  misc_feature (28)..(28): n is a, c, g, or t
  misc_feature (53)..(53): n is a, c, g, or t
  misc_feature (64)..(64): n is a, c, g, or t
  misc_feature (131)..(131): n is a, c, g, or t
  misc_feature (178)..(178): n is a, c, g, or t
  misc_feature (202)..(202): n is a, c, g, or t
  misc_feature (223)..(223): n is a, c, g, or t
  misc_feature (243)..(243): n is a, c, g, or t
  misc_feature (254)..(254): n is a, c, g, or t
  misc_feature (271)..(271): n is a, c, g, or t
  misc_feature (281)..(281): n is a, c, g, or t
  misc_feature (291)..(291): n is a, c, g, or t
ggagaaaggcacaaggagaaaacaccantcaatgggagaaaagtcccccaggncagtcttccanctagagcccctcccctttctcaccacaaagattgcttcactccagggcggggcgcagtggctcacgnctgtaatcttaacactttgggaggccaagcacaggcgatcacttgcnggtcaggagttcaagaccatcctngaccaacatggcaaaaccccnccttcattaaaaatgcaaanattagccaggnattatggtacacacgtntagtcccatntattgggggng

SEQ ID NO: 657842 - DNA, 1581 bp, Homo sapiens
gagacggtgttttgctcttcttgcccaggctggagtgccacggcgcgatcttggctctacacaacctccacctcccaggttcaagtgattctcctgcctcagccttccaagtagctgggactacaggcatgcgccaacacaccccgttaattttgtagttttagtagagacggggtttctccatattggtcaggctggtctcgaactccaggtcaggaagatctcaggtgatcttcccgtctcggcctcccaaagtgctgggattacaggcatgagccactgcgcctgtccattccttattcttaatcagataagagttgctggttttcacaactaattactccacctcaaaccaagatgccaccacacgcttaaagctcaaaatttctctaaatatgcatccattttattgtgtttttctactatctcaaaggaagagagatctgatttcctattttattctctcctttctcctttattgggagaaatactataactatttctttcatgtaaacttcaaatctttcccggtttccttcaaatctttcctcattgattccttcgtgtttcaacagagactgggtcatagagccctagaaattcttcctaaaactagagcagtctctaaccttatttaacttactttactactgctaccaccatgatatactgaacattgtttccattttctcatttgacacttacggttttcacccctaccatgtgattaaaaccatacatgaatcatctctttttttcatctatatccttcttccattagcaatattatgtgattctttctgaagaagtcctggtgaagtatctgaaaactacaactatttttgtgtggcccatgagctaagaatagtttctatatttcaaaaagtttttttcaagataaaaaaaaacagtattctgtgacacatgaaaattatataaaattcatatttgagtgatcataaagttcaccagcagaaggtgatgttgccgcactagataaagaaaagcctctggtggccacagcaatgaccacttcttctctactgtccaacaggtagcttgctctgcagagaaaaggcgtgaaaaaaattattctaccagttgacagaaaaaaaccagctgagaaataaaacctgattgttcacttttaaaaatcacacccccaacgtgggcccactagaatggctcccacaaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgc

SEQ ID NO: 657843 - DNA, 765 bp, Homo sapiens
  misc_feature (18)..(18): n is a, c, g, or t
  misc_feature (23)..(23): n is a, c, g, or t
  misc_feature (25)..(25): n is a, c, g, or t
  misc_feature (567)..(567): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaatctaaaaacttataaaaaccatctacacacaaaaagccatggaacttattaacatacatcaatttaaatgcccccantgttatacatgctaactactgcacaactgctctcagatgctctgatatgcccgaatgcccctcccgtgctatcttcaccataaaaaaaaaaatttggccctcttccccctacgcttttacttccgaaattaatctacggccttggacctcttggacatcccctatagggggggttcaggggccggtttcgggctcggg

SEQ ID NO: 657844 - DNA, 129 bp, Homo sapiens
  misc_feature (123)..(123): n is a, c, g, or t
atcatcgagctcggtaccgacatccgatggtgcagccgctattaaggtcgtttgtcacgattaaagtcctacgtgatctgagttcagaccggagtatccaggtcggtttctatctacttcaanattcct

SEQ ID NO: 657845 - DNA, 1069 bp, Homo sapiens
  misc_feature (18)..(18): n is a, c, g, or t
  misc_feature (23)..(23): n is a, c, g, or t
  misc_feature (25)..(25): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcaaataacgttataaaattgcaaaactctcggagaacttgagtttcttcttcttcttcttctctcggggggagaagggggtggcccgggcaagcgcggggccccccgggggcggtgccggggccgcgggggcggcaacgcgggggccaatataagcaacgtgtgccaacctataacacacaaggggtgcccggcggcggtgtggcctttaatagcggcgcgggccctacaagagaacccccccaggggagggtgtaccggaggggtaccccgaggttttgggacgaaaccggggggtctccccaagacctagaggggccaaacacaattttacagaacgggggggacccagggggggaaaacgtattactacacgtgtggcgaacgttattttccccggggggacaccctaataagcgtctttttcaccagcgctaaaaaccaaagtggtctccacacacagtagccggccacgaggagggaatagaaggtgggtacccccaagggctttgtgggtggtgggccaaacgaaaccttcgttgtacaagcaaaactgtgcgcccacaggtatgaggagagccacagtggagtcataaattgccgcccacagaggaaacagga

SEQ ID NO: 657846 - DNA, 114 bp, Homo sapiens
tagttacacgatggagaactggcaaataccctgacaaggtaaattcgagatatctaggcattaatagacaatccatctccaacttacatgtgctgctcttacagactgaggtaa

SEQ ID NO: 657847 - DNA, 106 bp, Homo sapiens
tcgataagccaatcactttattgactccaccgcagactcctcattctaacctgaagtcggaggacaaccagtaagctacccttttaccatcattggcccttatgag

SEQ ID NO: 657848 - DNA, 223 bp, Homo sapiens
ttattacaagtggtttgaagtcgttggatctctggtaaggtaaaaatagcatttctcccaaacagtgtccagatcccgcgactaccttagaaattagggcataatttcggctacacttgtccaaatgaggcaaatttgtgccctaaatgaagctgactcaatttaaagaactatttgtaaaatagtattttcaccaattcaacgtccataacaccacacaatt

SEQ ID NO: 657849 - DNA, 488 bp, Homo sapiens
caactcatacagggacacctcatgttaccgcatttccctttatttagtttttcgcagatactgcgtttgttacaaattgaaggcttgtggcgatcctgtgtcaatgaagtccactggcaccatgtttccaatagcgtgtgctcactctgtgtctctgtgtcacattttggtagtcccataatatttcacaatgttcatcgttaccacacgttctagtgtgatctgtgatcagtgatcttcgacgctcacgctcaagtggagtatgaggccatgaaccatgcccatataagacttaattaattcttaattgatgactatagtgtgtataactgactgttccactgacctgctattcccatatctttgtccctctcctcaggcctccctatttcccacagagaaaacaatattgaaattaggccagttaataacccgccagtggcctctaagtgtttaagtgaaaggaagattcacacatctgtcacatt

SEQ ID NO: 657850 - DNA, 299 bp, Homo sapiens
cccccttttttttaaaaaaaaaatttttctttttgcggggagaccaaagatttttttttttaacaaaaggcccttttttttccaccccccctttttggggggcccttttgaaaaaattaccccccccccccccccccccatttttaaatttttgggggggggggggggaagggggggcccccccccccccccaaaattaaaagaaaaaattttttggggcccccccataaaggggggggggggggggggttttcccaaagttttttttttttttggtaaaaaaagtttttttgccccga

SEQ ID NO: 657851 - DNA, 322 bp, Homo sapiens
ctgactcagaggattcccacatagtagatgttccttttttaaaattttttattttttttggacaggatctcacttggtctcccaggctgagcgcagtggcacaatcatggctcagtccaacctcaacttcttgggttcaagcaatccttacatttcagcctcctgagtagctgggaccatatgtgcgcaccaccatgcctagctaattaaaaaaaaattttggtagggatagggtctcctatgtcgcccaggctgttctcaaatgcctggcctcaagtgatccttgcaccttggcttcccaaagtgtggggcgataacatca

SEQ ID NO: 657852 - DNA, 175 bp, Homo sapiens
agaggtcaaggttgcagtcagagtgacaccaagaccccatctcaaaaaaaaaaatttttttttctcctttatcttctttagtggtcctccgcatgaaaaggggtatgagttatagaaatagcctttaccatatttttggtggtaggagggagagctatgggtattttctcatttc

SEQ ID NO: 657853 - DNA, 458 bp, Homo sapiens
ctagaggatccctaaagacgtgtgcaatgtacttcgctaaccctcacaatcttcatttataatttcaggattatgatattgtacttatagagctttgaagaggtgagagaccgtgttgcaatgatgttcatcagggatattggcctgaagttttcctttttttattgtgtccctaccaggttttggtatcaggatgatactggcttcataaaatgagttaggcaggattctttcctcttttattgtttggaatagtttcagtagaaatggtaccagctcctctttgtacctctggtagaattcagctgtgaatctgtctggtcctgggctttttttggttagtaattactgcctcaatttcagaacttgttattgacctgttcagggatttgacttctccctggctcagtcttgggaggttgcatgtgttcaggaatttatccatttcttctagattt

SEQ ID NO: 657854 - DNA, 471 bp, Homo sapiens
  misc_feature (214)..(214): n is a, c, g, or t
ggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattacccatgtggagttcaaacgtcatngtggggaacgaagaacgaggatactaaatttgtgggacttgggacttttggtggcccttttcaacctggggtgtgattacaggaagaagcctcgtggaggaattcaggaaatagtgctagcaaagagagcgacacctggtaaattcgtgaagtcgtgggtgaacctagctggcacctacttctttctgtgggatgtataaacaagctgaagcagctggatttaaagcttcaaaaagccgactccaaaacccgctccc

SEQ ID NO: 657855 - DNA, 108 bp, Homo sapiens
  misc_feature (40)..(40): n is a, c, g, or t
  misc_feature (53)..(53): n is a, c, g, or t
  misc_feature (80)..(80): n is a, c, g, or t
agttcttcccctttggtggaaacctgtgggaaatattcgntagggaaaagaanatgagaaagaataagtgaaagactttnggtttaggatgctttaagattggggcat

SEQ ID NO: 657856 - DNA, 194 bp, Homo sapiens
ggggccccccccccccgtccccaggtaaaccaagggtttgctccggggcccatttccagtttggcccccgtttgtgaccttgggcaagtcacttgacctttgtgggccccaacttcctcctttgtaaaaaggggaaagtccctgcccctccctccctcacaggcatgttgtgaaaataaataaggtaaggggta

SEQ ID NO: 657857 - DNA, 205 bp, Homo sapiens
gtctacggctcacgaggggcagcagccatgggagagcccttgcacggagagccccccaggcgctggaggtagggtgccggcatgtcaaccataaaagggcgtgcttgttgatgggaaaactgaacacagactgggagctaaggaatctgtgcttattttgtgaaatgtgaacaggcacttgagctatgtggtggacatgtgcaaa

SEQ ID NO: 657858 - DNA, 116 bp, Homo sapiens
gctgatgctgacagccactaccaaagctgctgctgctgctgctgaagccaccgccatagcctcccccaaagccactaccaaagctgctgctgctggaggaatagcagcaggaggaa

SEQ ID NO: 657859 - DNA, 348 bp, Homo sapiens
ctatagcatgctatatcacttaacagtagagacatctaactcaaaaaatatttatacacagcagaaatttcatcaacacaaaattattcatcatatattattttttgagacagagtcttgctctgtcgcccggccttaaattaacttttatgttcagagatatatgtgcatagtttggtatacaggtaaacttgtatcatggaggtttgttgtgcagattattttgtcactcaggtattgagcctagtgcccattagttatttttccagatcctctccctgctcccatcctctactctccaataggcaccagtgagtgttgttcccctctgtgtccatgtgttatcat

SEQ ID NO: 657860 - DNA, 462 bp, Homo sapiens
gttttctagctttctgtagaatcccattggctgagaggaagggtccattcagccagctggggggcttagaattgtatttttggtttacgaaatgaatcatattgctgttattctaactttgaatcgctagatggctgatgccaagacccttattattgttctttcatgtcatagaagaagaacattaataatggttgcaattgttatgattgtaagaacaacgaggcactgtatacattcacatgggctaatgtttacttgcactacactttttttcccgttaacttctttattaggctgttcgtgtttaccacttaactctttcctcccagagcactagcaaagactgcccgttagccacttttcactcttactggctattaacatctctagaacaggaatgagcttccttgctatatagccacgagacagcataggagactaaaacctggggtagagaaa

SEQ ID NO: 657861 - DNA, 427 bp, Homo sapiens
ggccaggtgttaacagcctaccagcctccctccccgccggtgcacagtggcttccatcggtaccagttcttcgtctacctccaagaaggaagggccatttctctccttcctaaagaaaacaaaactcgagcctcttggaaaatggacatcttcctgaaccgttaccacctgaatgaaccggaagcaagcacccagttcatgacccagaactaccaagattcgcccaggttccaggctccgggcagcgacaaggccaaggacagacgcaactagagaggactgcctgcctgcctgcctgccagaccgccggggtcacctaacagccgcgagtccacgccgcccacgcccaccacctacggcctggctgtgggagcccctctgggtacggaacccttctcctcctgattaaaaacaacgaaaatcctcg

SEQ ID NO: 657862 - DNA, 365 bp, Homo sapiens
ttaatagatatgtatgaaaatttaaaaactagaaaaggttgggcatggtggtttatgcttgtgatcccaggactttaggaggccaaggtgggaggattgtttgagcccaggagttcaagaccagcttgagcaatatagtgagaccctgtctctacaaaaacaaacaaacaaacaaacaaataaataaataaataaaattagctgggaatggtgatgcacacctggagtcctagctactcagaaggctgaggcaggacgatcacttgacctcagaagtctgaggttacagtgagctatgatcataccagtgcactccagtttgggtgacagaacaagaccctgtctccaaaaattaaaaaaaaaaa

SEQ ID NO: 657863 - DNA, 193 bp, Homo sapiens
gtatggtggcaatgatggatggggatgatgaagctattgtcttcagtagaattcattcgacatatggcccattagggtcacaatagccggctaattggggggaggcctcctatcggagagtgagggtggactggaattaagggtgttagtcatgttagtttgtggcaggtgcgagatagtagtagggtcgtgg

SEQ ID NO: 657864 - DNA, 1790 bp, Homo sapiens
aaattgatggtaatgaaggagggttgtgccatgaaaatacaagagatttcctattgtaaccttgttgcactgtggattaaattgaagatgcacagtggactcctgggggtggaggagagtttggaggtcagagggctcttgtcttgagctccaagtggtgctctaagtctaggataaagattttacacagggtggggcaggtggacagccagatcttcatttattcttaccaagctcttattaagtcatgtgggtgggatttactgttaaggaaggcagagcctacctgtccccatagggctggcatcctattggaggtggcactagccacttaactagttaagtgagtgatatttgggtagggtgcccataactctgatacgatctgccttgcgattctgctcctgctagtggagtgtgggggaggcctggtcttggatcttgttcctcacagctggttcattcaggaggttagtgctctgctgaggaggctggaggcagagctccatcttggcctggctggctagtttctgttcaggactagagctagcacctgtagtcttggcaagccattttagaaatctaagttgttggtccatgtaatgtcctggtggttgaaccaacactcgttctttgccattcctgggcaggtgcttggagaaggctggtgagctgttcatgttttttgaagaatggtgcatcagtagcacaaggttttccctggttctgctgaggcctgttgctgagctttggggtgccctgtcccctgttttattcctgttttatttctcccacattgttagctgctcagagcaaatgggttttgctgcaggtgtaggtttgcctctggctgatcctgggcagtatggcatctggatgggagggtctgagggagccttagcccagagttaaggggtgccccccaacccctgcctggagtcatcctacatggagctaataggggcgagtctgggaaaagttgcatttgtttcctgctttaagactttagcttttggcccgacctcaggtgatccacccgcctcggcctcccaaagtgctgggattacaggcgtgagccaccgcgcccagccttccttttaactctttgtacctgttttttttccttgttaggatgaaatggtaacaactagctcataaggctgttgggaagataaatgagatagtgaatgtagtgtgcttaggaccttgccaggtgcatagtgagtgcttgacaaacattgaccatccttttacagtagtcacctctgcagtgaatcagaaatttccaaccctgcacacttagggtgtctggggactgataatgctaactttagttctttgctcctgatttcacctatctgtgacattctttgtcttgatacaagtgtctgtagtactacattcacttgcttaatggtttaggggcagccacagccagtggaatgctttccagaggtagctgggcaacttgggagagagaaggaggaggatgaggccaggcatggtgactcatgcctgtaatcccagcactttgggatgctgaaatgggaggatcacttgaggctaggactttgagaccagcctgggcaacatagtgagaccttgtctctacaaaaataaaaataaatttaaaaattagccaggcatggtggtgtaggcctgtagtcccaactactcgggaggctgaggtaggaggattgtttgagcccaggaattcgaggctacagtgagctataattgtgccactgccctactactgcagcctgggtgacagagcaagaccctgtctc

SEQ ID NO: 657865 - DNA, 443 bp, Homo sapiens
cccacctgttcccaaacacaaaataaaaataaaaaatataaacaactgcttaacatgaacgaaaagcatattagtgctgacaaatgtttaaccgattggtcaggagctggtatcaattctgactatttgttggtaaatagaaccagatatttatacatcaataattgatcataataaaaattaagaaattttccacgaacaatcttagaaacaagatagctatgaaacctttggctttatatggcctttctcctatgggagaaaaaaaaccaagagggataggctcccttttctcagagctattttgccacacaatagcttacataaaataacattccatttggatgtatgtttttgaggataagaagtttgtgtgccaatacgtcactcttccaaataaaaatataaagtttaacaatgcaattggctgctaacaagcatta

SEQ ID NO: 657866 - DNA, 262 bp, Homo sapiens
tcagctacttgggacctgaggttgagaatccattgaacctgggaggcagaggttgtggtgagccgagatcacaccattgcactccaacctgggcaacgagagcaaaactgtctcaaaaaacaaacaaacaaacaaacaaaaaatccccactccaataaaggagaaaacaacagctaattccatcacctgtaacatcctggctaaccagaagtcctcctcagtctttccacgtgacaacttcactgctagaacaaccagcatt

SEQ ID NO: 657867 - DNA, 739 bp, Homo sapiens
tggaaacacagtttcactcgtggcccaggcgggagtgcaggggcgcaatctcggctcacgggaatcttcggcctcctaggttcaagcagtttctccgtgcctcagcctcccaagttagttggggattacgggcagtgcaccacgcagtgccgtggattaatttttctcttattttatagtagaaaaacgaggatttcatcagtgttgggccagtgcgggttctcaaactccgtgaccactgtgtgtggctcacacccacctgtgggccctcaatatagtggtgcatttggggcataatattatacgtggtatttctcaaccattcttgggtgagtttgtgaaaaaccgtgaagggccaaaaggcttctcctgttatattctcttcaccattgtggggccgagccaacctataagtgtggggttgtgtggtcaaaatgtgacagcacactcgtgggtgcgtgggggtatcttctctcttcgagggccttgtggacgggaccaactttcctttcctctccgcacagtgttcggcctctccctctcttccatatagaactggtggggtctcctaaaagaggggcttgtgggggcccggggtctggaggttctctagggtctgggcctataccctgccacatggggtactttaggggtaggctaccatcctcttctaaacgtgggacccctctttcttggggaccttttcctaccaaaaagattttcaagataataagataag

SEQ ID NO: 657868 - DNA, 638 bp, Homo sapiens
ttctgaggatcccctataatgttggtcattgatagctaaaaaatttaaaaaaggattactaatgaagttttgccagagattagaaaaactggttcttataatcctgcaacatagctgaactttgaagatccagtataagccgctattgcttgggcgtctgaatacaaagcgaaacggattgcacaagaacaattagccattgcagcgccaaaagccgaagcgttagattgaatagcagactgtgaaaataatctaggcatacgtgaatctgggagggtcctaaagattaatcaaaaaactttagtgcagtatcttatggatcataaggttgtgtatcgtgatcaattcaagaagatacaaggctatcaaaagtcagttgatcaaaagttgattcaagtaactgtaagtggtccgcgagaaaccgagaatggagaaaaggttttctcacaagtgaaactaaccccaaaattaattactcgaattgccacatggattgaaaacggcatgccgacaaaagccattaagaaataaaacagagggctaatgccctctattcttttaatgatgttttctgcatagtatggtagaactatttagcatttaaaatcatcttatatcatatatccatagttcttgat

SEQ ID NO: 657869 - DNA, 116 bp, Homo sapiens
  misc_feature (3)..(3): n is a, c, g, or t
agnagcgaaaataatgcataccgagaaaagcatacacagagcaataaaaaaatcacgacaccaaaaacgacataacccaacagaacgaacagaagaaaaaaagacaaaatcacaaa

SEQ ID NO: 657870 - DNA, 1097 bp, Homo sapiens
  misc_feature (18)..(18): n is a, c, g, or t
  misc_feature (23)..(23): n is a, c, g, or t
  misc_feature (25)..(25): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaataacgttataaaattgcaaaactctcggagaacttgagtttcttcttcttcttcttctctcggggggagaagggggtggcccgggcaagcgcggggccccccgggggcggtgccggggccgcgggggcggcaacgcgggggccaatataagcaacgtgtgccaacctataacacacaaggggtgcccggcggcggtgtggcctttaatagcggcgcgggccctacaagagaacccccccaggggagggtgtaccggaggggtaccccgaggttttgggacgaaaccggggggtctccccaagacctagaggggccaaacacaattttacagaacgggggggacccagggggggaaaacgtattactacacgtgtggcgaacgttattttccccggggggacaccctaataagcgtctttttcaccagcgctaaaaaccaaagtggtctccacacacagtagccggccacgaggagggaatagaaggtgggtacccccaagggctttgtgggtggtgggccaaacgaaaccttcgttgtacaagcaaaactgtgcgcccacaggtatgaggagagccacagtggagtcataaattgccgcccacagaggaaacagga

SEQ ID NO: 657871 - DNA, 242 bp, Homo sapiens
ccagagaaaactgtgatacgtggctggattttagacagtcgtctagtacccactctcattagatgcctaggtctgctagcaagcccctccttccaggtctccctcacttcctatgtgaacattgcctgctctttccttgcttctaagattttctgattttttttaaggtttctttctttcttttcttttcttttcttttttttttttggaaacaaagttctcttctcggttggcccaggtgt

SEQ ID NO: 657872 - DNA, 213 bp, Homo sapiens
ccaacacaggcatgcacataaggaaggttaaaaaagtaaaaggaactcggcaaatcttaccccgcctgtttaccaaaaacatcacctctagcatcaccagtatttagagggcaccgcctgccccagtgaacacaagttttaacgggccgcggtaccctaaaccgtgcaaaggtagcataatcacttgtttccttaattaggggactcttaaaa

SEQ ID NO: 657873 - DNA, 535 bp, Homo sapiens
  misc_feature (18)..(18): n is a, c, g, or t
  misc_feature (23)..(23): n is a, c, g, or t
  misc_feature (25)..(25): n is a, c, g, or t
  misc_feature (479)..(479): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcnaaaaaaaacaattgaagcaccaattcctttaaggaattcaagcacaagacatcttg

SEQ ID NO: 657874 - DNA, 846 bp, Homo sapiens
  misc_feature (18)..(18): n is a, c, g, or t
  misc_feature (23)..(23): n is a, c, g, or t
  misc_feature (25)..(25): n is a, c, g, or t
  misc_feature (500)..(500): n is a, c, g, or t
gggcagtcgagagctcancggangngccttcgcgctcttcctttccaacttggacgctgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaaaaaaaaaaanaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatagaaacaaaaaaaccaaaaaaaagtcctataattaaaaactgggcgaactttaaaaaactacgagattccaaaaaaaatggcgtaacccaccttaatcactttggagaaaaccccccttttgccaaatgacagaaatactgaaaaagcccgaacttttggcacttccaaacataatggaaaccccaatgcctaaggaaaatccaaagcgttagttttttgtaataccggtttttt

SEQ ID NO: 657875 - DNA, 699 bp, Homo sapiens
  misc_feature (25)..(25): n is a, c, g, or t
  misc_feature (31)..(31): n is a, c, g, or t
  misc_feature (46)..(46): n is a, c, g, or t
  misc_feature (50)..(50): n is a, c, g, or t
  misc_feature (463)..(463): n is a, c, g, or t
  misc_feature (499)..(499): n is a, c, g, or t
  misc_feature (501)..(501): n is a, c, g, or t
  misc_feature (506)..(506): n is a, c, g, or t
  misc_feature (513)..(513): n is a, c, g, or t
  misc_feature (516)..(517): n is a, c, g, or t
  misc_feature (527)..(527): n is a, c, g, or t
  misc_feature (529)..(529): n is a, c, g, or t
  misc_feature (535)..(535): n is a, c, g, or t
  misc_feature (537)..(537): n is a, c, g, or t
  misc_feature (539)..(539): n is a, c, g, or t
  misc_feature (542)..(542): n is a, c, g, or t
  misc_feature (544)..(544): n is a, c, g, or t
  misc_feature (562)..(562): n is a, c, g, or t
  misc_feature (565)..(565): n is a, c, g, or t
  misc_feature (570)..(570): n is a, c, g, or t
  misc_feature (574)..(574): n is a, c, g, or t
  misc_feature (581)..(581): n is a, c, g, or t
  misc_feature (585)..(585): n is a, c, g, or t
  misc_feature (589)..(589): n is a, c, g, or t
  misc_feature (591)..(591): n is a, c, g, or t
  misc_feature (594)..(595): n is a, c, g, or t
  misc_feature (606)..(606): n is a, c, g, or t
  misc_feature (609)..(609): n is a, c, g, or t
  misc_feature (613)..(613): n is a, c, g, or t
  misc_feature (621)..(621): n is a, c, g, or t
ggggctttccaactgggacgctgcnaatggntcccgcaaagaaggntggngagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaaaaaaaaaaanaaaaaaaaaaaaaaaaaaaaaaaaaaaaaccttgtngnccgcntgggccnagnngattttagantngggcangntnatncntgcggccgaatttcgggntanttggnccanttggccntatngggngnggnnttacaattaantgnccgnggttttanacgggggggtttggaaaaacctgggcgttaccacatttaaacgccttgagaaaaatcccccttttggcaggtgggggt

SEQ ID NO: 657876 - DNA, 253 bp, Homo sapiens
  misc_feature (55)..(55): n is a, c, g, or t
aaccgaaaaagggccctttttttttttaagggaaaaaggccctttgtgcaaatcncccgttaaaggaaaaattttttttttttggcccattttttttttccccaaaaaaccccagggttttttcccttttttttccatttaaaaaaagtttttttatttttttttttttaaaccttttttttttaaaaagaccttttaaatttaatttgggtttaaaaaaaagggccttttcccttttttttcctttttttta

SEQ ID NO: 657877 - DNA, 879 bp, Homo sapiens
tcttaaaaaaaaaaaaaaattactaaggacctgtattagtcggttctcactctgctataaagaattgcccgaagctgggcgtggtggtcacgcgtgtaattcccagcacttgggaaggctgaggcgggcagatcacagggttcaggagtttcaagaaccagccgtggccaacattggtgaaacccccaatcggttaccaaaaaaaaaaaacaagacacaaaaagaaaaaaattttttcggggccgcatcggccctcacagaaaaaggttttcttaaaaacccatcgtgttttggggcgccgggcgccccggttggtgttatgtctacaaaccgtgtggccaagcagcgtggtcccaaaaggagaaccccggcgaccaaagaacactatcgaggtggtggtggtcctcccccccaaaataaaaaaaaacgcccgcggcggggaacaccacaggacggcttcggagccacaaccccaacaagcaggagggatccagaaagggccaatagaggggagcccctccacacacagcggtctaccaacggagcgcgacaagattatcaaattaaccccgcgacaggagtggagagaacagcaagacaaacacgataaaaagaacacaggacgaaaaacgaaggacaccacagagcaacggcaaaaggcaagaggggcgaggtcagcttcaaaacagaaaaaacataaaggacgcgtccaacacgagagatgacaactgccaaagaagagacgtaagcgcacacacgaccaacaaaaacaacgtagacacaacacaataacaagcaagagaggcatgacaaagacaaacgaaaaagacgcaacaactagaaactaagataaaacaaagaccataagactaccgagag

SEQ ID NO: 657878 - DNA, 981 bp, Homo sapiens
  misc_feature (490)..(490): n is a, c, g, or t
aactcaacaaactgctctcgctctgtctttacccattctggctcatcagtattcccatcatggctgtacatgtcaccaatatactcttctagatcaatgaaaccatcaacattcacaagcgcatccatggagtgggcttcaagaagcgtgcacctcgggcactcaaagagattcggaaatttgccatgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattgcaaaaaaaaaaaaaaaaaaaaaaaaaaaaaaaaaaaaaaaaaaaaaaaanaaaaaaaaaaaaaaaaaaaaaaaaaaaaaacaaaaaaaaaaagaaaaaaaaaagaggaggggaacaaaaaaagaaagcgagaggaggaaagaaagaaaaaagagaagaagaagataacaaaacaaaaagagagaacacaaaaaaagacgagaaaacaaacaaaaaagcagagagggaaggagagaacagaaaaaaacagaaagaaagagagagaagaagacaacaaagagcaagaggagacatcaaagaacagaagaacaaacaaaagaggggaaaaaacagaaaagaacaagaaaaaacacaagaggagaatagcaaaaagaagacgagcaacgaaacgaacaaaagaaaaaatagaaaagaaaaaaaacgaggacaaacaaacacaaccaagagacagcacaagagaaaaagaaacaagcggaacggacgacaagaagaagaagaaaggaaaaaaaagagaagcaaagaaaaagggaagaaaagggaac

SEQ ID NO: 657879 - DNA, 538 bp, Homo sapiens
cgagcggccgcccgggcaggtgcagaatggctcccgcaaagaagggtggcgagaagaaaaagggccgttctgccatcaacgaagtggtaacccgagaatacaccatcaacattcacaagcgcatccatggagtgggcttcaagaagcgtgcacctcgggcactcaaagagattcggaaatttgccatgaaggagaaaaagtgctgcctttttattcatcagtattgactcctaaggagcaggaggggattcagaagaataatctagaagagcttactgaggagctcaccaaggtgatggtggactacataggaatggagaatttctggaaaaggtacaacaaagtgaaactggagcaactgagcctccaacatagacgagcccagctgctagatatcaatgggaagctgcgggagatgtctgaagcagtacttggatggcatctcagtgagtgacgaagtgctgagccagctcaacccactctttatagtcaactatcaaagcaacttactccagcgtgctgataaacaaggatccgc

SEQ ID NO: 657880 - DNA, 380 bp, Homo sapiens
tttgaaaggtttattctattaaaattttgccaaatcctctggttttctgaaaaagctttagaatgggttctataccccttggatccctgcatttttccatatcatctccggttcggtcgcgtccagatggaaaacggaaacaaaggcttttaattgttgccttttctggctccagtgcaacccatccctctgaaaaccctcggaagtttggtgcttggagagggggcccttgtcttttggacataaggtcatgacgggtttatgtccaaagtttttatatattttttttataagctgaaaaaaggtctatttttatgtttttaggtctatgaatggaacgttgtaaatgcttgtccaaccataaaaataacgaaaagtga

SEQ ID NO: 657881 - DNA, 417 bp, Homo sapiens
ggaggagcacttgagcctggagaggttgaggttgcagtaggctatgatagtgcccctgcactttagcctgggcaacagagtcagactctatctcaaaaaaaaaaaaaaaaaaaaaaaaaaagaacggtttactgccctttataatcagaggatagaatttggggcaaaaatacctactggaaagtagaaatcccagacagagaaggagaaaggagtagcccaaattctgtatataattgtctaaatatctggctggcttctggaccatgtatatattcgtaggtcagactccaagcagctcagctaaggctaaataagctgaacgaagatttgagctgcaatgggtgtaggggtaggagattttgcatttgactccagcctgggtgatagagtgagactgtctccaaaaaaaaaaag

SEQ ID NO: 657882 - DNA, 864 bp, Homo sapiens
atggaatcctttgcacgctacagctgacttcagggcagcagattgttaccgagctacaaagaagatgacgacatgcttccatcttcctacctgtgttggtaacaaactccagattttagaagactacaaagacaggcttctctgctacgaagaggcaaccaacacagagctgcagcagctggaactgcttacactacgctggcacaacagtctgctacacaacacgcagctaactgttgacaaggtacttctctttgactttaactgcagcagaaattcgacgcgagacacagatggcaagacagcacaacgaaacagacatggaaacaaccagaagaggaaacacgttctagccaacgagaatcacgacgaaacgatgctgcatatttataactcaacagcccaaactccactttccttcatcccttggaccgactactcaatacaactactacacttttatcaagacacttgcccaactggcacaggcatctaacttgcacctggaacatttacgttctaacaatctcttggccaacacctcggatcggttcattattcaccctacatccacgcgcactgcacaattggcgaccaactgccacatgaaacaggttccaaacctttttaacacttctcaaacaaagcgaactattctaatcaatgggcctctccaacccacaaggaaaaggtccaaagcagcgttccacatacctttcaacttctccaattacactttggcccctttaaccacatttctaattcaatgcggatccccgtgaagcactagcttacgccgatggctcaacgccctagggtgcttcaacctaagggggtccagtgcccctaaacctttggaacacc

SEQ ID NO: 657883 - DNA, 148 bp, Homo sapiens
cagcaacagctgctgatcgacccttacgctaagcaactggtgggcgaacgtcaatagtggtcctgcagcgctgtttggctacatcatcggccacccggagcgatgaccctctagttatcgatgaagcgcgactagtgcgcccgttcgt

SEQ ID NO: 657884 - DNA, 661 bp, Homo sapiens
aaaagaaaagaaatgatcaggaaaagataaaacaaagaacaagcggaaaagaataaagtaaaatgggcattagacacgtgataaagcagataggcatatcccactaaatgtatagatacatatacagaaatatacataaagacagatagatagcatacagagaattagagagacatatagatatagagagagatacagagatatatatatagatatatagatgaggtcagaaagacagtaagaaaataggatggaagaggaagtagaaagtagacggtagaacatgaggaacagcagcctagaaaaatcacaggtacaaaagagatcaaagaagaaagatcgtaagaatatggaagataccaaatcaggacaaggtagaggtacacagtcaatgcgaaagtcagaggatagaagtaagtatagacatagacagacaaagaaaagggaagaagtagatggagatgtagtagagaaagagagagagaagatagagtacgagagaacaaaacgagattaaacagatacaaacgcactctctctctagactcgcactctcactagctatctctatctctatctctatctctctctctctctctctctctctctctctctctctctctctctctctctctatctctctctctctctctctctctct

SEQ ID NO: 657885 - DNA, 256 bp, Homo sapiens
cgggggggggggggggggggggcccccccaaaagggtccccctcccccgggggttttaaattggacccccccccgggggttggtccccggggggggaacaatccggggagcgtccccccccccagagggattttcccccccgggtttgggggggccccccggggttttttttggggcctccccgggtttttgggccccccccccgggccccggccaaacccccccccggaaaaggcccaaaaatttgggggggtta

SEQ ID NO: 657886 - DNA, 874 bp, Homo sapiens
  misc_feature (707)..(707): n is a, c, g, or t
tgagttgtgaaaacctccgttgggcgcgctgtgcggccggaaaccccccgggtacacaggggcaatcaacacatggggggcccaccgcacagtggggaaaagccagacacaaggccaagagggcgagacaaatggtcccctgcgccggactctaagtcttggtggtaaaacgcgcgcccaagtgtgtcggcggcccacgcgaccctcagggcgggtgggccatgtaaacgcggcgggctaagcagccagatatgggccccaacgccttggggatgccacgccagacgccgcacagaccttgttcaagagggggtgcaaaacggttgcgtcaaaagcagtttcggagggcccttcttcttgacccaggaacagatgtgtcttcacatgataggtgtaacaagttgtcgtagagtccctccagagatctgttgtctagcgctgacccctgctaacaagtgtggatgcctgttgggtttatcacaaaatccgccgaattgtgtgcgatagaatctcgcccacccctcttatctttaataagggcggccaacaaattcgagccacactttactggtatataagaggtggtgaccgaagtgtattaaccacaacaagatggcgttgtaacagaatcgtgtccaccgcagtttggtttccgctccacgcggtgccgccagttaaaggcgaagcagtgcggatgttgagcgggncaccatctttcttacagagcacaaatgcgtgttataaacgcttccagaacagaggtaatatcttcagctagtgctcaggcatgcagactaaaatcttttttcagaacaccggccacaagttcttaagctcttagaattcacataagaaaaatttttaccccaaaaca

SEQ ID NO: 657887 - DNA, 203 bp, Homo sapiens
cctctctcctccccccccccttcaagtatggactaggttagagaggaatttgtgtaaagacaggtaggactgggaactgggaatgccctgcacagccttcccatctgaagacagtcctatggattctgtgtgtctcctcctgctgaaatgatggatggataaaccttcatgagtgaagagattacagtggtagttaggcttcc

SEQ ID NO: 657888 - DNA, 733 bp, Homo sapiens
  misc_feature (11)..(11): n is a, c, g, or t
  misc_feature (43)..(43): n is a, c, g, or t
  misc_feature (70)..(70): n is a, c, g, or t
  misc_feature (94)..(94): n is a, c, g, or t
  misc_feature (158)..(158): n is a, c, g, or t
  misc_feature (161)..(161): n is a, c, g, or t
  misc_feature (164)..(164): n is a, c, g, or t
  misc_feature (166)..(166): n is a, c, g, or t
  misc_feature (170)..(170): n is a, c, g, or t
  misc_feature (186)..(186): n is a, c, g, or t
  misc_feature (273)..(273): n is a, c, g, or t
  misc_feature (278)..(278): n is a, c, g, or t
  misc_feature (285)..(285): n is a, c, g, or t
  misc_feature (376)..(376): n is a, c, g, or t
  misc_feature (403)..(403): n is a, c, g, or t
  misc_feature (534)..(534): n is a, c, g, or t
  misc_feature (546)..(546): n is a, c, g, or t
  misc_feature (570)..(570): n is a, c, g, or t
  misc_feature (594)..(595): n is a, c, g, or t
  misc_feature (628)..(628): n is a, c, g, or t
  misc_feature (639)..(639): n is a, c, g, or t
  misc_feature (646)..(646): n is a, c, g, or t
  misc_feature (660)..(660): n is a, c, g, or t
  misc_feature (663)..(663): n is a, c, g, or t
  misc_feature (671)..(671): n is a, c, g, or t
  misc_feature (720)..(720): n is a, c, g, or t
gcgctggcaanatggcgggagtgggtgcgcccggtgagggggntccagggccttgtgtggcgtgctggtnttcctctggcagttctgcattctntcgggcggtgataagtactgaaatcccagggttatgtgatgaagtgtcggagtaatggtttgtntancangnttcntgaagactgtatagantgtgacaacaaatttctcgctgtagctatgggaagcctgtcacttttgactgtgcagtgaaaccatctgttacttgtgttgataaanaattnaaatacnaaaagaacttcatcattaacatgacttggagattttgctggtagcttcctgaaacagattatgagtgtaccaactccaccagctgcatganggtgtcctgtcctcggtaggcgctacnctgccaactgcaaggtgcgggatcacgttcattgcttgggtaagcgtactttttccaaaatgctatattgcaattggactggagtgctataagtggtctacggctctgagctctaagcatcaccctcggtnggtttggagcanatcgtttctacctggggcagtggngggaaggtctcggcaagctcttcnncttcggtggcctgggaatatggacgctgatagncgtcctgctcnttggagntggctatgttggancancagatggntctttgtacatttagctgtggtgtgtgcttcaaaaaggagcagggcttngaaaaagcccttt

SEQ ID NO: 657889 - DNA, 110 bp, Homo sapiens
ctttgggtttggttttttggttttgggtttaattttgtttttttccaattttttccttttgaacctgggaagttctttcgggccgaaaaataaagccccctttggcccca

SEQ ID NO: 657890 - DNA, 145 bp, Homo sapiens
ggaccccctatcacctggtggtgctggtcgacatcctcatgggacctgggcgcttttggcccgcaactgttcgccgagaaagcaggctagacgtcgccaagtcggtcacctaaggcctgggctacatgcactgcctgcctcaacc

SEQ ID NO: 657891 - DNA, 110 bp, Homo sapiens
gccgcaagtaaagcttagccgatgcccccctgctgccgccactgctgtgcctccccgccacctgtgtgtcttttgatacatttatcttctgttttactcaaataaagttc

SEQ ID NO: 657892 - DNA, 167 bp, Homo sapiens
  misc_feature (65)..(65): n is a, c, g, or t
cttatgattaactaagcaaatctttcatagaaagatattatcaaagctgaagaaatgcaaacttnaacaaagtgccgtgagattccggaaaaacccttaaccgattgaatggttttttaagaataaaaaagaagtctgatactgaactacaagtcgcaaggaacatc

SEQ ID NO: 657893 - DNA, 337 bp, Homo sapiens
gccggcgacaagatggcagcagcgtgtcggagcgtgaagggccttgtggcggtatacccgagagccttgccttggccttgccacggcggacgaactttttgggcagggagcctcttctgttcttcttgacctctcccaactcggggtgggggaggcccaagccaagaagttaggacacaacttcgttttcgccccaccaacgtgacctctcagaagggtgtacaaacagctctcgctctagcaaaaggaaagtttgggccctttggatttagctttcaactgtacaggaatcgggggggctagcaagacgtacaacttaagggggggccaaccccta

SEQ ID NO: 657894 - DNA, 275 bp, Homo sapiens
cgaggtagtggagatactgatagtgtattgctgatgagcgactggaatatgctgatgcagtgaagcgctttgtagacaagagatcaagtcccggcgttgttatgtagaaaagaacgttaattgtttaaattatagtttaaattttcttttgaaaatgaaccctaggtagataaaggaatctccttggcttctaactgcttttggtggtggagacaccacctgatgtcacccacggacacgttttcatccacctgtgaccagggagcttcagggag

SEQ ID NO: 657895 - DNA, 320 bp, Homo sapiens
  misc_feature (18)..(18): n is a, c, g, or t
  misc_feature (278)..(278): n is a, c, g, or t
  misc_feature (295)..(295): n is a, c, g, or t
gagtgactctccaggatntctttgcgatggaatatgacccagcaattcagacgcttagcatgacgccatcaacgggcatgatccgcatgcttatttgaaggacgtgctcacgcgcctgccgtcgcagcgggcgagtgggattgaagcggctgggtcctacgcaattttgattactaccttaccaaaggcgcctctggccaaatgttcgtacgcttcgcgtgcttgatcaaatggatacacgtggtcgattaccgggcgaatcttgtgctcgttcattncggtcaattccatcgcnaagagatcctgtagatcgacccgct

SEQ ID NO: 657896 - DNA, 495 bp, Homo sapiens
ccacctcagtctccggggtagctgggactacaggcacaggccactacgccgggctaattttggtattttggtagagatgaggtttggccatgttgcccaggcgggtctgaaactccggacctcaagtgacccacctgtctcggccttccaaagggcggggattacaggcgtgagccaccacgccgggcccaaaacgggattttttggatcttcctctccaaaaccggccttaccacggtgttccttaaacaacagaaagacaacaccggtggccatacagtacttaaactagaaacttaggaatcatccttacctctgcctcccgggttcaggtgattctccggtctcagcctcctgagaggctgagttgatgttccccttccggtgtctatctggtattacaggcgtgtgctaccatgccctggtaatttctgtatttttagtagaaacagggttcaccatgttgccagggtggtctcaaattctgactcaagt

SEQ ID NO: 657897 - DNA, 339 bp, Homo sapiens
gtaatacaaacattctcgaagtaccagtggctgaaccatcatcttccccatgtcatctgaacaggacccgatacgatgtcacttggtcccaactggatcctttacttccaccaccaaatttccatcatagacagaggcctccagaactattcgttgatttcccggccatctggtagtttatactttcgggaaaagcttcttgagaaaacccgcacctcatccattctggtccctttggtgctttatcagtagccagctttcgaaggtttaatgatgatgcttcaggggggactggccaacgccacaaggttctaaagggggattccttctcggggggcg

SEQ ID NO: 657898 - DNA, 356 bp, Homo sapiens
cgaagattcaatagcttggaaccttagccatgagatagcaatacaagcttgccagtttttgccccaacagataatccaatgaaggctgtgaaccaaaattttggctaaagcagtctccatggcagtttgatttttaaaggccaaacctcccacgacttcaaagcagggtgtcacatgttaaccagggcccctgcttagagctgcagcacaaaagcctggatacatgcaactctattccactttccaattcaacagtaaacttcagattccaaacaatgttggggccaaacagcattgcaactgcggagagaaaattctaaggagggttagacctcagaacctttgacaagagcatc

SEQ ID NO: 657899 - DNA, 167 bp, Homo sapiens
tatacggagatttaaagaagccaatgtagaggtagaatgtatgttattttattattattttttgagatggagtttcgttcttgctcgcccaggctggagtgcaatggtgcaatcttggctcactgcaacctctgcctcccaggttcaagaacgaaactccatctcaa

SEQ ID NO: 657900 - DNA, 232 bp, Homo sapiens
tatgctcagttcttgcttaaaccatgcagtggccacccttgggctcagacactctctgggtcttttgaccatcaatgccagcccctcgctctctgtctgcttgtatatatcttctctgccccaggactgctgggtggcttcctccaacgtcttccaaggctcacaagaaatttggctccatcttgcagcctgtgtactagacacaggtctcaagtatgggtatggtgtgagc

SEQ ID NO: 657901 - DNA, 136 bp, Homo sapiens
tcagaggatcccagagacacaggtgaggatgcagggatttgggagcagtggaagagggtgccaaccttgggttgggaccaacccttggtcgcagtcaactctgcttcccgcattcctgctccacgtgtcccagctt

SEQ ID NO: 657902 - DNA, 230 bp, Homo sapiens
tgagagtcaagctgaccatggcatccctgggtgcacggcgacagcatgggcctcacctcctctgtgatttctttctttgcaccagagacatacagtctccaacatgtttctgtattggtatagtttgattcagcaaacaatctcccagtagacaacatcgacaatagttttttacttactacttaggtagctctgaggaatagggagagggggtaggatagtacaggggg

SEQ ID NO: 657903 - DNA, 874 bp, Homo sapiens
cctacgcattataatctttttatcgatgtttcatctttatagaaagaggttccttttagggtacaacctataggtcaagtgatttacgcaatatatctagcgtcgaatgttcccccgggaagaaggttacaaaggggaaaggtaccggaacgacgagccttaaaacgcatttaagttttcgaaagataattcaaggtagggacgccttcaaaaccccgccagggggtttttaagaaccttggacctttacagacacgtatgtcgccccggggtagtacttaagcccttttttggcaaaagccgttctgttgccccaactggtttacatcctagtaaatggctaatttaagcccaattgttagggttccacgtgggttcttaaagaattcatggttacgcagatgtcttataccttgaaactacctcaacttttctaattacagcaacgtacactagaaacctttctctgaatttgcgatatcgaagtattaccaggtgcactcatagaccctgtaggaggtattgtatttgtagcacacctatgcctagacctcaggaataagaatactactctcataaatgggtgggagtattttggtgacaacatacttcttgcttaggcttgagtgaaggaattgatattcatatattcatttacttccatggacatttatgttagtgctttttatataccaggcatgatcgctgagtgacactcccttgtgtatatttccaaatttttgtatagtcgctgcacataatttgacatcatatattaagactttcccaagatgaggtcctggtttttcatggcaaatgatcaggtaaggatttcacatctgttgtaactattaccatctagtatatgtagaca

SEQ ID NO: 657904 - DNA, 135 bp, Homo sapiens
cctttcctctctcctcatttccacattaggaggaaaaagagtgattttcctttcctcctcccagtaacatttctgactgaagtgttggtctaagactgcgaacaactcaactccgtgtccaaccagggggtgttg

SEQ ID NO: 657905 - DNA, 305 bp, Homo sapiens
acagctcctgatcaagtttcaagcccataggtgcagacagaaagcaaaaaacggatagggaaaaaatggagaaacgaacacctcatgaaaaggagaaatatcagccttcctatgagacaaccatactcacagaggtgttctccatgagcccgtagatcacagtatgtcaagtaactcccacatcaccgtggcttcaacgagttcccattacgcagtttttctctatggggaagcgaaagtggttcaccgaaacgcacctagccagacgccacccccgtccagttcacatgataaccttcttacca

SEQ ID NO: 657906 - DNA, 277 bp, Homo sapiens
ccttatcgccacacagaatgatctggctgggtagttttcctgctgtgtaatattgataataagacgtaatactgttttaatgaaaacagttaatattgaattatttagtaaaataaccatatatttaatcttaaggtttctactcacctaaatatctgaaattcacaggctataaaatggttgacagggaaataactttacatgatgactcacagttttcataaataatgcaggtaaactattaatataaaataattaggtgttggggataacatca

SEQ ID NO: 657907 - DNA, 159 bp, Homo sapiens
  misc_feature (56)..(56): n is a, c, g, or t
tcgacactctgttgtcagtgggctgtgaactgaggaatgtgtcgttgctgagtatnagattagggccactgactacagagagaagacaggctgttaacattctcttttaacttgagtgtaagggtgggggtcacacctttgcagcaactttaagaagga

SEQ ID NO: 657908 - DNA, 281 bp, Homo sapiens
  misc_feature (33)..(33): n is a, c, g, or t
ccccttcacccaggaaagtgcgatcttttagtntcgccttgccgccgcccctcggacggccgcgacccagccaaggacgcgctcgcctacactccccgacacggtctggcgtaatcgcgtcgagttcccccgtggtcgtgccgaggtccaggcagttctgacccgcaagtggaaccatgaactggaataccgcctgatcaaggaactgtgggcattcaccggcaaccgcattgccgtgcgctatgcctacgagtaccacgacgatagcggccagtggttcc

SEQ ID NO: 657909 - DNA, 1928 bp, Homo sapiens
cttcgtgtgacgagattgcctggcgtgagctccgggtgggtcaacgtgtgtctgtggggctgaagtcgcccgtggctgatacacacgcattcgccagggctctgattgcccggcatcacttgatggacgcacccaggtgatccgaggcactaagcagcgcacattatgacaaggcgttctcgtgaagacatctctggtgcttcacacctaatccacgactccaagaagaaattgtgcgtaactatgccacgtggtctaccagatctcaccctgacgaacgtgcgtgaggctcaaggtcagatctggagtgagtctatggacggaacagcaccggaacagaggccgggacttggcgaggctaagggtcgattgacatgattggtgcttgcccgtcgcaacgctaggacgcatgcagttccggagctgaattcggccattctgcagagccttgcgggctcccgggatcgtgaacctggagtgcagtgtacagagagcctgagacaggctgtaggcggagatggagaacgctgcatggcgtggacgtgttggagatgatcctgtcgcagtgagaaggggccgagtgcctgagcgcctcacgcaaagttacctacatcatccagatctggtggcttttgagacatctttcactttcgagaaacattgtcccactggagaagtttgaaagtctaggcaaaaacggtgtatggctggggttctggcagagcccatttcctcagggtcaagctgtgtgactttggccctcggacgcgatccccggcaacaatgatccgccgatcagtggtaggacaccccggcctacttgacccgagggtggcaacccgggtaccgcccttgaacatgtgagtgggtaaagaagtaccagaggaccctacagaggagagacagcaacagagcgttagtgccacgacaatttggaacaaacaagagtgcacctgtttcctatactccccctcctctcgtccagtcttcttcttctcctcgaaataaaatcaaactcaaaacaaaaataaaagaaacaaacacaaaaaaacacacacaaataaaaagaaaaagacaaaacaaacagaaacaacacaaacacacaaaaaaacacacacaacaaaacaacaaacacacaacacaacaacagacactaaacacagatgataaaagacaaaaacaaaggccgacaagcggacacaaggacaagaaggaaaggcacggaagagacacagacaaggacaggaagagagagagaaggagagagaagagccgcgggaggccgcgaggagacggagaggggggacaggaaggccgggcgcagaggaagcagaacaggacaggaggagaagcaggcaagggagaaagccgcgaccagccgacccagagaaggcgcagagacgagcagacggagaggaaggacgacgcgacgagaaggcggagcagagagagaggacgcagacagagaaaagagaacagaggaaaagaagaggacgagcgaagagagaagaggaagataagaataggacgaacggagacagaagaggaagagacagagacaaaggaaacagcgaggagacgacagagagagagaggaggaaggcagagagaaaagaggagaacaaagaacgagagagcagaggagagacggaagaacaacagagaacggacgcaaacgcgagcagacagaaagagcagcgggaagaggagagacaaaggaagagcaagacagagagcgacggaacgaggcgaaggagagacccaagcaggagagcaagagaacagcacacgagaagaaaagagagcgaagaagaacaccagacaagaatgacgagggagggcagaaggagagagaagcagacgaccgagagcaaggaggcaacacaagagaagaagagagagacacgacaaggagagcagagagacgc

SEQ ID NO: 657910 - DNA, 202 bp, Homo sapiens
  misc_feature (91)..(91): n is a, c, g, or t
  misc_feature (97)..(97): n is a, c, g, or t
gcgtccgtgcctttttaaccatttttaagaagtggaattgctgggtcatgtggtgtctgtgtttactttttttgttggtttgtttgagacnagtctnactcagctgcccacactggagtgccgtgggacaatctcggctcactgcaaccaccatctcccgggtattttagtagaaacggggttttaccatgttgccaggctg

SEQ ID NO: 657911 - DNA, 636 bp, Homo sapiens
cccgcgtaatccgtaccaggggtacttagaggtggattctttgcatgccggattcaaagccttatcaggcacaaattctaccaacctaatttctaccgattaattacctattagctcatttgtgaagcatttcccctccctatcctttctggtttttgactctttctaaatgaccatgcatatgaggcctccaatctcacaaagcctacatgcctagcttcttccaagcgtcactccatctaatgtcatttgtctctatagtaaccaactagaaaagctgctatgcttagtaatggctttgtacgagcagtggtctagcctagagatgttttaaagatttgagtcctctctaccgattactgttttttttcctggtattaaaagtgaacctctgatgaatgagagcagtagagggttagagagaaaaggatggaatatattataaaacatgaaggaagatggactgcaagtagagacttgagttcaagaggaaacgagtttagaaagaccttgattgataagaggactaagaagacacagacaaaaaactaggtataagaaacagaaaataattattaggcatttcccttcaaaatggtcaaaaacaacataatgatgtacgatttagcactgacg

SEQ ID NO: 657912 - DNA, 498 bp, Homo sapiens
gttgagattattcactagaaaagtatagtgaatggttggaatctacgtgtatgataaagatgctacaaagctaccagtattagttagccactctataagaaatttacttgttttaaaaaaatccaaatgctggcattgtccagaaaaatttaacaggtttatttataattattataaagttgaaccgctgaaacttgttcactgaaacattttaacttgcattaatgctttacgtctccgcatttatattaaaaattcacacacaaatgaaaatggaaaaactgccaatacctgatttctgtcccctatttttccactcgcaatcatatacttaggtaccttttgaccccatggaaaaaaaatatctaacgttcagaactaccaataacaggaagaagagaaatttttttttttttttggagaatgaaatgtttcccatcataggggattcttaagcacgttctccacgtatgcggggtgctagctgaataatctcaa

SEQ ID NO: 657913 - DNA, 183 bp, Homo sapiens
gacagagcgtggcccagggtggagtgcagtggtgcgatttcagctcactgtggctcactgtaacctccacctttcgccttccgctttcaggagacttgcttgaacccagcaggcagaggttgcagtgagccaagatcgtgccattgcactccagcctgggtgacagagcgagactccctgtca

SEQ ID NO: 657914 - DNA, 305 bp, Homo sapiens
atacataaagacaagaggcttaattgactcacagttccacatggctggggaggcctcaggaaacttaacaatcatggccaaaagcacctcttcacaggccagcagaagagagaatgcgtgccagtaggggaaatgccagatgtttataaaaccaccaaatctcatgagaactcactcactatcatgagaacaggcccaatgattaaattatctcccaccagttccctcccatgacacatgggaattatcgggattacagttcaagatgagatttaggtgaggacattctgaccctggcccctccc

SEQ ID NO: 657915 - DNA, 369 bp, Homo sapiens
  misc_feature (29)..(29): n is a, c, g, or t
  misc_feature (36)..(36): n is a, c, g, or t
  misc_feature (60)..(60): n is a, c, g, or t
ggaatgtggcaagccgttcgaaagggcanttgaccnaagatgaatatcccatccgggccnagcatctggtcgaggctatccccaataggtcgcttccagttcttcctcgacttcagggttgaacgcgcttgcggttgtgatagtgaatggaaagcccgaaagccttggcgcggcgggcgacagccgtgccgatgcgtcccatgccgacaatcccgaggcgcttgccccagatgcgccgtccgagcatccaggtcggagaccagcctggccattgtccgtgcgctcgcccagcacattggcaccttccaccaaacgtctaggcacggaaagcaaaagtgccagggtcatatccgccgtgtcttcggtcag

SEQ ID NO: 657916 - DNA, 346 bp, Homo sapiens
ttcctaaatttattttcataaagatacagttcgatacaggaattattacgagtaattcttttttgtttctgtttataatgaagaacactgtatctacattttcacaagttaacatcaagccatcaaacctgggtatagtgcaaaaaacgtggcacacactgaccacacattaggctgtgtcaccattgcgtggtgcacctgctgtaagaattttagcttgctacttgcagacacaatttcagtgggaaatatgccactgaccgatttttttcttaatttttgcaatggggataggacaattgattccacaaagtatttttttcttttttctcagccccaatttgaa

SEQ ID NO: 657917 - DNA, 411 bp, Homo sapiens
aatcaggctcggtacccggagacatcttacgatgcactttgagactgccattagaatgtacaatgaaagaaaagacaaagatatcaacccacaaagcttctacagaaggaacccgtcaaggcacttcctctatgtggaatgtcgacagacaagttagcctactacggaacacagtcgacttctcgtgaaggtttaggagaagatatgtatcaggtgcgctgttatttggagtgttctactattatccttgcgtgatcatgctatactccgatggcttctgtacccctagacattgaccctggctgcctctgggttgctagccctggagattgatttgttgtcagccgacgattgtttccgtcgtcctctgtacgttctggtccgtcgttccctctgctggggcgattccac

SEQ ID NO: 657918 - DNA, 479 bp, Homo sapiens
gctgtgttggatgcctgagcaaagcgctagccaggcgcaagcgcgcacatgactgtatgccatccgaaggacacccctggcccgccggccaccgcggaggactcccctggcggaatcgcctccggatcgccctgcagtcggggggacgttgttgaggtcgcgcaaggccgatccgggtcccggtaaggaatgcacacaccacggctcttaaggcgaacgggctgtgcaaagaaagacccgtcatgtatctaccgctcccggacaggagaggacgtcatgaacagacacggagagattgcataccacgatgacaaagcagttgatcacgggcgtaactgtattccgactgagaaaacacccaagaccaccacctacactgttgaacatcccgcactacaagtacccaagcataaacaaaagctccgtcgtaggatggacttccaaccgcacataacgaaaggagaacaagagcaagacgg

SEQ ID NO: 657919 - DNA, 159 bp, Homo sapiens
  misc_feature (4)..(4): n is a, c, g, or t
  misc_feature (10)..(10): n is a, c, g, or t
gggncccaanccctagtgtccctgccccatgcctttcctttagtggtgggaaaccctttatcttgcaaagtgaatgtgccccttccccacccttcttagtgtatttcacagaaaacaaaacctcccaataaaacgggttgaaacctgaaaaaaaaaaaa

SEQ ID NO: 657920 - DNA, 712 bp, Homo sapiens
tggacgcgtgacctatgtccatcgccatgcttggctcacactggaagaggctggaggaccagaagggctcacactgtgcactcttggttctccttgtcttgacccacatggtgatttgctagcgatggcgtgctccacagtccccattcatcgaaagcatatactcaacgagctcaaataccagtgtgtccctaccaggcgttacggattaatgttcatcaggcttccatctgagactggaatgcatgggtaccatagcccctgcccaggagccgtaccctcggaccacagtggctctgtatggccaggaactgggactcgagctttcagattctcaagctagccttgtgcaaaacagctgtaggtggcctccctgacaacagacactcagcgcctccccaccctgagctctcgcttgcgattttcccgcgatgctccccgaccccatggcaaaaggctggccatgctctgttcccagcagaccgcgcaggtttccccacgtggctgcaatggacctaccaaaagccatgttgcatatccgttgtaagcacgtgccctgtgccctgtccccattccttatgccctaggaggccaagctggtgtctctacggagggcccacaaaggcaccctggatcccccagagagtagattggtgtgctcaggccgcaaggctgactcagaggtagggcagtgggctctgcaaggcacctg

SEQ ID NO: 657921 - DNA, 802 bp, Homo sapiens
agggagagcagttttgcaatgggaactcctccgtctaccttctggtgaaatggggtgctggcatctgggtcattctgtaaccacgaaacacaagatgaaatgccatggggttaccaggagggcgaggagagatgacctgcagtcaggatctgaagacggctcctggagggaaatggggtttggaacacagttggaagggctgaagcaagatgtgagagccctgtggagagaggaggtgtgttctctctctcacctcagctgaacctgggctcaggaagctgaaactcctccatgtgaatcctggttctctcattcatcacctgtgtggcgggacggtgcttttaggtcaccaagcctcactacactcacctgtaacatgaagatgatgatgcctacctcctccgactactgtgcagatttaatagtgcatgggacaaggcttcccatatgtttggcacacagtaggtgctcggtacacagcagctaacagtcacgatgtgcatgacactgttactcaggtggccaccctcttgggctcccaggtcatcctaaatccctctctctcttcaccatgtctatccaaagcatcagcactcatcaaacaactgtctcctcaagttgccccctatttcaaattcccactgctcctgcccatattctggccacatcacctcttactttggacaattttaaagcctcttgtctttgtttccagttatttcctccacctgtctcttctgcaaacctgggctactaaagtggttttcaaaacactgctctgctaaaatcctcaagtcatcct

SEQ ID NO: 657922 - DNA, 341 bp, Homo sapiens
caggatcttaacagcatcctaaccagtacatcgcaagatgtgcggcatgcctggacgccaccagcagtccatccccgctgtcctggagatccctccaagagcacccataattacgcgccaaggactccatcctgcgcaggccagggcgcatgttcacttgccgaagacctgcgctagggggactcctcaatagccctcagcccttccctcgtttccaggcctctccccaggcttgccatcatgccttctttactttttgagcctctgaatttccaattccctgctccttcccactccatataagaggctaggtgaggcgcaactaggttgctgggcttctg

SEQ ID NO: 657923 - DNA, 116 bp, Homo sapiens
gtctagccgtgcagtgcacgagacaccaaactcactgtggctaggtctcggcagcatcctactgcgcctggcttgcccaagtatggcacctaggctactgtgggcggcaagccacc

SEQ ID NO: 657924 - DNA, 691 bp, Homo sapiens
  misc_feature (10)..(10): n is a, c, g, or t
  misc_feature (36)..(36): n is a, c, g, or t
  misc_feature (51)..(51): n is a, c, g, or t
  misc_feature (77)..(77): n is a, c, g, or t
  misc_feature (82)..(82): n is a, c, g, or t
  misc_feature (89)..(89): n is a, c, g, or t
  misc_feature (92)..(92): n is a, c, g, or t
  misc_feature (94)..(94): n is a, c, g, or t
  misc_feature (102)..(102): n is a, c, g, or t
  misc_feature (109)..(109): n is a, c, g, or t
  misc_feature (124)..(124): n is a, c, g, or t
  misc_feature (139)..(139): n is a, c, g, or t
  misc_feature (156)..(156): n is a, c, g, or t
  misc_feature (172)..(172): n is a, c, g, or t
  misc_feature (174)..(174): n is a, c, g, or t
  misc_feature (178)..(178): n is a, c, g, or t
  misc_feature (187)..(187): n is a, c, g, or t
  misc_feature (189)..(189): n is a, c, g, or t
  misc_feature (192)..(192): n is a, c, g, or t
  misc_feature (202)..(202): n is a, c, g, or t
  misc_feature (208)..(208): n is a, c, g, or t
  misc_feature (214)..(214): n is a, c, g, or t
  misc_feature (217)..(217): n is a, c, g, or t
  misc_feature (230)..(230): n is a, c, g, or t
  misc_feature (236)..(236): n is a, c, g, or t
  misc_feature (246)..(247): n is a, c, g, or t
  misc_feature (250)..(250): n is a, c, g, or t
  misc_feature (256)..(256): n is a, c, g, or t
  misc_feature (286)..(286): n is a, c, g, or t
  misc_feature (289)..(289): n is a, c, g, or t
  misc_feature (300)..(300): n is a, c, g, or t
  misc_feature (304)..(304): n is a, c, g, or t
  misc_feature (310)..(310): n is a, c, g, or t
  misc_feature (322)..(322): n is a, c, g, or t
  misc_feature (328)..(328): n is a, c, g, or t
  misc_feature (334)..(334): n is a, c, g, or t
  misc_feature (360)..(360): n is a, c, g, or t
  misc_feature (381)..(381): n is a, c, g, or t
  misc_feature (391)..(391): n is a, c, g, or t
  misc_feature (413)..(413): n is a, c, g, or t
  misc_feature (415)..(415): n is a, c, g, or t
  misc_feature (422)..(422): n is a, c, g, or t
  misc_feature (433)..(433): n is a, c, g, or t
  misc_feature (457)..(457): n is a, c, g, or t
  misc_feature (460)..(460): n is a, c, g, or t
  misc_feature (463)..(463): n is a, c, g, or t
  misc_feature (473)..(473): n is a, c, g, or t
  misc_feature (477)..(477): n is a, c, g, or t
  misc_feature (490)..(490): n is a, c, g, or t
  misc_feature (496)..(496): n is a, c, g, or t
  misc_feature (508)..(508): n is a, c, g, or t
  misc_feature (541)..(541): n is a, c, g, or t
  misc_feature (592)..(592): n is a, c, g, or t
  misc_feature (603)..(603): n is a, c, g, or t
  misc_feature (609)..(609): n is a, c, g, or t
  misc_feature (662)..(662): n is a, c, g, or t
tagcttttcnagagcgatcttttattttctgaaagncccaaaaccgacccntttatcaaaagatgattgaggccccngtccncaaaccntancnttttcccnttcagcnaatcccggggccccnagggggccgccgccngagtgaaggggggacancagaacccgccccccncncccnacagccggncngcngccccccgcnaggccngggggntgngcccgaccccccnctgggncagagtccgnnccntggggngggacgggaggcgggagcagtggcggggcntgngcgtctttggntgtncaaacntgtctatgagancaaccntttccnccagggcccccccaattgttcggacnaagtcaaagaaatcattttcngcgtaattcncagagggcaaccagaatgaaanancattgancacagccgganatttgctaagaggctgaaacttcnccntcngattaatgtngganacacagaactgcntcaggnagcgcccgtccncacaccagaagagacggatatcagggatgtcgnagaggatcatggccagcctttctaatcctaggccaaaagcccagccgattnggtcttgagcnccagcngaattgaccagttgttgttccatcaccccgcagccaagaacttccagccattntccatgaaagttgatctccatctcaaagg

SEQ ID NO: 657925 - DNA, 384 bp, Homo sapiens
ccagttcacatgtctttacctacccgggcatccttgtgaaaaaacgcacagttaattgaggaaagtaagagccaccctcaaattaaaacctaaaaggacccacacacattgtattgtagagcatttttaaaataaaattccagttagccctaattacctacacccattcttactctctccataatgcttctttacctgttagaaaaaacctgtagcacaaaaccatgtaataaccatgcaccctactcaaatagcttgcgctttctaacttaaatgcccaaatttgaagattatataggcaccacagtttccctttataatactctattcaatagtgtcctataaggttctctgactatataaatctctgtcacctctcgtgcc

SEQ ID NO: 657926 - DNA, 629 bp, Homo sapiens
aggctgaaggtttacaatctgactggatattatcttggttaatatatgaaatcctgagtggggatcccatttggatacttccaggtcaacgcttccccgtaggttcaaacaaaaagagtatagagtcagcatgaaacagtttatcctgtggatggactccactgctcctctccactagttcaaatgcaaagggaaagagttactccagcagtgtatgtatggagggaaaaacattattagattatcatcttgcagagattagtgttaaaaaacaatgcagctatagattagccctcatgataatcacatcttgagcgaatttcaaaagccaacatgtggaatcaaacacactatttgccgggcaaaaaaactaaattacaaatttaactaaaccccaataagcagataacaaacaaactaacgtttggcagtactcactaattacaattgtaatatcagggtagtctcttgcacggaacaatcataagacgaatacgtcgtaaaggtaataacacaggcaaggaatgatgtgtcacagtaatacttgcccaaacattacattgatcgatatttgcatactcttacgaagctcaatccacacctgtactagcctcaatttctcataccta

SEQ ID NO: 657927 - DNA, 960 bp, Homo sapiens
gctggtcccctggcctctcttcgtcctcatcctctgacagcgtgtggccttgtgggaaagccggaaggcctcctggctcggggctgtggcctggagttcctcaacaggtgtctggctattcgggtgtctggccggagccccccagggggcccagagccgcaggacaagggaccagatggactgtcgttgtatggggacagatggtctggggctgtggtgcgcaggggtgctgtctgggcctgggtccgtcaggatggaaccaagagagcaaagggtggaagctgctggttcgtggcagggggcgtgcctggaagaccgaggcccacgcagagaaccttgcatcatggaatcagagcgtccacagtcccctccctgatgagactcgaaggcctgccagtacttccagtatgccctaaagcctgcggcaacacgggaccaggtggcgagcccttctacattcgtgccgaatcctcgactcgttgcctgagtagggccgatccccatgccctttgcggtgagtaggccactgagatccttcgactggtggactcggcatacaagcggaggcaggaatggttctgcacccgggttgacccctcactctgcgggactggaccggggcaccgtgccaattatcagagagcccagcaggctcctaaagtgcagagaaatgctgcctccagcggcaaccgaggccccgcagtaatctgaagaagagagcctggaacaggtgcggtgtgaggccagccgtgggggcgctgcagggatccccggtcagtgtgctgagccttgtcagacggagggactcgacctacagtgtgggcgttctgtgtgcctgcgctgtctgtgtgaggcgggccgtcatcgacgaacgccgcgggaaccaggcaggaacttggggaagcacgcggccaggcgccggcccgcgtggaccgcgggggggaacacagaagaccacct

SEQ ID NO: 657928 - DNA, 444 bp, Homo sapiens
taggcggaccataggcgcgtctggtcccacccaatctccgtcgaatgtaatctccagtgtggaggtgggaggtgatgtatcacgggggcgaatttctcatgaatggtttagtgccatccccctggcactgtcctcgagatagcgagttctcatgagatctggttatttaaaagcgtgtggcacctcccctcattctctctcttgctccagctcctgccacgtaggacgtggctgctccctcttaaccttctgctgtgttcataagtttcctgaggcatccccagaagtcaagcggatgccagcatcatgcttcctgcccagcctgtagatccaattgaacctttggttttattctttataaattacccagtctcgggtatttcgttatagcagtgcaagaatggcctcattcacattcataaggcccgagtcctgcatctctta

SEQ ID NO: 657929 - DNA, 887 bp, Homo sapiens
  misc_feature (14)..(14): n is a, c, g, or t
  misc_feature (29)..(29): n is a, c, g, or t
  misc_feature (47)..(48): n is a, c, g, or t
gtgctgtggaactnctggaagccagctgnctggttgcacaaagcaanngccgtgacaccctggaaatatcactctatccttccttacctttccgtgtggcagctggccatgaagaaattctctgacctaccttgtttgatagcagatcacaagaccctggttccagagcggtcctgctttacaccgagggaaaggaatgtcatacagaaaggccaagaagaatctgaagagatgctaatcacctttgcacgtggctgcccattcttcattgaacctaagcattaaaatagacagtttcccctgggtctttgggtcttcatttctgaagactccatgtcatgtaaaacgttgattaaataaatgtatcatgcattaaaaaaaacaaagcgggtttgctactcgagcatgcaccacaaaacaaactacctcacgcacgacttgcccgtttgaacgcacgtgtgtatatatgaagaacgcgcctaacataaggggtctttgtcgttcctgtggtgcgcttcctccgccattacgttctggaggatgggtattctataaccgcctcctcacagcgtggctccgtgctttgtttgtgtagggggaggggagctgttctcccttggggtggcgaagaggtttcccgcgcggttaggtttcgccggcaccaaagcgagccgtcgattgccgggaggcagaaccaaggaacacgagtggggtgggcatacctacacgccccaacccgtcggagttcgttggacacgagactctgcacagggcggacatgggagtatcataacagggtgcggcccatccgaagaactgtcgcccctcaaattgagagtcgctatgcgagtatacgcatccttagcgtacataggtggcttataaac

SEQ ID NO: 657930 - DNA, 851 bp, Homo sapiens
cgtaacggacgcagcgctctcgcggctccgcgcgtgccgggaacgtatgttatgcagtaacaagtggataattttagctatgataatatgcatcaatgcgccccaattgcttctatagaggcaggagggtcctagacatacgtttgaataaacagagatgctgatgctgatcatgtgggacagagaactatcccagagagaggggagcaagacgttatctgtctaacacagagcgatatgcaagtaaacgagttcctcccgttcagaaacacgacaagatcgtgacagcaatccgagaagtcacaggatcgaccagtacactcttattgtcgacagagggctgcaaactttgtagaatcgatacaggacgcctaggataacctcttcgttgactatccccttatgtgaatactagcacgagtcgttatgaacagccaatcgctattattttcagataccaaccgaaaactagattgactcattgactacctttagactttaagctagtcaggtgccaggctgtgtgatgtatatcgcaggagtcgttgtaaacattagattcctataccttaaaaatggggaacgaatatacatcgtgtcgtcgtacaaaagatcccctgtagctgcccggaactgacactaaactacggttgcaacttctgtctcataccggagaaaagtcatcagcaaacgtttatgctcaaacttttgatacaaacatagcaattatagctatacgtaccgatcatagaatgtaatgacgcaaccaatgttttgaatgaagatggtaaatacacttaatccttctaacttaataagacccttaccaaaaaattttgaggataataccg

SEQ ID NO: 657931 - DNA, 432 bp, Homo sapiens
  misc_feature (14)..(14): n is a, c, g, or t
  misc_feature (26)..(26): n is a, c, g, or t
  misc_feature (38)..(38): n is a, c, g, or t
  misc_feature (49)..(49): n is a, c, g, or t
  misc_feature (94)..(94): n is a, c, g, or t
  misc_feature (287)..(287): n is a, c, g, or t
  misc_feature (390)..(390): n is a, c, g, or t
cccaaacaccccancctattttccantttccaaatatngtacccctaanaaaacccccagaggatatccccacactttattataccaataggcnttgtgttaggtaattttgcccccaattgtagggtaatgtaagtgtttttgagccatgtttaaggtaggctaggctaagcctatagtgttcagcaggttggtgtattaaatgtattttcaacttacagtgttatcaacatacaatggctttatcaagatgtaaccctgttgtaagtcaaggaacatctatatgnccaaatcatcctcaaggaagattttgcaggggccaggcacagtgactcatgcctgtaattacaacactttgggaggccaaggcaggaggatcacttgagcccnggagtttgagagtagcctgggcaacatagggagacccccatc

SEQ ID NO: 657932 - DNA, 712 bp, Homo sapiens
tgcgcacggtcagggctgggtgttaatcggacgagggagagaccagagagagtaagttggacctcctggtcctgcaggaatgtgctggtgctcgtggctgctccgggtgaacgtggagagactgggccccccggaccagcgggatttgctgggcctcctggtgctgattgccagcctgggtgccaaggtgtgagcaagtgagaggctggacagaaatggcgattcttgtgtgcccctgtgtcctcagtggcccctctgtgagcacctgtggcctcagggtcctactggatgttgacttggtcctaaagtgatgccctgatgtgttgcccaatgggcccccctgtgtgatgccacgtggattccctggagctgctggccgcgttggaccacccaggctccaatggcaaccctggaccccctgtgtcccccatggtccttctggaaaagatggtcccaaaggtgctcgaggagacagtggcccccctggccgagctggtgaacccgtgctccaaggtcctgctggaccccctggctgagaagggagagcctggagatgacggtccctctggtgccgaaggtccaccaggtccccagggtctggctggtcagagaggcatcgtacggtctgactgggcaacgtggtgagagaggattccctgggttgctggcccgacgggtgagcccggcacgcgggtgctctggagcatctgga

SEQ ID NO: 657933 - DNA, 157 bp, Homo sapiens
aagttatgtcgggacggggggatgctcctctgtatacagggttcgacagccttctggcctgcgcatagaagacgcagatctgccgggaccccgctgtgctacaatggcgccagagactgctttaatccaagttcattatttattatttatttattat

SEQ ID NO: 657934 - DNA, 151 bp, Homo sapiens
aattaacactcgtatgctcatgtaagaacccaatgcctacaaaatggatacctttcagagaaagtatatacttaaaagacccaagacgtcaggatacataaagctctgtatttataatacttttatatagtcctacttgtaggctattatg

SEQ ID NO: 657935 - DNA, 411 bp, Homo sapiens
aaaatcatttttaaggagaagaaaatcatattgaaacagtcacaactacactcatgagcactggacctgccccagcaaacatcatctcaccaataaagatctgcctggcgaaacgccccggcctaagtagcgcggggtccaggatatctggtcgattggtgccggccaaaatgacgacatttgttgttgtattaaaacctgaaagataacaaaaatgcaaacactattaaatgacaagaggcagaaagcaacagtgcaccatcaggaacatatgagcactgcaaattcatagctacagtaaacacattttctattcattatctagtgttttttgctttttttttttttgggaaaaaagccccggaccatttttataaggtccttgcccaaatgccacccatataaaaggag

SEQ ID NO: 657936 - DNA, 1176 bp, Homo sapiens
tatcgctgattgtggctctgcctagttcacttgtcgatacgccaagcggtgtgtacgtttggaacgcaaggactgcgtactaggctcttagcgggatgaattgatgcgcggcagaccactgtgatcggtgtggaacgtggaagagatacaccttggcgccgttaccgtggtattttactgcgactgtccagtgagagaaaaatctgtctttacgggaatgtgactagtgcctgtgtgggtcgacctcttttgtgtcatgaatctaactcgaagatgagtgatgctagtttgttgcagtaattagtgttggttttgggttgtttagtagatttctcatctctatgcggacatattaagagagatttcgtcatgtgttatggttgggtgcaccctctgctcgaacaaggccaatttccttcgttgggctttagtttgcttttcaatcctgtccttttctgtgtagtgctaggaatcagaatgccaactataatgattgttatataggatagatgtatgccttggatcatatacatagttgttgataataagtagtggtgcaactcatgatgttatgtataagagttatatatagtgatatatattgtatttatatagtgagtgggatagtccgagaagcgtgtttgtgagattaactctagggatagcgtgagcacacactcggctgtatatatcttgattatcgtcgtgattgagcaataagagtggttataccaatggcgtttgactgaagtgtgcaagttgatggtgatattactattgatgttgtatgtatatggcgatatataagctggtgtattgtatgcttgttgctgtgtgtcttggatagttacaggaatgaaggtgatgttgatctgcatctctgctcgcatttaaattaaatagctgcgagtgtatgcgcaatagcccactgcccctctatagtaagaagctttgattttcccctagtcatgatatagcccttgtgtcttcaatttctttgaatgctctgaacctgtagttatcatatagagtttcctcttttgataacatgctgtactttcatattctgctcactatcgagatgtattgttaacacttagtatagctcctcgctaaatgataggggttttatctgcatgttgacattgaaccttgaagtatctttaagtatcgtca

SEQ ID NO: 657937 - DNA, 851 bp, Homo sapiens
cctggccgaggagagccggggggcgggccgcgaggggcgggcgcgcggcatgtgaaggcggggaggaggagcaaaggtgcggggagggggaagcgcgagggcggggtgccgcgagagggggaagggggcgccgggagggcgggaggtgggcagaggcggcccggcggggcaggcgaaaggcggacggcacgaccccgggtgggggcaacaatgattgttggtggaggggcaggagagagaatggcgtgggacaggtgggcgcacgacgcaggagtgtagcgagccttcgtgccaaaggggccccacgagaggcaagaggagcggctcccccacgggcatgaggtgggcggcagtagaataacccgagaggacgggcagccaccggggtggcaggcgaacaggagggcggggggcccccgcaaggaagcaactcggtggggataatttgggggaacaaacggggggctctgcgaccaccctttcacaccggtgggagaatgccaagggcacacaaagcgtggtggtacatccccgcggaaatacgggcgcgccacgcgtggggggcgcggttttgttcactacgtgggttgtttatgcgccggtggggcttttcttctgcgaaaggaaagtggtgggtgcgaatgtcgttcacgttcacagggaggcgttatgcgatgacagggggagatcctgggacggggagaaaaaaagtgtcgcggtaagacactatgcgagcgttgccaaacaggcaatgaagcttgtgcactcatgtctagaggagcataatcctcgaaacccgtcgaataattctggtctttttcccaaaacacccccataaacgccacataaca

SEQ ID NO: 657938 - DNA, 128 bp, Homo sapiens
catattttgtgccaaatcacactgttttccaaactacataagtgatgagaatcttggcattgtttacacatttatgtaagtctctttagtgtctggcgtaggctggtaagtttggcgttggctggaaa

SEQ ID NO: 657939 - DNA, 876 bp, Homo sapiens
  misc_feature (63)..(63): n is a, c, g, or t
agaatatataatatatttttcttacataatttacattagtggcaactttgaggcaaaactagnataatgaattcacaggagaagacatcaaaataaaaagccaagatttttatgaaaaattttaactccttagtaaagagaccagtgaggaactcctgcctccaccagttcatactcaaattaaaggccatgcctatgctccatactttggaaaggaagaaccctcaatgactaccaactgcaactggttaaaactttcatccaggattctggatgccacgagaaggcatgagccacatatcaatgaaacgcgttatgtgaaaatcctctacatgtttaatggatgtgactattctaactaaataaaataagtgaatacttaacaacaaaaaaatcgtccaatagtgaccataattcttattatatagccaaataaatttgtctattctggccttcctggttgtaggctatgccttcacttcccttaagtgagggttatataattgatctctagatcaatagcatctattagtctctgctcgttacatatgtgaaatatatggcatcgttataaatactaatactctatcaccatatttctactccatttcacgggattatcctacaaatttaattggtagattaatcggtttaatttctcagtctgacaataattaaataatatatactttatttgtaatttaacatattattctctcgccacttttgtatttcccattttaattctaaatatatttttatattcgttttatattaactgtactaatttgattttattgtatttatttcatatatatattctttttctcttttctcatcacaccatacttttatcaattatatataatccttccg

SEQ ID NO: 657940 - DNA, 388 bp, Homo sapiens
ttttttttttttgcagcaaaaagattaaaaacattttagcccttcaatgtttaagttcaagtggaactatctaaacatcacatcaatcaatacctttatatgttcttctttatatgcacaagggcaagaattagtttaggggtataggagttggttacagtcattatgctctaatgtggcaaacattagtgtcaatttaagtaaactctaaagggttatgaggtcaaaatgcaagactgcataatttatcagatcaagcaaatcattttgaaagtacagaaataagtgaagcatgaggctattactgcctctcatgaataaaggttaataccaatgtttatttattacacgctggatggtatttgctgtcgacgcggccgcgaattta

SEQ ID NO: 657941 - DNA, 122 bp, Homo sapiens
  misc_feature (5)..(5): n is a, c, g, or t
gattntagaggatccccatggtcggtgaagagctatggttggggcggtgatgtagagggtgatgttagatgtggagggctccaggggctcattggagaagagttttatggcgtaagtgaagg

SEQ ID NO: 657942 - DNA, 416 bp, Homo sapiens
ccgacggggactggtccaccggggattcccaaagtgtttcaacaaagaattcttttctcatagagaaattctcggtctcatttggcagaatgcattttgagaaacactctcctaggcagtctagacatttttatagctcctcccctagaaattctgactctttacctccagtcacctcttggtcccctttctgcaagatatgtgggataaacaaacacacaaaaatatctcatgtctctgcctcagcctctttaatgaggtccattataattaagaggactgagtgatagcatgcatggaaaccactaaaatgtggtacctgtagttttgcttttatgataggagcaaagctctttgcttctctaaattgtttgggtgttagaaaaattctgttacatggttagaatccccggtcg

SEQ ID NO: 657943 - DNA, 742 bp, Homo sapiens
agggccctgcctgctcagaatacagcatgtactggtgccggacgttacttgtacgactgagtgccctatactgagtctgatataagccaggcttcgtgagaccgcatgcgtagaatgtcgatgagtgcctacaagttgatctgcttggcgatgtttgagatggaagttattgctgtgcttgtgacatgattggacctcatacgctaacacgcgagtcttcatcgctgataagcgctacattatggcaaatgtatatcatgttgtactatgtgtagttccacagtatggttgtactaattgcctcagtcaaggtctgaagaggattttgcatgtgatgatctatgtagtttgatgactgatcttaatagcactggagagctatgtgataaaggtttctctccagatcccccaaataagctccgagagcgcccttcggtctgccatcatggttaagtctgtccaaataaaaacacatccgggtaaaattgcttgcccatgttagtaggtggttactcaccacacgaatgaaccgacactggtcatttcgctcactgtacgaatcattcacgtctgtgtatgtcaagacgtgcggtgacatcaagtacttcctggagcttgcacgcggatggcatgcatacattcgtgccttgggaatcctgtaagacttcttgcatgagtcccccgtcaatcttgatcttgcacactggtcgaacgctgttctttgacgttaccaatactttgc

SEQ ID NO: 657944 - DNA, 421 bp, Homo sapiens
  misc_feature (102)..(102): n is a, c, g, or t
  misc_feature (116)..(116): n is a, c, g, or t
  misc_feature (133)..(133): n is a, c, g, or t
  misc_feature (171)..(171): n is a, c, g, or t
  misc_feature (225)..(225): n is a, c, g, or t
cctcctccttgctgggtacgacgacttcaactgcaacgtctgggatgcactcaaagccgaccgggcaggtgtcttggctgggcatgacaaccgcgtcactgncctgggcgtgactnacgatggcatggctgtngcgacagggtcctgggatagcttcctcaagatctgganctaacgccagtagcatgtggatgccatggagactggagaccattccaacttggncgcgttacatgagagcatatctatccaaccgtactaacgtggacaccctacactccctcagacttcaaagggcagatcttttttcctcacttattgctgaaacagagacaattccattagagaagatctctgtgctgtaactaacaaatgtcatcttcgggcatgcttgtttctttttgctgaatgaatttaaagg

SEQ ID NO: 657945 - DNA, 114 bp, Homo sapiens
tcttttagagaggggaaagtgtgagctcttcccttatgcctaatggctatttttgaagcaaagaaggcagcaacattggcacatgcacctggcaaaggacccttgagtaagtga

SEQ ID NO: 657946 - DNA, 354 bp, Homo sapiens
ttgctgcgtttttggtaaagggtgtaatttgtaaacagtgcaatttaaagtgaccttagtgatgcagagttcctgagtggtgtttgtagaatgagtttatcatacattctttctactactggaaaaaaatggatgcagtctggactgttgtaaccttaggttgtaatctgatttggaaataagtacatctttaaaagttgctacagatttgagttcatgattttgttaaaaattgctatgacaggcccagccataaatttgacgcctccctgaaatggaactagtctaacaaaattcattgttctacctagttgcagctgtacctgaaataaaaatgttattgatgactgaaaa

SEQ ID NO: 657947 - DNA, 230 bp, Homo sapiens
  misc_feature (158)..(158): n is a, c, g, or t
  misc_feature (183)..(183): n is a, c, g, or t
  misc_feature (194)..(194): n is a, c, g, or t
ttttttttagtagagacaaggtttcaccatgttggtcaggctgggctcaaactcctgaatccgcctgcctcggcctcccaaagtgctgggattacaggtgtgagctgccgcacccagccaagaaaaataatactcttaaatacttagatgttcacctnaagttgatattatttggtatggganttacttttganctgtaatctttcagattacaccactttgaaaacaag

SEQ ID NO: 657948 - DNA, 825 bp, Homo sapiens
aatgtttctcagtgttgtgcatgtgagatacatctcttcatttgtaggtccagttcgtagtagcttctgcgatgatgtaaattaaagcacacgtcagtcttataatgatatcctgtggtgtccacggtctcgtcgcattatattgatcgtgtagtttgtagcaagttcccaatgctggttattagtggttgacctccaacctgtttcggaaggctatttctctgcagtgggttgcgaaatgtgatttgtgaggaatacattaacatagatgacgcccgttacccactcctgggagctatcttaacatgacaagagagtccagtattctcagcagctcgtgaattatagagggaaatacaggagaggaaccgctcttccactattacttttcgtccaaatgcatgcatggtgtaccagaagtgtgaagatcggcttgaggattggggctagctcgtatgacactaaggccccaacatcgtcgggcactctgtcttgtggtcgtcggattcttaggaacgctgtctctagccggccacctgtcccaggggtcgccgtggccggcattatttcctagttcttcctgtaagcctgagtgtgccagcgcggggagtgaggaggggtcagggggctaaggatgcaacctctgacgttctgcgccttcctaggagagtcttacatgtgttgagatttcacaagcaatgcgaggtgtaaaataccagctctacaagaagctaaggctctgtgacggcatagttttcagtatcctcctatcacaataaatcacaatggagaattagtataacatggtagcacgtatatagcccc

SEQ ID NO: 657949 - DNA, 206 bp, Homo sapiens
tgattgtatatacttgggctgtatacttgtcaagtatcagtgttgttaatcatgacgcaggcttatgcggatgataatgttttcatgtaacttatactaacattagttcttctatcgggtgatgaattggtccacttgggatgtgacggagttcacttatatgtttgggatttataaagtagagggtgtagaagcttgaacgcttt

SEQ ID NO: 657950 - DNA, 304 bp, Homo sapiens
ccagtacaacagctgaaggaatatgagtgggaagactttagatgtcatgtacaccaaagaaggcctggaactatccagaggatgaagaagagaaaaagaagcaggaagagaaacaaacaaagttatgagaacctctgcaactctcatagaaagacatatatgtgatgaaaaaagttgaaaaggttggtagtatgtcaaacctgattggagacatctccatgctgtatttgtcacaagcacatatggctggacagcaaacatggatataatcatgaaagctcaagccctaagagacaacacaaca

SEQ ID NO: 657951 - DNA, 784 bp, Homo sapiens
  misc_feature (1)..(1): n is a, c, g, or t
  misc_feature (496)..(496): n is a, c, g, or t
nctggagggcccccaggccccctcgggggggttcttcttcgcaaccagttgagccccccccgctgggggcaacagggacaatgccccccggcgttaccaacactgcggggcccacaaaagacgatgtgctccccgctcggacaatattgattgcacagccgaagaccatcattcagaaggcgcaccccggggtgtcccagacaccacagacagaggtcctcggttaaggccacgcgtcgcccccgcccgcgactggtagaatccccccagaaagaacgtgggtgctctttcgtagacaactccccaaactatcttctgagtagtggtacaaaaacgcaactcgccgccgaggggttcctgcagggacaccccgcgttggtccccgtgcctctcacgagattctcccagcccccacgaaacagaggtaattatcatgccccctccgagcaaaatcagcaccgtttgcgacggctttgcttcccaactctaggcacgnctctttattctctcccgcatcgcccatcccactctgaacacacaagagaacatcccatgagatatctattgtgagctgcgacatacaagtatttctgcaatcatagagcacctttctaccccccatccttgggcggcataaacatattctagagttaaccaccacgcgtcaccacagaagcaagagcacctcacggagcaccaccgctcagcaacccctcttcttcgttgaaactatatgaatgttcgacaaaaacaagacccttcagtgggaacaaaaaaaaaaaca

SEQ ID NO: 657952 - DNA, 557 bp, Homo sapiens
gtggtggatataaaatatattaatatatatgccatggctatcttttatgctattaaaatttgggaggataacaggacttataatgaaaatagaatattattaagaaaataaagcttcactagtaattacatttaaaaaataaatctaggccttttaaaccataataaaaatcattgaaaagatctcagttctcatcacattatctgcaagtaacaaatttagggcagaaattatacttttccttttataatactagaaagtgatttctggctaacgtaattttagttctatcacatttgggactgttcttccttcagtaaattttctcatgatgaaacttgctaatcttatcagacgtttttgttgaatataaaacaactactgttatgattaggaaaattattaatgccttatattacctgcctaagggctagaaaattgaaaataagttgtttacttttatatcctgttatcaaaggggtttgaatgacatgctattaattgtatgaaatagaaaatgtctaatgcaatcaattgtaagcagcttttcttacaat

SEQ ID NO: 657953 - DNA, 398 bp, Homo sapiens
gtcaggtggacttggccatcaggctgtacacggggatcctctcccggatccaacagagccaaggttttcaactacgccactttctggatctagaaaaaattcactgtcttccagatccatagagtgagtatcgtatatgtccattggatccaatatcagcatcctttgcactgacttatcaggatgatttatatttgatggaatgtcttcaggaagtaatgctgtatattcaacctgatcacacactggtctattgtcattcacatcattgacgctcatttccaccatggcctgtgttacaaaaagcccatcattggcagttatattgagaaagttaatatcctgttcttctctgtctagaggcctcttcacatagaccttccattataataaaatca

SEQ ID NO: 657954 - DNA, 982 bp, Homo sapiens
  misc_feature (110)..(110): n is a, c, g, or t
agtgatctgtgtgttctgattcttacccgcattcagtgtggtgaaactcatccgggtcgctgtctttaaaggccctggtgcatgtactaactgctatgacctccacgttntgctccggctctgataaggacctcgtagatgcactagtgcttctcagacaatgttggtcgggagtccctttaaaacattggtccatggttgggacaatttcagacagtaagtgcctggttgcattgttagcctactccagtagagacggtgagtggtaatcatgagtagatacagtagttgtctggccctaacccatgtgtttaatagaactaatgagtgtactcaagtaaattcagggtgtgactgggtccacggagtccaggataggcatcctctactttggccacctgcaaagattaaccgataatttcaccctgaaaaggagaggagtgccaacagtaatggagaatatgagcattctatttgcctggtggaactcgcgtacatgcggcccatggcacattcactgccttgagcgcacgttgctgtctcggatgtatgtgtcataggttgcacgtccccaaaggggcaaggatgacgttgtgccgatcagatcagtacagataggaagctactcaggacaatgggccaactagactgatcgtattatgctcattacttagtaacctagctttgtttaccgactgttggctacctctacgggtgcgtcctgcgttgaacgtttgtccttcgtgtccctggttctgaccgtgtttacacgtccgtatgggattacgttattgcccccaattccgggccgtgtctgagagtggggaccttgggacctgagtgtgcggtgccccaccagtttccacgtacggttgtgttaacattccctcttgccctgaggggatcccccccgtttaaggggttcgggcggagaaacacaccggttttgtacgggcccggagcggggcgccttatgccaaaa

SEQ ID NO: 657955 - DNA, 1020 bp, Homo sapiens
cattaacttgtggcaagatggcgcagatacaacttgatctacctcgcagtcgcgcccagttctgtgatcggcatctagctcttcccgcgtacttgaagtgcgtctcgtgacagacgggccgactactactacgttgacaacggatatgactcacagagcgtatcagtgggaaccttctatatgggattacccaacgcattggtaggacctctccacgtactggcatgtattacatgaaaacgcccttcatgttctgcatgcatagttccctacatgtcgttggacgagcagctactacgatagccaccaggtgtgtggcaccacacggtgacaccacagctttcagggccacgcaaaccagacaccacagtgtgtcgacacgactcgtgcgacatgactcccagcaaagctaccacagtgcaaattgcctaggtcacaccacggaactggtacggcatcgctccttcggacctactcctgggctggcacaacagcattggctttctaatggcaagcgacactacttctaccgcataccacctctaacacgataatggctacatattcccagtcacgacatgtaggagcaatctacctccaggacgccagccacgaactcactcctcacatatctcgtcacgagctgctggttaccagcaaccgtatagcacaatgctcaaagtttccctactggggcaaagctggcctctgaacattctctaatggccaaattgtgggattgcatggcattggaagaaaccttacaccggttaaaaggagaccatagcataactaacttctggtgagtcctccacctttaacggctctccagcaagagaacactggcattcactgggctctggtgcgtcgttcaagaccccaaggcccgaattcttatagcagcttcttttcagccaaattgctgggctcaacatgtgcgccatcttctcgtacagcgcaacacagagacaaccagcaaaccatatatcacgcagtcaacaacagactgtgtggcagata

SEQ ID NO: 657956 - DNA, 375 bp, Homo sapiens
ctctgatgtcccccgtctccacgacactccttccagaatcattgttcaaagaagcagctggtaatctctgttctgctgcactacctttgaagcttcccactgttagtaggacaaaggccacactttgagcctgcctttaaggccctgatgagctggtccttgtctgcatctcagccttgtgcactgctggtgcagctggcatccttcccctaaacagccaagcaggacacactggggctcagccaggcatcacctgaccactgggaaaataagagaacggggtgaggacagggctggggtgagacctgctgtgaaaattggctggttctgagcccagacattttgcgggtgacctgaaggtcagtcacaatgacc

SEQ ID NO: 657957 - DNA, 847 bp, Homo sapiens
ggactcgcgtcgggtaggcgattcccgtgacgtaggatagtaaggtgggccggtgttctgaggtgctgccttctcgtttacttgttccagcgtcataggcacacgatgcgcgctagtagcgagacgctgggaggagttcatgaacgagtctgccgagaagcttgagtctcgctgaccctatgaatggcgacgtgtggtttcgtgcaaagtataggcattgctgagtgggaatctgtgtagtggttgaagaagtacacagatggatcttagattgggttgtggtggtatagaagtaggaccatagttcaaggaatgtaaacgaaggattggagagaatgccatcagggcgagattaaagtgcgacttactggtaggcaatgggaagccctgcaaggttagccatggaaagctggagtgaatggttggaatagtgaaggacgtttgtcgtgtacgttaggaagtaaatatcttaagaatgagagaacagtgttggggacaggaaagtgagttggatgtaagtagagtgggctgttcatgaagcttagaggtcatttgttgtaaataattctctgttaattactttaggagagctgagggatgcaaagtgtgtgcaggttagaaacgtgtttatttacttggggaaatggatgcaagaacatggatctgtcgttagaaagtggagattattcgatgttgggtacgaatgtgcttgtggtctctgggcaacatgcggtatcaggtaggattggcccagtggagatattacggaaaggacaaagggttcgtcaaatgtacgtcagtcttctttgagacgaaccttgagtgtaaccatgtggcggatcctgta

SEQ ID NO: 657958 - DNA, 491 bp, Homo sapiens
  misc_feature (308)..(308): n is a, c, g, or t
tgttagtttgtttatttatttatttatttttattgatcattcttgggtgtttctcgcagagggggatttggcaggatcataggacaatagtggagggaaggtcagcagataaacaagtgaacaaaggtctctggttttcctaggcagaggaccctgcggccttccgcagcgtttgtgtccctgggtacttgagattagggagtggtgatgactcttaaggagcatgctgccttcaagcatctgtttaacaaagcacatcttgcaccgcccttaaatccatctaaccctgagtggacacagcacatgtntcagagagcacggggttgggtaactacgctttggctgccaaagcgtagtacccaatagctaggactacaggtatgcaccaccacacctggctaatctttgtatttttagcagagatagggttttgccatgttggccatgctggtcttgaacccctggcatcaggtgatccacccgcctcggcc

SEQ ID NO: 657959 - DNA, 220 bp, Homo sapiens
  misc_feature (29)..(29): n is a, c, g, or t
  misc_feature (118)..(119): n is a, c, g, or t
  misc_feature (171)..(172): n is a, c, g, or t
  misc_feature (191)..(191): n is a, c, g, or t
  misc_feature (209)..(209): n is a, c, g, or t
gcacaagtacgtttttttgacaggcatanaattttaagattttttaagtctaagggacttgttcctgatcttcctgaagatctcttaccatttaattaagaaagcagttgttgttcgnnagcatctttagaggaacagaaaggataaggatgctaaattccgtctgtttcnnttagagagccggattcacngtttggctcgatatatangaccaagcgag

SEQ ID NO: 657960 - DNA, 741 bp, Homo sapiens
cgtggtggctcacaactgtaatcccagcactttgggaggccgaggaggcagatcacgaggtcaggagatcaagaccatcctggctaacacgggaaaccccgtctctactaaaaatacaaaaaaattagccaggcgtgtggcgggcacctgtaatcccagccactcaggaagctgaggcaggagaatggcatgaacctggcaggcagagcttgcagtgagccgagatcgcaccactgcactccagcctgggcgacagagcaaagactcccgtctcaaaaaaacaaacaaacaaacaaaaaacaaattaattctagatggcattaaaaacttctatgtgaaaaggcaaagccttgaactctaacctattcctatttagaggacccatataggagacatatcttcaagacttcaggctagagaagcattcttaggacacaaaaagcatcaccataaaccgataatggtagattctaactccccaggtatatcaaccgctaaggaaacccctctgaacacataaataccaggacaactataccaaccactgttccacaagactccctctgaaaactagctcaaactgaaaacctacacctatgctatccagaaccagcataccctaatgtgatcatacctattcacaagcgactgggccacctcatccagccactggaaaggaattgcaaccaactgcgacacaccctcagaacaccattcttgcctcgacaaaaaccaatcata

SEQ ID NO: 657961 - DNA, 534 bp, Homo sapiens
tgattcctttgtctttcttcatcaaaatcatgacgtcttacgctcctcaaaagctgtacctactgctaggttggacaatgaggtgtgagtggggtagacccctgtcgtgacccttggcagcagcgctttggcactacagacagttccaccatgctccttccctgccacagcagccgtgcaatgttccagacccagggcgggggaggggaatggccaataaacacatcaacagatgctcaacttcacttccaacaagagaaatgcagaactgaggtacccttttcatctactcgattcataaaaattataaagtgatatcccatactggtgagaaaatgtcaaatcaggccattttccacactgatggtgagggtacagaccagcatggcatgcagacagtgatctcccaatccttgtcaaaattggccgggcacggtggctcatacctgtacttccagcacttggggaggctgaggcgggcaaatgagctgaggtcagaagttcgagaccagcctggccagcgtggtgaaaccc

SEQ ID NO: 657962 - DNA, 1018 bp, Homo sapiens
atgctttcctctttgactttcacattagatggtttcttctagatctacctcagttctacttgcctttcaatcagcccagattctcctgttcaacttcttatttggaggaccagacaaattcattagctgtccatgtgtttttatttactgtagtgtgggtttccttcttatttatcttttccaatgttttcttttccccttttttttattggcagaagcggaagtttgggtccagttgtaaaccagaggttatggaaaaatgcaggggccattgaaattccaaagggcccagtggaaacacttttgtgcctcgcgcgggttcccaagcgccattttctctggcgtgggcaccccgcgaatgtggggggaacattaatggggcgccggcgccgagcaaccagccttggactaactcctgggctactccaggataacaacacgggcgttcccaccaattgttggccaaaacagagtgctcccaacgacacctcggggacctaagtagaaccagacgcggcaattgggaccaccaaagggtagcaggggatacaacggcgttgtgacgccccaaaaccaacaccctcagatggtcagcggaacaggaccacagtatgggacaggacacaggggaaagacatgaacccaaaggagttggagtgcaacacagccaacatgtgggaccaggaaagccacgcccaccacgggacaaaaacaatcacccacaacgttaagctaccccagacgtgtgggttgtgccacgccgcacgagaacgaacgcagaaaagaacattgtggcggcgcccgccacgaggaagcacaaagcacagtgcggggcgccaccaatattaggatcgtactcagtgccaaggcacggctatagtttggatcaaaaacaagcggggacgacgataaacgagtgcgggtagagtaaaagacgagcaacccgcgcgcggaaagagaaagagtcacagcgcagcgatcgacacagacgaacgagcacacgacgacgcgaaacacg

SEQ ID NO: 657963 - DNA, 932 bp, Homo sapiens
actcgcgcattggaggtcaagatggaggagtacgcgcgacgcttgcccatgcgaattgtgatgactgtggtgggcctttacgatgggtcaccattggttggtgtatctttccacgcaatcacagggtgtttgcgcaattcctccatgtggatgttaaccacagacttacggaggagatgtttgacagggcttaataaaaaccagggctccacagtaagggaggtacccttttgggcagttgggggaggccttggtttcccatgattggacttggacgtatgggtcccacgtgtcaagagggaacaagggaagatcccttgaaaactccatcacaagtgtgtttgccttaaggtggggagccataactggcaggcaaaggaattggccccaagttgcccattgttgggttacagccggaatgggggtggcaatctccctagcttaaatggaagggacgctggatcatcttgtggaccaagagatttgggcttgctgcagcagttccccattgggtcctctcagtgtggaaaagacccttccaatgttgcgtcacttcagtacccttcctcaccttttgtgagaatctatcgaccatatccaggaagcacttccttccctaaggatttttaccaagaaacggagtggtgcttcgggagaggtttcaggacgatccagttaccgtcggtgtcaacaccctagtgtggaccgttattggcatagggtataagggacttagcactttttccaattcaggacacccggcagcggctcaacgcacacgttttattccctttatggctgctgcccaaatttatcgcacggaacagcagtgttaaagagccacggccaacggaaagacttccggcggtgcggtgggtggtcaacaacggcgcactatagggtcgcgaagttgtgcaccgtactgctagaaa

SEQ ID NO: 657964 - DNA, 240 bp, Homo sapiens
ctgcatacatgattatctaaagcgtcataagtctcccccatcccgggatttgtgagcctgccagcgtgctataaatccagttaagagaccagattcattttagttagtccctcaaatacaaggctcaaggaacttacgctggagaaggcacttctaaaactaggggggatcctctatcagtctgaccagtccagcttagtccgtgaggagaaggctgctattgaaccttctagagctagg

SEQ ID NO: 657965 - DNA, 130 bp, Homo sapiens
ctccctccgtgtttcattgcctattggtactgatgaaaaccaaagccatcttaaaaagtgcatagcacagtgcctggcttggttcgggccctcaataaacattttctaaatggttgaatggcctatgcta

SEQ ID NO: 657966 - DNA, 411 bp, Homo sapiens
gtaaaaaaatgattgcttatcggtaacatataaattcagaatcaggaatgatggtgatggcaaccaatccaagttcgtccacatgggtgggcgagaatgttaacacctttgctttctgatggttcagtgtatccacactttgtttcatgccaaaattatttaaaatattgtatgaaattaccttcaggctatgtgtataaagtatatatgaaacataaatgaactttatgtttaaactgggatcttatcctcaagctatctcattgtgtatgtgtaaatatttcaaactaaaaaaaaaaaaaatctgaaacacttctggtcccaagcatttcagacaagggatattcaaccctgccctgcagtcttgattactgtaactgtataataaatcttgaaatcaggtaaaaaaaa

SEQ ID NO: 657967 - DNA, 293 bp, Homo sapiens
  misc_feature (37)..(37): n is a, c, g, or t
tgtgggtcaagtgattctcatgatatagaagttgaanaagggtgatttgaagggttagaggatttggaggtgagaatcttcagaagaattcaaaaattcaattccagggtctaccaacagtgagggactgtgggaagagagaggaggcagggccttcctgtcggtgtccttttaacccattaaaattatgggggagtgttcctcaaggggtgagacacccggggggaggaggggtgttcaagctggaaagcaggaagcaagcccaggagggaagacttgagcagttgtgcttg

SEQ ID NO: 657968 - DNA, 194 bp, Homo sapiens
acgcgtcaagtaacagggtcctaccatgtaagatgaagccagtgcagggaaagcagagccaaaatatggagagacttgaatcctgatgacagcgtttgtgcccctggatccagctgtgcctgaagctagaatatcccctggacttttcagttatgtgaaccaattaatacccttttttgcttaagttactttga

SEQ ID NO: 657969 - DNA, 356 bp, Homo sapiens
tgaagttttgctcttgtcgcccagtctggagggcaatgtgcgatttcagctcactgcaacctctgcctcccgggttccagcgattctcctgcctcagtatcccaagtagctgggataataggcacttgcaaccatgcccagctaatttttgtagttttagcagagacggggtttcaccgtgttggtcaggctggtcttgaattcctgacctcgtgatctgcccgcctcggcctcccaaaatgctgggatcacaggcatgagccaccgcacctggccctatatcctgcttcctatctcgtgggtcatggtgtatggcttttatttatttcaacctgcagttgtttgcagaacatctg

SEQ ID NO: 657970 - DNA, 189 bp, Homo sapiens
ctgctacgacggctggagtgcagtggagcgatcttgtgtcaatgcaagatccgcctcccgggttcatgccactactcctgctgcaggctcccgagtaattgggaccacagatgcccgtcccacccccaatttacttgcaatccagcaagaatatttgaaaaatatatgaatagccgtcgtaggcagtga

SEQ ID NO: 657971 - DNA, 107 bp, Homo sapiens
aggctcgaaaagggggaacggcagacggaacttaagcgcaagagtttgaacacgatgaaacaacgataggctcaccagataccagggtgttaagtcttgtatgtgaa

SEQ ID NO: 657972 - DNA, 300 bp, Homo sapiens
  misc_feature (176)..(176): n is a, c, g, or t
  misc_feature (270)..(270): n is a, c, g, or t
ctggtgtgctgcacccattaactcgtcatttagcattaggtatatctcctaaagctatccttcccccctcccccaccccacaactatcacaaggatacactgttaaagcagcacaaaatgaactaagacacacctaataaaatatatatttactttacagttaaataatgaaagtngttttggattcaaatcattgtaagttttgtaaaataaaaatttgttgtgaaaatgtccttactcagcacttttatttaagaatggaaagtgtgnagacattttttgacaggttaaacagcaagc

SEQ ID NO: 657973 - DNA, 762 bp, Homo sapiens
gtttaaaagtgtgtagcacttacccaccgccaccccagaccccatcttggtcctgctcctgccatatacgacacctgctcctgctttgccttccaccacgagtgaaagctcccttgaggcctccccagaagcagatgctgccatgcttcctatacagcctgcagaactgtgagcaaattcaacctcttttctttataaattacccagcctcaggtatttctttatagcagtgtgggaatggactaatacaggggtagaaaaacaggatcataaggtgtgatatgggccataaaaatattctactaacatgaggctgatgttcataggaaagaacaattatttccccctaattttttttttcttttttgttgcgggcacagaaaattggggaagaatttatgggggcagtgctatttgaacaagaccttgtaatgttcctgtttcatctctgatggtgtcttaattcttcaggactcaaaaatatgtttttctttctcactggaatgaagttgctattctgtgctttctagtgtaaaataatttttaaaatatggataacatttcaactcatttaaaatttgtaggccaggtgcagtggctcatgactgtaatcccagcactttgggagggtaagacgggtggatcacgtgaggccaggagttcaagaccagcctcatcaacatggcaaaaccctgtctctactaaaaatacacgaattatctgggtgtggtagtgcatgcctgtcatctcagccactcaaaa

SEQ ID NO: 657974 - DNA, 191 bp, Homo sapiens
atggaatccagctggtggaacaacgccgtctcatcaccgtgaaactttgaatttactggttcgtaacctgaaaaaaacgccagtatctgaataatttagatcctgtacaaatgctccgaattcggggcattttctatttataactggtcaaaaatgatcaacagttttcgttatcattctttgttatagtg

SEQ ID NO: 657975 - DNA, 389 bp, Homo sapiens
gcagtccagcaaggcacgagtgcaagcttgctcccccttacaccatggttctttaaaattttccagccaaacagctatggtccgcagtagccttcttgcagggcacacggacctacttcagatgggcacacctcatggccaaattcaagtgcaaaccatcacccagcacataaataactcacagcagcaggtcagcgcatgcgcttgccacaggattccaggctacgggagggccccagggcaagtaactgccttcgtgccagttctccatttttcaactttcaaaaaaaatccccttagattcaacatcgccaaaacaagagcttgtggcttttccttttcaaagttatcctcaagactccatccagaaaccagacctaggagtcatt

SEQ ID NO: 657976 - DNA, 290 bp, Homo sapiens
  misc_feature (44)..(44): n is a, c, g, or t
  misc_feature (49)..(49): n is a, c, g, or t
  misc_feature (56)..(56): n is a, c, g, or t
  misc_feature (77)..(77): n is a, c, g, or t
  misc_feature (240)..(240): n is a, c, g, or t
  misc_feature (256)..(256): n is a, c, g, or t
agaacacttaaacgtcttctgcaggtccatttttatacaatctngatangaccgtnatactttctggcttgccacanagcatatctttctatttctgctcatccaataacacatgctgtgccctactgtgatagattttccaaacaaaaatacctggagcagcattttagcataatatgccttcagtggcattcaacagatggagtttccccaagcacagttctgtaagatgtgcgtgtnagagtgtgtgtatatntgtgtatgtgtattttaagttattatttgtattg

SEQ ID NO: 657977 - DNA, 110 bp, Homo sapiens
aggccaaggcagaagtatcagctcaccatccacacggctgacctcatacatcaagccaataccgtgtggcccaagacccccaccataaatcacatcattagcatgaacca

SEQ ID NO: 657978 - DNA, 845 bp, Homo sapiens
  misc_feature (29)..(29): n is a, c, g, or t
  misc_feature (35)..(36): n is a, c, g, or t
  misc_feature (41)..(41): n is a, c, g, or t
  misc_feature (112)..(112): n is a, c, g, or t
  misc_feature (170)..(170): n is a, c, g, or t
  misc_feature (172)..(172): n is a, c, g, or t
  misc_feature (184)..(184): n is a, c, g, or t
  misc_feature (186)..(186): n is a, c, g, or t
  misc_feature (195)..(195): n is a, c, g, or t
  misc_feature (197)..(197): n is a, c, g, or t
  misc_feature (269)..(269): n is a, c, g, or t
  misc_feature (384)..(385): n is a, c, g, or t
  misc_feature (390)..(390): n is a, c, g, or t
  misc_feature (393)..(393): n is a, c, g, or t
  misc_feature (423)..(424): n is a, c, g, or t
  misc_feature (432)..(432): n is a, c, g, or t
  misc_feature (435)..(435): n is a, c, g, or t
  misc_feature (441)..(441): n is a, c, g, or t
  misc_feature (488)..(488): n is a, c, g, or t
  misc_feature (498)..(498): n is a, c, g, or t
  misc_feature (588)..(589): n is a, c, g, or t
  misc_feature (594)..(594): n is a, c, g, or t
  misc_feature (627)..(627): n is a, c, g, or t
  misc_feature (629)..(629): n is a, c, g, or t
  misc_feature (653)..(653): n is a, c, g, or t
  misc_feature (691)..(691): n is a, c, g, or t
  misc_feature (708)..(708): n is a, c, g, or t
  misc_feature (733)..(733): n is a, c, g, or t
  misc_feature (750)..(750): n is a, c, g, or t
  misc_feature (755)..(755): n is a, c, g, or t
  misc_feature (768)..(768): n is a, c, g, or t
  misc_feature (773)..(773): n is a, c, g, or t
  misc_feature (824)..(824): n is a, c, g, or t
ttttttcctcttttctccttcttcactcntttcannctacnattcatatttctttaatttttttttcccttcttttctttctccttcattcattccccccttccttttttcntccacttattttctcacataccaatatactttttatttacctttttaatcttatttanantctatttttttnanacatttcananctaataccaaaccattttacactttctctttttaccaactattctttattcatcttatattactttattttnaccaatacttcttatttccacctttattttttttccaactctttcttcttttataaatatttttccctcattcattacaatttcatttatcttcataaccatttcatatattttnnccttnatnttttttataattcccttctatctcttcaannccccactncancccagntactacattccttcttttcatattaccttaggaaacttcccttcatnaccagttctnttatttatttttttttcttttctttcttcctctttaccctctttttctacacattatattattttttttatatctcttttcctttagctnnttcanttcacctttcaacatctattcttaaaaacccanantttaatctttcatttctttcatcnatttacatccttctcctttattcattcctcttcctttnttttaattacatttatnaacacactacacctttttatttcancctcatttttacacttntgaancgccgccgagctnctatngacttccctggagccaaggtcattgttccccagctgaagggcagggtgcancggaagcgtgttggggtttat

SEQ ID NO: 657979 - DNA, 405 bp, Homo sapiens
  misc_feature (165)..(165): n is a, c, g, or t
  misc_feature (279)..(279): n is a, c, g, or t
  misc_feature (363)..(363): n is a, c, g, or t
  misc_feature (392)..(392): n is a, c, g, or t
taataatcagtcagtaataatcagtcagtaataatcagtcagtatgtttatatgtacagtaataatcagtcagtaataatcagtcagtatgtttatatgtacagtaataatcagtcagtagttatatacaggctcagttccagggtcagtagttatatacagggncagttccagggtcagtagttatatacagggacagttccagggtcagtagttatatacagggacaggtccagggtcagtagttatatacagggacagttccagggtcagtagttntatacagggacagttacagggtcagtagttatatacagggacagttccagggtcagtagttatatacaggctcagttccagggncagtatttatatacagggacagttccagngtcagtagttata

SEQ ID NO: 657980 - DNA, 1260 bp, Homo sapiens
  misc_feature (1260)..(1260): n is a, c, g, or t
gggcgtgcggcaggctgaggaagcaagacgccctccattcactcgtccgtgcccgttctccttggctgtcctccactgttccgctgacccgcccgtggtcgccgatgatggaacgaggccatctccttctgccacatagacttctgtgtgaccatggagggcctcggcgtcgccagtcatctcacaaagactggccgtagtgctccgagtcgagcgtggtcaatgctgcatgcctgcaggtccagcacgccagcgctgcagtatcggcgtacgacgagctgttcgcagggcactcgtgggactgccgttgtcctgtcagtcccccctagtgtatgcacgggtcagttgccttgtgcgctgttcgtggcatggggggactaaaccgtatgcccagaacgtgtccatatcgacttatatatccccacaagctcgtacagcccctccaatcgttacgactcttacacagggactaaacggtacccaacacaggactcgtgcacgtgaggtggggcggatgtgcacccagggctaagcaacggccaaggttagcttgagaaccgggtaatcgtttttgaccgtttgacaagaacactaggggcccattcccgggcacgaggtagcctcgggtcaccagtggttagacaggaccaccttacccacgtaccatgggcatgtccggtagattaacagcccggcgtaggcactttatgtggcgcaatgaaaatctcccctgaccctttgggccattatgtccgcagaaacggattggggcgacaacaccgtccccaacggggcgcacctgacaagaagcccctggacaggaatgtgtttcccgagaaacatggtccctttgtgtgaaacgcgaacctatgctcctagtgctctggatagtggattaccaactccaggagattacaccggacactgaggtcaatttcacctgagggtgtgcgccctaggttaaccccaacgaggaccttatacaaggagtgattctatcccccgaatggcacacgaggtgccgagttcgaatcacacctatcgtaacctcaggcgtgagacgatggagcttaagcataatcccgcagccagatgttacaccgaacttaacctagagatcatagataggtgggccaagatagcattcctccccacggaatctgctcttcaagaggcacatcaagcgtgccatccgatatatggttgggagtcgaaaggcccttgggatatatggattcagagcgaggccagaggaccccn

SEQ ID NO: 657981 - DNA, 226 bp, Homo sapiens
ggcacgagcccctcagagttctacaggtctggcaagtatgacctggacttcaagtctccggatgaccccagcaggtacatcacgcccgaccagctggctgatctgtacaagtccttcgtccagaactacccagtggtgtccatcgagatccctttgaccaggacgactggggcgcctggcagaagttcacggctagtgcgggcatccaggtggtgggcgatgacct

SEQ ID NO: 657982 - DNA, 390 bp, Homo sapiens
ttttttttttacattcatgttctttcataaagaatctcatatcatcatagtaaggccaagggcccaaacggaaaagaaagagaaagaagaggggaatccaaatgaatgtctcctagacgcctcactgcgcacgggcttttccggacatcttccactccttgtcccgaagtttggttcgttgaattttccctgtgacagtcttgggcaggttcaagacaaactctatctttcttgggtacttgtatggggctgtcctgacttccatgctgctgcagctccttggtgaagctgtttctgggttcttggaataggaactgccaaggccagaatcacaaatgccttcaccactctcctccgaacgggtctgggctgctgattacagccgtctca

SEQ ID NO: 657983 - DNA, 936 bp, Homo sapiens
  misc_feature (14)..(14): n is a, c, g, or t
  misc_feature (71)..(71): n is a, c, g, or t
  misc_feature (92)..(92): n is a, c, g, or t
  misc_feature (94)..(94): n is a, c, g, or t
  misc_feature (96)..(97): n is a, c, g, or t
  misc_feature (102)..(102): n is a, c, g, or t
  misc_feature (133)..(133): n is a, c, g, or t
  misc_feature (135)..(135): n is a, c, g, or t
  misc_feature (145)..(145): n is a, c, g, or t
  misc_feature (152)..(152): n is a, c, g, or t
  misc_feature (155)..(155): n is a, c, g, or t
  misc_feature (175)..(175): n is a, c, g, or t
  misc_feature (180)..(181): n is a, c, g, or t
  misc_feature (192)..(192): n is a, c, g, or t
  misc_feature (201)..(201): n is a, c, g, or t
  misc_feature (233)..(233): n is a, c, g, or t
  misc_feature (291)..(291): n is a, c, g, or t
  misc_feature (293)..(293): n is a, c, g, or t
  misc_feature (301)..(301): n is a, c, g, or t
  misc_feature (328)..(328): n is a, c, g, or t
  misc_feature (330)..(331): n is a, c, g, or t
  misc_feature (335)..(335): n is a, c, g, or t
  misc_feature (354)..(354): n is a, c, g, or t
  misc_feature (360)..(360): n is a, c, g, or t
  misc_feature (367)..(367): n is a, c, g, or t
  misc_feature (371)..(371): n is a, c, g, or t
  misc_feature (373)..(374): n is a, c, g, or t
  misc_feature (383)..(383): n is a, c, g, or t
  misc_feature (387)..(387): n is a, c, g, or t
  misc_feature (394)..(394): n is a, c, g, or t
  misc_feature (398)..(398): n is a, c, g, or t
  misc_feature (402)..(402): n is a, c, g, or t
  misc_feature (427)..(427): n is a, c, g, or t
  misc_feature (438)..(438): n is a, c, g, or t
  misc_feature (481)..(481): n is a, c, g, or t
  misc_feature (835)..(835): n is a, c, g, or t
  misc_feature (934)..(934): n is a, c, g, or t
gggggggggggggncgtttttgtgaggaaagtccatataaaccccattaagtagaatctggatctaaatanttccaaacaagagtacacaanangnnaacantctccctcatcccactgatctgctgcttcananaagatcagcnacgttcntcngcatctcatcaatctgagtngcatnntactgctcgcnatctctggngctgcggatgtcgtcattctttacaaagttantggccacacccttccggccgtatcgacctgttctcccatttctgtgtatgttcaattntntgttattngggagatcatagtttatggtgggggananntggngggcatccaaccccctggnccaganatctgtngatntnngcgctcggntggngcccgancggnactncttcatgatggacttccgctctttntggggcatgtntccatgcattgaggatacagtgaagttggcttccctcattttntccgtcagccagtgcacctttcttttggtgttgcagaagatgaccgcctgagtgatggtcagtgtgtcgtagaggtcacacagagtgtcaaatttccactcttccctctccactgccacgaaaaattgcttgatgccttccagagtcaattcatcacgtttcaccaagatgcggattgggtcggtcatgaacttgttggtcatctccagaatctcgtgtggcagcgtggcactgatgagaaccacctgtgtggctggaggcaggtacctgtatacatcgtaaatctgctctttgaaacctttattcaacatttcatcagcttcatccaaaaccaacattttgatagcacgtgtncttaggcttctgcgacgaatcatatcaaaacacgccctggagtgcccgcgacaacatgctgtccgtaatccagcttcctgatgtctcgccacatttggngc

SEQ ID NO: 657984 - DNA, 1575 bp, Homo sapiens
gcatctcacaagtgtgtcctcgcaagtggactactgcttcagtagagtcccgctgacgaagaggagcagttgtgtccggatgatctttgtactggcgtacttatgagagagatcgcagtatgagcgactcggaacgtcagatgatgttgctgtgatgcaccgcgctgcaggatgaacgctgatgtacagctacgagctctggctcctatgtagtagcaggaatggcagtgcgcggttcacctcagcccctgcactcgttcgtcctaggaggccgagggagtataggaccagatcgattctataggctcagaaggcaattcccccaacctttactagctaggacacgttcccaggtaatgcccaagttggatgcttcagcagaagagcagaggcctctgggcgtccgactcctgtccgggccacctgatctggactattgccaggaccatgcttctagatgttccgcaaccgctaaatccgcagagaagtgaccctcacttgtgtacggtgactgcaagggccctgcatgttagtgtgtggggctccctccctggtgggccacacggcattcaacttggacttgtcatcagagagcttatgtagttatccaagtcccaccatcataagcataagaggccaagctttacaagacctttcaccaacaccttgtagagcaaaccaggggttcctggatgtcatccagtgcctagtggggctgcccccctttgagcggatacagataccctaagatggtttcgaatcgctgttcgccaagtactagtggcctttggtgcatctcgaattcgcagccgggctttggccctaactgaagtagccgcggtgcgcagacaacatataatctctatgaaccagagaacacgcccatatccttgaagaagtaactataggaccttccctaagggtttgtctacttccgttccaaacatcggaaggaaataagttggtcctttctcgaacaggggtggagttcgcaggtccgaccatggataaacacaacgtgcccctttaatttacgccctttgggcggttagatataaccgcgcctcatacacccggcaaccgcgcgtgtatcgaacacgggctcctaccatatgtcagcagaagctaggaaaaacagatcgttagggtcggccgaaggtgttctatcattcgcagaaggtagggttactcacccgtgttcccctagggcctccccaggcaaattatgcccgagatgttcctaacgcgctacagagctaatacccgatattatccccctttctgtgccccaaagggaaattacttttcaccacggcgacaaccggtgtgctggctaaaataccccacataaccttgtatgtgtgcatcttagggggccgccccgtattccgcagagagcatgtttagtgtagatccgtaaaacagtctcgccagattatattgtctccacgacaaccgccgcggcaagtgctgtggctacgcatcaccatgttccaaggcgcccttagtgttatcttgcttcgtcgagcaccgtgtgacatcctgaacatgactcgttgcttgatagatgcgctt

SEQ ID NO: 657985 - DNA, 424 bp, Homo sapiens
  misc_feature (407)..(407): n is a, c, g, or t
ctgcgagtgcatttgaggcttaggggtagtcattccatctttagattatccttggacttcagctaccagcacagcatgcattagccttggtcctgtaggttaactgaagttcaaacatcagtgccagcttgcctccatccttttcacatattatgcaggccaattgacatataatttgttcttaaaaataggggcatgaaatatgtgatctggaaagagattgtactttctaggactcttttcccactctatgcctcttgtgtgctgcatgtttcagtatcctccctcaacaccggtgtattctcccagcccaactcagtgtgtctacatgcctacataaattccctcaaacttgtctcttccctggatataggagcacagcgctaaatgaaaaacacgtcaataanaagagctttcatcctga

SEQ ID NO: 657986 - DNA, 385 bp, Homo sapiens
atagcggtccgagatgatggagtggggcatgcgctgcgggactggtgggcagctccgccctcgtccctggcttgggatccactaggcgaagccagctgggctcctgagtcaggtggggagttggagaacgtttatgtctagctggagtattgtaaatgcaccaatcagcactttgtgtctagctcaaggtttgtaaatgcaccaatcagcactctgtgtctagctcaaggtttgtaaatacaccaatcagcaccctatgtctacctcaaggtttatacatgcaccaatcagtgctctgtgtctagctaatctagtggggacttggagaacttttgtgtctagctaaaggattgtaaacggaccaataagctctctgtagaatgga

SEQ ID NO: 657987 - DNA, 382 bp, Homo sapiens
  misc_feature (241)..(241): n is a, c, g, or t
  misc_feature (330)..(330): n is a, c, g, or t
  misc_feature (351)..(351): n is a, c, g, or t
agtaatataggaaaatataccctcattttgatgtggcatctttgtttgaaaagctggcccaattaattaaaaatacttgtaatgaaagtctcgtttcctgagcagtccatatttagataaatgggaaaagacatctatagccagcattttcatagatcttcactgtagactaatgtcaacaacaaaatttaatcatggcagtcttgatattttacagctccacgcttttgagggatacacnttctcaggtcttcatttacatgtgaggaacctgcaacaatatacactgcctattactatggtaatgcggagttaacagaatagagtccntcatgtaaccggttagaacantacttttctacttagtccttcaaggcacaga

SEQ ID NO: 657988 - DNA, 128 bp, Homo sapiens
  misc_feature (15)..(15): n is a, c, g, or t
aaaaggggggggtgnttgggggggaaaccccccccccgggggtgggttattttttttaaaaaggaggggggaaaaatgggccccttttttttttggggggggttttttaaaaaaaagggaggccttca

SEQ ID NO: 657989 - DNA, 113 bp, Homo sapiens
aagtctcctggctttggcctgtgtgtctgcttctcctgcaaacccaggctctggccttgcatcaggcctactcgcacagctggccatgtgacctctccagtgctcactcagcc

SEQ ID NO: 657990 - DNA, 379 bp, Homo sapiens
  misc_feature (13)..(13): n is a, c, g, or t
  misc_feature (256)..(256): n is a, c, g, or t
acggatccccctntatcgggagaagtgcgggttgagaagtaactatccctgcatcctggcagccctgtggcagaagcccctagggacggaggaaatgagagtggcctatgtccagaaatgtaggcccagataatcttgtccaggcatcccctcccggtgtgctgccaaccctcgaagaagcatgtctaggccacgcctagtttcgagaggactgagaagttggaaaaacgaggtactctgaagggaggcctgcgantgctacccgaacactctgccatacaggatattttagcctgggtgttgggcaccaggacccttgcctttgaggcttccgttgttcggtcatgctgctgccccgtggtggccagtcccgagcccc

SEQ ID NO: 657991 - DNA, 1448 bp, Homo sapiens
  misc_feature (578)..(578): n is a, c, g, or t
gagtgtatcttctcaagactgcgggggtctttccctcgggctgtccttccgctggttttagcaccccgtggtggccctctccttttcacgacacgcgggccacactgggttgggcgctcccctagtgagccccgctttgatatatcaccgcgcctgggaggttgtctctatattttgtggcgctcgctcccccatccatatatgatacccctttcgggggcggatggaattttgcctccccgccgcttcctcacaaatggggggagccttctcgtcgttttgtcaccgcgagcggcccaccaatctttggggaagttttcccggtgaaattatcctctgcgaggggtgcataaatttcgggtgggagggcaaagtttagggcgatccccacgggatgccccttgtgaaagggcgctgttgcacccccctcgcccagagaggaagactcttataataaggtgaacgcatagagctgttggggcccacagccgcaacagtattacgcacctcatataacatttgatggaggaagaatagctcctggttggagaacaacaccccagaggtttctttggcgnccacaaatatctcgggaaaaccaccacgagttttttgaatgggcgcccccttcacttcccccaacggaggggattatcccgaacccccctctttttccttcgtgaagagggagtgcctatcccgccccatattaggctttccacaagggcctcgacacgacataatagagataggggtccacctcaccctggggacaccacactagaaattgccgagattagagttttattaagggcggcgctcttccctctttctctgctcgcctttgtcctctgacacagctcgggcgtatacacacccctgcgaggcacacgttgtcgccctctggttgtgctgtctctctctgaggagagtccccggcgtctctctgtcccctcccacagtgaaactgtttctgatgtttgtttgtgcgcgccctcctttgcggcttgtcccgcccccacttttcgcgctcttctcaccacggctcacaatagctctgctcacatattcgcgcaccccttggtcacacacacacgtgcttctccaagcaccacatttacacggggagacccctgagagtgtgcaaacaccgcgttcacgaaaagtcgcgtttgtcgtgttcacatccgctgctattgtgccctggcacacggcctggcgacacacgccctctggctttccacacgccctcgaggcgctggaagaggcccgcaggttatgttgtagttccgcgcttgcgcgtggggctgaacttcctcgttggtttgaagcccccttttgttttgccctctctgggggttttttttggtcccccacggagggtgggtggaacacggtggactggaattttttttgagggccaataaaagttttcactggtgtgtata

SEQ ID NO: 657992 - DNA, 1972 bp, Homo sapiens
tgagagaatcagtagtctggatataatcacaattcttgtacccctcgttgttacctaatgtttcagtctctgtatgctcagtaatatatgaaaaatagtatctcccttgcaagggtcattgtgaagactttgtttatttccacggaagggcctacagatgtcttttctggtatcattttttggtagtgtgtgtgtgtttgtgtgtgtgtgtgtgtgtgtgaatcagcgcctaatagcactatatgcacagaattatactgttcctcctgtagccatgaatgaagatcagaatgctctttttccagctgtactctgaatttattgagaatagatacctgttctgattatgcagtgtatgccaagtgccaagcacagagtagaatttccttagtggatttgttctaggtccagagtgtagcgggcctgcttcttagagactgctttatattcagcaaagtcccaaggtactatattgttaatttataaggagaaaaacatcatgtaggtggctacaagcagtactcaaatctccatgtccaatctgcatgctctgttgtagagtctgtcctacataggtgatcataagcagagaatgtttagaaagcctggagtcaaaccaagaatatgcttttcggacttttgtttatagagcatctgaggctgaccacctcactttccatgtgatacattttatagtcaagccttgctaaccttgaacccattttattgctcttcagtttaagttctgtgaagctgtaattaatccttttcaaaacagctataattctcttattccactctgtcatactcacctgtcaaaacctcagccctggttaaaaccaactattggtcagcttacttagctttggccttctcttttgtcttcattttatttgcaggtgccatctagtcccatgtatttaaatacttcagctggtggctctgaaatttctagcaacagtgctgccctctcctgagctccagacttagatccaaatgtctccttgatggttcatgttggaagacttcaaggtcaaacacatgtacagggttaacatgactttatttttttcaccaagcctgcctcttatgtttgcctgtttgttccatctaaaactctacttttcctggattctttactttccagttgtcttgcatatgatcatccaaatgtcccaaaagtgcccatttctcttcttcaccactaccttggggtccatgccactagtgttttcttgcttgatctgttacagtgacctgactggtctttctgctttcactcctacacactcccccaaccctctgtgtgcaagagcagagcgagctttttaaaataaaagtcacatgccttaggtaatcctcccatgttccactatcttggctcattgaattcctgtcttcaggaatcttgtcctctgccttacctcaacctctcactctggtcttattcatttccagtaatcgaaccccctccctaattgtgtgtatccttctctctgaccatagctcctgtctttccagctcactttctgtagtatcccagatccagtaatccttggatcctactaggaccttcaagccactacagacaggctattacctccatgaccccaccaaagtatgccatgccctcctagtttacggtgtacctgacttagcagccacacctcaacctgggcccctggctgctccccatgtccctgacccactgagattagcaggtcacctaatccatcttccctgtctgctgggccagccaggacctccccttgaactccactgggcccttactggcctgcttgacagctccacttggatttctggtattcttctggcattctttctgacctttacccaccaaactgctcctctcacaatttctgccatttcagtttaatggcaactcttaattattagcatatcctgttggttctatgtttaaagtaaatccattggagtccagttactctgg

SEQ ID NO: 657993 - DNA, 620 bp, Homo sapiens
atactattaaccagcaaaaatatatttaccatacttttcatagatctgcatcagaaaagatcacactgggaaaaagcctgacatatacgctataacaactgcactctactacatccaagatcagaatactgtttcttgctctatttacacagctgatatacctattctaacgaaggagggagaggagtaatgcacaagaaactcaggccaatgggggagcaagaagaaaacgaagaagtgcagtgcatgcgtcatcggtgtttaacagtcagaagcgaaacagttcagaacaaggcctgccctgtcaaaagaagagctaaagacagttatataaaaattaaggtgggctttcagactggctaacacaacaacattccatgagtagatggtaatttatttttgtttatccatttcgttgggagcaaggacaaaaatgtaaatctacaccttgcttatcacaattgccgacaaaagaatgctctgccttttaaaaaagtatcatgatatagtagaccttgttaaccaatttaatatgaggaaaaggtgtccttttcctattcctactcagatgccagtgtaatgcgtttacttccggggggcgttatttaaaacgggtttgc

SEQ ID NO: 657994 - DNA, 767 bp, Homo sapiens
taaattttctagatctccttaaatactatcatttttcactacttgtatcttaactgttaagttcaacattttctataatattaatatgttgtgaaaatttccttactttcttatttgtcccaggttcaatgttttgcagtctctacctcaccctgtgaagcataaacattgtacatgctgtacaaataatacatagttcatgtgcttagagattgcacaatttttatttggttgacaatagctaatgttttcttcttcattttctatttcctgatttttctttatttagtatatactacattatcataaaaataagaacgttttacaaactaaagcaaaagcaaccctaggaataaaatgcacaaataaaatatataaacatacatttagatgtaccatgtacccttgtaatttatttagacatttaattttagtacaattttaattaaagtctgtgtattatctgtcatcatcttagtattttttatataacaaattttgtaaatcaaaaagtctcaatgtcattataaagtatcttggcagaggttgatctccaaggaataatttctctcccaaattatgccaatcagaatttcactctaccataattcttttaatcagtttcagaggaataataaatttcaaaattgttcaaggtacttcttttagttcaagtaccttttgacaggtgtaaaactgtagacagactgatacaaacatattctaattgactcaaaattatatgggacctattttaaaatctagat

SEQ ID NO: 657995 - DNA, 305 bp, Homo sapiens
cgacagtagcaaggagcgtcacccaactgcagccccgatgagccgcaggagggatgtgcatggcggtgggcctgcttcttgggaggggtgaacaggatcacatggataagcgaaggtcctcgtcaacaaagctgggcacgatggctgcccggtcgccttcacgatgaggccggatccggatgaactccggccgcagaaagggagccacatctgtgtcgctgtgcacgaatatccggacgggattcttcgaggagacagaagccagatctttcacctcgtctgtcatggtggccgagcagagcatg

SEQ ID NO: 657996 - DNA, 240 bp, Homo sapiens
aaggcccggggggttttttttcccccccgtttagggccaagggggtttttggggttttttttaaggggcagttgggaaaaaaaggtaaaaggcccccaaccccttgtgaaaattagattggtgaattaagggtcaaagggggggaaacttttttaaatcccaaccccctaaatttttaaaaaaaagggggaacggttttcatggggaaaacttttttgccccaaaaaaaaatgtttttta

SEQ ID NO: 657997 - DNA, 891 bp, Homo sapiens
tgctgttcacgcaagagaaagacagatggatgttaaggttgacgttgtatggctggaatttgaacctccagcagtgtctgacatttgtggaacactctggataatggggacttctgctcaacatggcagtggcatgtaggcatgttagggctttgaaggtggggcattcacattcatctgactgtaaatcccaagggcctccgtttcatgctaaattgagaatctaaggggtaaagcaccccctccaggaccgggttgctcagccttggactagtgctgtctgaccattctctgtgtggggctgccctgtgtatggtgggctccacccatagattgccagtggcaccccctcccagagatgacaaacggaaaatgtctctagacatttgccaaatgtccccttgtggaaacatcccctattgagacccactgctttagccgaagagaaggggttacttacgcgacgaatggggaataggaaaattcccagctgagagaactaagctgtggctcctcagctacctgaacttccttaagttcttaatccccttagaatttcatcttcctcgaatgagccagcgttcttgaaccccactctttttttttggccccccccgaccttccatcctgggagtgtagagggtcgtcagcccgggactcctaaggtggctcttaaggggcactgccatttgttcctcttcaacccccaggttcctggtaataatcccacgggccgaggtattggcatctgacataagacttgtaagtcccgaaagctcttggaggtccccctttgaaaaatggggcttggggatttgaatattccgagaacatcatttagagactgggcccttgtggtcacgacacactgttaggacaatttttttgacg

SEQ ID NO: 657998 - DNA, 880 bp, Homo sapiens
tggtaagtcttagcaggtcatccatggagctgcgtggtgagagtacgtcggggcaggaagggaagccgcagaagctgcgggtgtgcctgtgaggcgccgggtgacggcgaccctttccagggtcctgtttgtctggtgcgtggcccagatgaaggacaatgtgtaacggagttattctgaccctctggttgcagggggaagatgctagctagctgggtgtgcggcggctctatacgaggcacctctgcgtcggtgatgatgtaagatgatgcgggaagatgaaaatagacagttgataacagaatcgtaacgttacgatgtgatccagtctgcaatgcgggcgtgaagaccgtcttaaccaactagccttcatgaccagtttaacaagatggcctgccgtatccttatggtgacagtaggacattcaacggaagacttatgctctacttggcaccaagcattctgtgtcgtctcctgggaccattccccgtccctgacgagaacctggttattcttgcgtctcagcaacgattagtgccggctgtcagtcatagactccctgtcgcgggcgacgcctcgctgccagaccccggcatgacgatcgcacacctctcctcctgtgtaggactcctcggtgggttggccaccgcctcctcctcctcgtcgcctatcctcaccccatcatgcttcgggggactgtcactcctgtacctcgctggtctgtctgagcacgcctgcccgctcctggccgtacgtccgggcctgcctttcctgctctgcattgcgctcctctcccccccggcctgctcccggcaccgtcttcttcgcccctcgctctctagctgcccgtctgccaccgtctcctccctcccgtcgcgcc

SEQ ID NO: 657999 - DNA, 204 bp, Homo sapiens
atgcttcttccactgacctgaccaccccctatagtcctgtcctctgcttcctggtttgttttgttttgttttgtttttaggtcatttccaacagtgaaaacccgaatgctaccttgctttggttttaagaaatgtcaggctataagccattttttggtgctcactggtttctgaacactgaggatagaaatagccactttcata

SEQ ID NO: 658000 - DNA, 148 bp, Homo sapiens
gtgattcctttgtctctaatgctcttttctgcagtttctttctttcttttcttcctactactctactaaatcttactccctcttcccatgtcttagctacttcccagcaaaaaacaccactcccctggcactgctgccgcgttctttt

SEQ ID NO: 658001 - DNA, 328 bp, Homo sapiens
ggggcgactctacaggatcccggcagctatccggttcaataggagtggtgagagtaggcatacttgtcttgtccagtgttagggggaacactttcaactttgcccattcagtatgatgttggctgtgggttcgtcatagatggctcttattattttgaggtacattccgttgatgcctagtttgtcgagagtttttatcatgttgggatactggattttaatcaaagacttttttcacatctattgagatgatacagatttcgtttttaattctgtttatgtggtgaatcacatatattgatttgtgttcattgaaccggatagcttg

SEQ ID NO: 658002 - DNA, 385 bp, Homo sapiens
gcggctatctgcagcactctctctcctggacctgcaagtattcagaatgctaaggcaagcagagttgaatccagatgtcacgaggattacagagttctcatacattgctggtgggaatgtaaaatggtgccgctgtttaggaaagcagtccagcagtttctcaaaatgctagacatagaattcacacagtaactctgtgtaacattccacttcacaggattgaaagagaatagaaagcatatgtctcacacaaaaacgtgtacataaatgccccatcaggagcattattcataatagccaaaaagtggaaaaaacctaaatgcccatcgatggacaaatggataaacaaaatgtggtctatgcatatgatggaatattattcagc

SEQ ID NO: 658003 - DNA, 699 bp, Homo sapiens
  misc_feature (18)..(18): n is a, c, g, or t
  misc_feature (50)..(50): n is a, c, g, or t
  misc_feature (96)..(96): n is a, c, g, or t
  misc_feature (107)..(107): n is a, c, g, or t
  misc_feature (137)..(137): n is a, c, g, or t
  misc_feature (155)..(156): n is a, c, g, or t
  misc_feature (164)..(164): n is a, c, g, or t
  misc_feature (182)..(182): n is a, c, g, or t
  misc_feature (186)..(186): n is a, c, g, or t
tgggctctctgaccagcnccatggcggtgggcaaaaacaagcgccttacnaaaggcggcaaaaggggacccaaaaaaaaagtggttgatccatttnctaaaaaagantgggttagatgtgaaagcacctgctatgtncaatataagaaattatgnngaaagacnctcgtcaccaggacccangganccaaaatggcttctgatgcgtctcaagggtcgtgtcgtccgaagtgagtctggctgatttgcagaatggatagacatgttcgcttatttcagaacatattcaagctgattactggaaagattgtccaggggtcaacaacactggcctggactaatcttcccatgggccatgggattcttacccgtgaccaaacgtggttgtcccatgggtcaacaacaatgggcagcacatctcgattgcgaacgctccacgtttcgatcgtcaaaagactaccagatgggttcacttggctctcgtctggtcctggtagtggcgtcttaactaaaaacacgcaccaatcagaatcacggagaaacctctttatgtctccagccaccaacaggtcccgccaaatccggacagacggcatcgtctggacacatccatggacccggagaggtgcagacacattgcacttgaacgaaggtggtccactcaatggcatcccagacagccttggcaacagacttgcag

SEQ ID NO: 658004 - DNA, 106 bp, Homo sapiens
gatctgtttcttaaagctacagggtttaaaaaataaaaatgagtgaaaatacttgatgtttcttgaaagataaatttaataataataaataaatacataaatacat

SEQ ID NO: 658005 - DNA, 245 bp, Homo sapiens
cttgggcatatcttgatgacattgatgtaaaagtcatcacacattcaacggacacaaatccagcagcacacggacaggttttccaccatgttggggtaggctttattcctggtgcaggtttgtttcaacaatttgaaatcaataaatggggattctacaataattgggcctaaacatggacctattatccaataatcaggaggtttataattaatttcctcaagtaggcctcacgaactaggctg

SEQ ID NO: 658006 - DNA, 406 bp, Homo sapiens
tattaatatccatccatataaggtgttacttcagttttttcgtatttgttgagacttgctttgtgttaacatatgtgttcaatttgggagaaaattccatgatctgctgagaaagtatattccttcgtgtttcagtgaaatattctgtaaatatttcttagatccatttggtttatgatgtcagttagctccagcatttctgtttagtttttgtctggacaacctgtatatttatgagagtttggtatcactatgtgatgttcaatatgtgactttagctgtggtattgttctttttacaacttgagtgtcatagtgcaaacactaatgcatagatctttagactagcaacatcttttttgtggatgcttcctttaatgagtatgtagtgtcctccccgtcgacgc

SEQ ID NO: 658007 - DNA, 239 bp, Homo sapiens
aggatcccccgggcccctcaccctgagatggggtggaaaaggagggagttgctctcaggctgcgtccagcaacagtgccgggggctctgatgagtctctcatcgcttgtaaagcctgagacagctgcctgtgtgggactgagatagcaggatttcttcacacctctccttcagacttcaagagcctctggcatctctttctgcaaaggcacctgaatgtgtctgcgtccctctccttca

SEQ ID NO: 658008 - DNA, 333 bp, Homo sapiens
tgaaatgggacagtaagagctcccccgaggccaagtcctgccgccctcctgccctgctgtggaccccagtgcaactgtgagcatccgaggtggtgaaggggacctcacagcacacagagtgcacggcgctgcagcccaaggagacctcatcagtgtgtcggctctcattttcgttatttttcctattattttctctatcttctgaagtccttatgtaaggaattatggtttccggggagacccattgtgataaatgccggaaaacaaaagcttttttccagggcgctgaggcctgtggatcctcccaggccctggtcatgctcctgtgcccac

SEQ ID NO: 658009 - DNA, 1091 bp, Homo sapiens
gggcggcggcggcgcgggcgccggacaggaggagaagcggatgagatcgtggggctcaccatgcgtcccccgatgtgcttctagacgtacgctgatggtgatgttgagatgttcatgacacacacaagaccgaaggcatcgcaccgacggctctgtccttgacccatcaaccatgacatccatgcatctctgccagaggcagcatggtccgcagggcaccatgtgggcccagacagagtgacagcacgagaactgtgctgagaacgacgacctggccaccagcctcgtcctggacccctacctcggtttccgcacccataagatgaacgtcagccctgtgcccccacctgcggctgacagaagaatctgcgctcagcgctggaaactttcctgaggcaagcgggacctggaggctgcgtaccgggccctgacgctgggaggctggaaggcccgctacttccagagccggggcccgcggcaggaggctagcctcaagacccacgtactatcgataagctccgtgacttcctgcctggaaagtggcttaaccatcctagcctagcaacgctgctacctccatggagaccaacggggccaaagatcgtgtccactcgtgcttgggacaacaagaatgacgaagctggagctgctggtgggctgctttgcagtagcttgcgggaggcacgctgcggggctgcatgcagggacagatgcagactgacttccagacgtcaatgatcatcaagcctgcaagcggactagatcacctgttgctgcgcccagacgcatgatcaaccatgactgcaaccaactgacagttggtgcttgcaatggaaaggacaccgagtgaaggtgtctcgggaacttgttagcgtgggacgaggtggactgtgctaacggaggagggatactacgtgaggaacacaagagacaggagatggcacaactctagcagagcagtgagtcagggagtacaacatggccttggacctcgcttcatccgggcccgtatatagacaaggttgacaacgaggggtgatgatgtgtgtgtaaagaccattgacaaccaggaacctcggagacgtcatagc

SEQ ID NO: 658010 - DNA, 438 bp, Homo sapiens
  misc_feature (422)..(422): n is a, c, g, or t
ggcaacctctacccccgcgggtcaagggattctccggcctcagcatccggagtagctgggattacaggcgcgcaccaccaggccgggctaattttggttttttaagtacagatggggtttggccatgtgggccaggcgggtctggaactccggacctcaggtgatccacctgcctcggccccctgaagggctggggattacaggcatgagccattggcacccagccagatctagaccttttaaacaattgccttggccagtgggctggtggtaaagcataggggacatggggcatgggagagacacggcaggaggacagagcttggcctccgggtggccaagcttcggctcagcaggctcctgcagctggggaggcttctcggggagcatccagaagccaccggtttcttccagaacccggnttgtgtaggtgcattt

SEQ ID NO: 658011 - DNA, 86 bp, Homo sapiens
  misc_feature (14)..(14): n is a, c, g, or t
tcggcaaggcgagntatgaagaccttgctttagaaatcttcaccaaacatacttcaaaagataacagaaaacctgaattggaaagc

SEQ ID NO: 658012 - DNA, 392 bp, Homo sapiens
gggaacacatctccacttagctcacctactcagcctgtgcagaagacagatggatcttggagaatgacaattggattaattgtaaacttaattaactagtgattccaagtgcaggtgctgtttccacatgtggtttcagtgctgagcaaacgatacgtctgacaactggtttgcagttgttactgagccaggcccaggtttgttctgttctcacacagtaaatcaatcactgtgacatgggttttgcaaaagagagaagaattattcacaaggctgtccagtgaggagatgggagaatggctctcaaattcacctccccaaagatgaggcttagagagatttataggttagagaagtagggtggtctgaggcatggggaaaggtgattggca

SEQ ID NO: 658013 - DNA, 197 bp, Homo sapiens
ggatccctgaaaggcaggatgagaaagtgatcctggaaaaacgcgaggttaactatgaacaagaagaaagagtcaatagcagatctaaatccacaagaggctgggtgtggtggctaataccttaactaccagcactttgggaggccgaggcaggaggatcacccgagcccgggaatacgagctcatgtcatacatgt

SEQ ID NO: 658014 - DNA, 152 bp, Homo sapiens
acggtaagcacactactcctctgataggcacaatcctctctcttctgcttgaagttgtaccttgatgtgagattcgctctatctcccggaccccgtaactcggccgtcgcggtgatgcgcaggaagaagcccccgtttttgcagtacagccg

SEQ ID NO: 658015 - DNA, 162 bp, Homo sapiens
gacatgatacaagtcagctctgtaccgatctctagagcagctagccaaagcaccagtttgtaaaggactcttccgtcagagatgggaaaaccattggggaggactatggacccatatgggaattactacctctcagggccgagaggacacgaatgttcagga

SEQ ID NO: 658016 - DNA, 1746 bp, Homo sapiens
ggagcgacgggctgtcggcagaccccgaggttctcgtgtgcgctcagcgtgccgccgacgctagtgagtgccgcgctcctgccccgaataccatgaggcccctggaaagccttcctgctccatgctgctcttgtggcgctggtgcagcatgcatggcctgtggcagtggtgcctgatgggcccctggaccgagggcattcttctaaccagcgaaacatgccagttgacggactgacacgacggacgcgacgcgacggacgcgaccgactgacgtgactgaccggacacgaccacgcaccgaccctttgcaccgtcacaccggacacgacacacactggaccgctctatgggtacactacaacctgacctgccaaacaccctccatgcgtaaactccccgatcggacctgaccaaaaaaggagcaccacgaatgtacatgccatggtgaagaatgtctacactggccgtcccacatgagctgattggcaccgattactgcacacgacaagacatataggcgctacccgcgcaaactactggataccaacacattgtccccacaccatctacttgcgcacgcgaatacaacacgcattccctccccctcatctacccctcactacgggccacaaggaactccgaaactgggcgaccccctacaccaacggctcgtagggcggccatgggaaccaacggcccacgggaccacacgacgcgctgcacgccgcgcgctaacccaacagccaccagctcacaggcaactcccatctaaccgaacaccgggagggcgaccggaccatggcaaagcaacccaaacagacagggcgccaaacccaagaaaacaccacacagagggaaacgaccaccgttcggtccggcccacaagtgcgcaccagaaacgcacacgcactccgcccaaggccgcccccgaacccactgcgcacggccccatcgccaccatcaacgcacaccatacaaggagcgcaggaactgatacgcaccaacgaggcacacaaaacccagcacactgcagacggccggcggcacaagtacgtgcccgcccactcaccaccaccacacgggaggaacgctcgcactggaccccaacacgggccacggacccacagtggacgcaaacacagacgacacccacgacggctcgcgcaaagcgggccgcaccaccgaacagactcagaacagcacagaaacgtcccacccaatataccgccaggccacaaaacggacgaagagaccagcagagccaacaaagaagacaaagagcaacagaacggcacagcacgacaccccgcacacccacgccacccggaccgcacgaccccacacacaagccacagacaacaagaacacacgcagccccgaccagcaccaacgaggacacgaagagaaacaacggaccaagaacagcgggaacacgccaacacaagacaacgaaccgcacagcacgccccaccacccagcacacacagcacaacaaaccaccgagccaacgaccgaacacccaccccacaaaccaaccaaccacccgaccacacaaccaagcagagacacacacaagaccagcaggaggaagaacgaaacaacagaagacggccaccagcaaaacgcaacgaacatagacacaaagacaacgacacgaacgcacaaaagccgcccaccgcacgcatcaacagcaaccaccacccagcgcccaccccagaacaccaccacacacgcaccacgcacccc

SEQ ID NO: 658017 - DNA, 668 bp, Homo sapiens
  misc_feature (259)..(259): n is a, c, g, or t
taacctacaatgccaatccaaggttcccaaatcgcccgcacatcctggaggggcctgtagtcagacggtttggtactgaggcggaggtttaagaaggtgttttgcgactgttatccggaagagtgctttgaggagtgtgtgtggccggatacggacttattgttaggagacggtctaaacctttcgtctaagttccctcgggaaggggattgtgggttgactgctacacctctagcggcagcgaggagacgtttgaggnaggcggggtgtgtgtggcgtgctgcttaagaacttttgtatttttattacgtttgtatttttacgatcggtataggttcttgcaggtatgcggcgcgggctatgtaggaccgtaggaagggcgagaaaaccgggaaataaagcgaggggagcgttacgatgtaggaaggaactttaatttactcgggataccgaatatgaaagtaggcctctagcaaactttctacccggagagtagagtagagacctcctcgccccgacgagtatccgagactagtttgactacgagactctctatatcttttactttgggagggggttaccgacgctcaggcctcgtcgaccttcccgttgcccgcgtctatggttaatgcgctttaggttttgtggctgtacgcgtcttttagttt

SEQ ID NO: 658018 - DNA, 436 bp, Homo sapiens
ctaccagagacatgccgggagctggacttcatcagcagccttctgaaaagccacccagtgcgagagctgaagaaaagcaaggggagccgaagaagcctgagcagccgtttgcagcgccttggtcaccagccggcccactcggccaagaaaccttacaaatgcgatgactgtgggaaaagcttcacgtggaactccgagctgaagaggcacaagcgagtgcacacaggggagaggccctacacctgcgtggagtgtggcaactgcttcgggcggcagtctaccctgaagctgcaccagaggatccacaccggggagaagccctaccagtgcggccagtgtgggaaaagcttccgccagagctcaaacctccaccagcatcacaggctccaccacggtgactgagagcagggcttcccgctcggctcacaaggaggat

SEQ ID NO: 658019 - DNA, 152 bp, Homo sapiens
aggctatggacttctggagaactacagccatctattcccagctgtccctcagtggctgcactgcaccctttacctgcacctccttgttgcttgagcctccagaaggtccaggtatgccagaaggtccaggtatgccagaaggtccaggtatg

SEQ ID NO: 658020 - DNA, 310 bp, Homo sapiens
gggggggtttccccctttcccccccgggggaaaaaaaacccgggcttttttttttggcccgggggcccccggatttaaaaaatttgcgggattccctggggggggggccctttaagccttttttaagggggttttttttggggcccccccccctttaaaaaaagggggtttaacccccccgttttttctcggggggggggggtttttttaaaatttgcgggggccccccgtttttccacccggggggggggaaatggggtcccccccccccgggccccttggggcccccccctaaacccttgggttttta

SEQ ID NO: 658021 - DNA, 1202 bp, Homo sapiens
  misc_feature (451)..(451): n is a, c, g, or t
aattgtaccgatagattggctggtatgatgccggtgcatcgggggggcccgggagcccctgtatgcgccttggcaattcgagaatcgcgatgttcttccagcgaaccgttaccgggagatgaccattcaggcgctcgagggtcgacgcgccagtggacaggcagtcgagagagactgtgagaccgccgagagactccacggatagcaaaagcggattgcatacaccgaagtgagatgcaccggctcactcatatgtttcggggcccagagtcaaggcttcgagaagagaactgttgcacaggactctacttttcctcgtaggtaagcgaagcattctaatgcatacgtgacgttccgcatgccctcgattacatggggatactcctaggcaggtactcgaattaggagtttgggcttaattcgcctaggaagtcgttccctctttcatacnaagcgcatttccacgcgggttttaggaaacgcaatttaatgccctgggttagaccgattgagaagccacgcaagcctcggatgaaccgggtccgaagacagaccttagctcgaaggggttctcccaaagtgactcttaatgtgccattgctatagtaccggggcggatacctcaaccaacattgggagcccaacggattcaagggtccttcgagtgcgtggtttgaacaagtgtgccattacccaaagggtagaggatagggaatcgaacccggcccaacatccctggttgcgtggaaccctaatcaaattcactttgggacgcaaagagccagtctttccaaactcgtggtccaccccgtgggctgctaggcagggtctttgacgtgaggggggacacctagagaagtacgtggtacaggccgcccagacactgttgtacccgtttgccagaaggctgaacaggtcccggcagggcgggcattactgctgacctgggtaacgacccttcaatccccggggaacccgcaagagggactcctgggcaattcagagcataccggaatcccttgtgcggttacgaaaagctagggtcattgattgggcagggactcgcatgacgtgcgtaaatgcgctcaaacccgtggtgtttagcataggccaatcctgtggaccaagtttctgccagggacacgcgtttggaagcccatatcttatgaccttatacaggtaactgtaaccccgaccttctg

SEQ ID NO: 658022 - DNA, 110 bp, Homo sapiens
ggggagtggaaagccaacgaccagcagatcctcccgacctcagacggttggctgtccctcgtcccagcctgttacaacagagcctgccacgagctatatgccctgacacg

SEQ ID NO: 658023 - DNA, 312 bp, Homo sapiens
atagaaattcctaattgtagcctattgaaatcctcactttcctattcttttaaagatgtttcaactcaagtgtttagatgaaacaagagaaaggatgataaattattattttaaaaattgatggtagcaccagttagatccataacagattaaacaaggtattacatatatcacctatcttacttcaaaatttaatcttaatttaggtaagaatatagctttaagaaggcatattttggatgggaaataacattcatttgcctactgatatgtccacataatatttctgataatgcatgtatcagactaaat

SEQ ID NO: 658024 - DNA, 102 bp, Homo sapiens
gccacataattcattaaaaatgtttttaatgaattatgtggcaattccaggaatgttctcaaaatgaaatattcatactttattaaaaacatttttttaagc

SEQ ID NO: 658025 - DNA, 433 bp, Homo sapiens
tgaacctgtgtaatgctttaccttgtttacagtttggcaaagttgcagtttgttcttgtttttagtttagttttgttttggtgttttgatacctgtactgtgttcttcacagaccctttgtagcgtggtcatgtttgctgtaatatttcccactaattttcttgctgtccacatcaacatcttaatcatttttttatattgatctctaccttccccatgctttgcccaggtccattttcttttctctcattcacaagatgctttgaaggttctgattttcaactgatcaaatctaatgcaaaataaaaaagtttgtattcttcactattgagtttcttctttggtaaactatcactattgagagatgggataaacctgaatgtataaagcatttttttgtcaataaactgccttttgtaaggggttttcatat

SEQ ID NO: 658026 - DNA, 114 bp, Homo sapiens
ggtactctagtttatcccgagtctgctcggacgatgttgattacgggctggcccgcagcagcacattgtggtctgacaggctacccactagaatgtctagggtagaagttctca

SEQ ID NO: 658027 - DNA, 694 bp, Homo sapiens
ggtgtttctgtcgccgtcgccgcgtttgaggtcacctccgacggctgcgcgtcggtctacgggcgagcggcccatccgcgaaatatcacatactttgcgcaccaggctcaattacgcgttagtcaagctgcaaaatggatggacggacaagacacttcccgaactggagacggagcttgctccagcagtgcagacgccgccacgtcgctatcacaacatatttccagatagtgcagacgcgggtacttccgcgcatacagcgtttcttcaggcgctcggaggccacccaccacgggaggaggccacggctgtcgaaacactgatgctattgtcgtcgcctaccaagaagcaacaacaccgacccgtgccggcgacatctgctggagaacccacggacgaaacggagcccgagtcggataccgaagtggagacgtcttaatgtggtagtacgagttttttctccgcaatctcggagttaatgcagccgcgcccgctgctgcaccctttagcatatatataaagtgcgtaatgtgcgtgctaaaaaagctcactagtgcgtactctgcttatctctgcgtatccgccgatcaacatccgcggctaaaatggaacagaacaggttcaagaaagaaacgaaaacttgtagcgctagctggccgcgcgcaccgcagtcgacgctgtgtgcgacagatcg

SEQ ID NO: 658028 - DNA, 157 bp, Homo sapiens
cagttgctttgaggcgcctccacgtctttacacacagctgactgaactccgacattccattttcccgaagtggtacatctcagcctttctttgactccagataaacatgaacccttggtggctacttacatagcagctcgtccccaattcggctggc

SEQ ID NO: 658029 - DNA, 112 bp, Homo sapiens
gtgcatgtgtgcggtgatttagaggatccctcagcacatggaggatgagatttgctcctggcacagagttggaaataacactggcttgagaaaccgagattccagtctcagg

SEQ ID NO: 658030 - DNA, 410 bp, Homo sapiens
ggtcttgtgatggaatccaatcttccaaagtgcgaagatgagcacgattaacagcaacaagccgtcaaaaacactcagcaggatgacccataatggcactctgaccggtagcccatctatgaatatccgaaaaacaagctctctttttagattgctgctacttaaaaccagagaagcatttacactccgaagttctcccctaaaagtaagatttaagctggaaaaataagattttataaaagttggtttccacaagataaacgaaacattgacttggctgatgtcagaagaagtgagattacatgtgatggtagcaaatttacatgtattgcagaccagaattgtgcctcgtttgagatggtcagttgatgtagtcattttctttccaaagtcgatactgaaaggatcct

SEQ ID NO: 658031 - DNA, 403 bp, Homo sapiens
ttatgttctacccacctgctaggcccttcccctctggcagcctcaggccagccaggagctccctcctgtggctccgagcacctcctgacacctgagtgagaccctgtccaacccccctccgtcctcaggacttctggtgaccagccactgtccccagaagccacgccggacagtgtgccttctccactcccctctgacttctccagggtgggctcgttggccatgtgccccccaggatgctccagcctcaactcagcccatgcgacctggacggatgaagatcatcatcctatcagggcgatcaatgtgggttgggcaggacgttgtggtcttcaggcttgcttcgtgcgttcttgcttttgtcattgtccccctgtcacgtggggggggggtttaatttggt

SEQ ID NO: 658032 - DNA, 236 bp, Homo sapiens
  misc_feature (9)..(9): n is a, c, g, or t
  misc_feature (24)..(24): n is a, c, g, or t
  misc_feature (126)..(126): n is a, c, g, or t
cctagacancatactacgaccctntctatacaaaaaaaaacttctctaaattagccggatgtggtggtgcatgcctgtagtcccagctactcgggaggctgagtgaggcaggaggatcacttgagnccaggaggttgtggctgtagtgagtgatgatcatgccactgcacttcagcctggaccacagagcaagaccctgtgtaaaaaataaaataaaaaacagattgaatgtcttt

SEQ ID NO: 658033 - DNA, 337 bp, Homo sapiens
gggaacacagtgagcgcggaccacaattcagatgtgtatgcgcacgatgagatggggcacccagagataggagatgctattggccgcgtcaaggaggtgctggagtgcggcattggaggcaagtgtaaccgcggtttgacggtggttgtggcattcccggagctgtgggagccaagggaacaggatgctgttaggctccagagggcccggactgtgggctgtggtgtggaactgttgcaaggtttctttctgtggggagatgacatcatggattcattccttacccgccggggacagatctgctggtatcacgccgggcgtgggtttggatgccatc

SEQ ID NO: 658034 - DNA, 194 bp, Homo sapiens
cagatatttgggcaccaagagcctacctgctaaccctccctgtatctgctagacttcgaagcagcatacccccgatcccgatacgaccaagctcatacacctcctatgaagaaaacttcctaccactcaccctagcataacttatatcatatgtctccataccccttacaatctgtcacatcataatggggcac

SEQ ID NO: 658035 - DNA, 324 bp, Homo sapiens
taggccacatatataatatataaataatatatactgtgtgtcttatatatcatcaacaatatatcataagtatagtgtatgtaatagtatatattatctttaatatataaacataaaatttacatacacaaattaaattaaaatataaatatattcattgtgtatataaaatatagctattatatcacagtatacaatttcaatagctattacaatatgcacaggattacatatactgtacaattaatattgtatatatgtataaataaaagacatacacatatatatatatcatgtgttacttaatgattgggtcgtcacaga

SEQ ID NO: 658036 - DNA, 758 bp, Homo sapiens
cataacttctaatcctgtggctttaggcagtttagtccacaggacaataaggaggttgtttgggaaaggactgttatgtcatgtttcgaagctgaacttaaactaggttcctcccaaagttcattcggcctatgcccaggaatgaacaaggacagcttggaagttaagagcaaggtggagtcagttaggtcaaatcgtttttcactgtctcagtgtaattttgcaatggaagtttcataactttaaatcatgactatcacagtttttataaataatctaggtaaacaattaataaaataactaggtaaatgtaatgggataaatacttatagaccaactggacataatttagaatataaagtcatattaaattaaataatagataatttattatttgggtattttccaataaatatatcttgtaggaaaacatgttgcttaaaaaaaagtgtgtccttttttaaaaaaatggtgaacaagtttgtctaattcaaagcttattaaaaggttatatataaaacaaggtaaaaggaaccagaaaagaaaaaacaatgtaacataaagttataaacaataaagaatttttctcaaggttaaaaagctgaaaaagaaataattttatataagaaagaattttatatggtacatttagtcctaaaataaaataactggttgtttaacaaggagggatgttcaggagaaacagaaagtccagcatgtcatgaacattgggtaggtcagatagaatatatatataa

SEQ ID NO: 658037 - DNA, 250 bp, Homo sapiens
ccttcagccttcccgagtggctgggattacaggcatgtaccagcacacttagctaattttttgtatttttagtagagacagggtttcaccgtgttggccaggcttgtctcgaactcctgatcttaggtgatccaccttcctcagccttccaaagtactgggattacaggcgttacgaccccactttgaccttaaaccctgcatagtctttactttgaattgcaaatattcattagaatcttggggacaga

SEQ ID NO: 658038 - DNA, 772 bp, Homo sapiens
tttggcgacatattgttgttgtgcagtgttgatggggtggtgccgtgttcgcgttcgctgtctgccgggccccgttaaccattggtctccctcgacgggcagcttgcggccccaatttttgcactataccagtccttccgcggaattccggatctccttcgcgggtaagtcccagacccccccctgtccagcaccgggcgaaccgttccccataagtttgcgtagaatgacccgccaataaatatgtcccacggggagatggaagttttccgcgccttatattgcaggctacccaaccttcgcatagattacttgaatactttgcaggagagcccacttagaccccgaaccggcggctccttaggaccgcttaagagcacccccggtctatgtagccaaataatgggaagaattataggtagaggcgaccaacctaccgagccctggtgataactggttggtcccagatagaatctttaggtccaccgttaaatttgcccccagaaccctctaatccccctgtaaaattaactgttagtcccaagaggaacagctctttggacaaataggaaaaaaccttgtagagagagttaaaaattttacacccctagtaggccttaaagccgccccccatttagaagcgttcaagctccacaccccctaccttaaaatccccgacatattactggactcctcacaccccattggacccatctatccccccatagaagataatttatataatacagaacattttcctccgcataacctc

SEQ ID NO: 658039 - DNA, 184 bp, Homo sapiens
tatatggcattggatatgatatggaaattcgcggacgagtgacttgccaatggacacagtgagaatgcagcacagccaggccttggggataggagagtgggtccagagctcgcccttctacctcaaggaggcgaggaggcagcatgggggctctgagtcacattgggcaagaaacaagcaagaa

SEQ ID NO: 658040 - DNA, 253 bp, Homo sapiens
tcaacgccttgctgctctgcgtggcgcagtgtgccatgcctgctcccttttcttgtgtcccagccatgcagggccatccattgtgacgtcggccgcccaggctggacaccctctgccgagtcatgcggtgtgtggctgggcccttctttattctgtgttcatggctcacctgttcacactgggctgggtagggtcagggtgtactggctataggggggggtatatattttcaacagcaaacatcaatcatcct

SEQ ID NO: 658041 - DNA, 278 bp, Homo sapiens
gtgggtggtgaatgcagtctacggcagtcggtgcgcagctgtgcgggaggacttcaaggatctgaaagcacagctgtggtaacgcggtggacaaggagatctcgccgggctgaatgtgacatctacagctatgacccagacttggagtcagatccgttcggggaggatggtagcctctggtccttcaactacttcttctaccccatgcggctcaagcgaatcgtcttctttagctgccgttccctcagtggctcctgctatacaccctcataggccgc

SEQ ID NO: 658042 - DNA, 1196 bp, Homo sapiens
  misc_feature (488)..(488): n is a, c, g, or t
ggagagagagagactagttcgagtttggtttttttttttaggcagcttagcttaagatatttattcaaggctctcactttgggcctcggtgtgacccagaaaaagcggataaagcagggttaggagccacatgtgagtgcattcctttcaggccactgtgcaaccttccagagagggaccgaggtcttcttcgagaagaaatcttgcgtccgtgggtggagtgacgtgactcaagcgcaataaccatgtgggagaagaagctccgtgggcttcttccatttctcctccaaatcgacgtggaatttctcgcgtgagagagttcagtgcacaattcattgtggatcgtggttcccgcggtcaaaaggtatctccaacagggccccgacgacgagtgttctcccagacaagtggtctccagtgtggcgtgcacaactccaagagccaccttctccgcagtgtggtctctcacaagcccaaacaccgtgganacccctgtggccttatcgtggagcggaatatagcgagggaaagcctcattaccgagggtgttagcgaaatctcgaggggaaccacccgagaaatgcgcataaagtgtttcatacagagtgtggggagagaactcacaatcttgcggggagacacgctattttacagcgccaaacaaaaaccccgtgtgttttgttgtggggaggctccaaagcgtgtccaacacaaattccccatctcgcttggggaaaacacacagcacttgtggcgcacccttggtgcccccaaacatagacgctcatcacaggattagtaggcgccatggtgggcaaagaactcctgggggaccactctcgggcgacaaactcttaacacgcgggataccccaaagggggcgacatgggggtaaattccctggaaaaggccccagtggggagacacggacggggcgacaaaggaagaaggttccaaattaggaacaacgcccaggggggaccaagctgtctgtgagctgggtctcaccccacgcgggggtgccccccaacttcacacatggggtgcgtctagacacgtgtcgtgggtgcaaccgcccaagaaggcatcaaggggacacgcctagagagacaccccaacggggggtgcggcccccaagaaggaaggagctccggaggaattatctaacacacctttgagatccctacacataataa

SEQ ID NO: 658043 - DNA, 247 bp, Homo sapiens
agatctgaatcttggatcagcgatcctcccacctcaactcctaaaagtgctgggattacaggtgcccaccaccacgcccggctaatttttttgtattttttagtagagacggggtttcaccttgttagccgggatggtctcgatctcctgacctcatgatccacccgcctgcgcctcccaaagtgctggtattacaggcacgagccaccgcgcccggcagaaatttctctaggatacagtagggaga

SEQ ID NO: 658044 - DNA, 119 bp, Homo sapiens
gctcggcccggatgtggagtctcagagctgtcagaaagaataagactgattttatgggaaaattaagcagatgctccagtttgagaaacatggatctgcgatctgtttgtggcacagca

SEQ ID NO: 658045 - DNA, 295 bp, Homo sapiens
cgcctggcagcccggacttcccccgacatgtgatcggcttccagggagggcgggaggcccgggccgttcccccgagcctttggggaagcttggccgtcccggacttgacctcttcggggaggagccaaccaaaggccaaaaattcggcccttgcccaagccttaccggttccaagtttttgtttctctccacgcggaaaaaacctgggggccccgagggaaatggcattggcaaccttttcttgagaaaactctaaccgggcttaaccttttttttcaaccccctctcctgcatc

SEQ ID NO: 658046 - DNA, 814 bp, Homo sapiens
  misc_feature (63)..(63): n is a, c, g, or t
  misc_feature (300)..(300): n is a, c, g, or t
  misc_feature (309)..(309): n is a, c, g, or t
tcctacgtccctccgggtgattgtaatagagcgtcccgacgcaccatcacggggggccagganagacgcttcgctcccgaggcgaagttcactggtgttgtcaccacctggccgacactttcctccttcctttgaagatgtgcgagcgccttcttgtgccggcccacaatgagcacacagaggcgtatcacagaagaccctttgttgcccccccctcccacgacgatctcgtcctttctctccttggaattgagggcgcgtcatcaccatatggggggccttgtcgtttctggcaacccnccagggagngccctaccacccacgcgtgggtggcgccccacacgccgtgtcgctcctgccaccgtttgcgactcgtgaccacctaggcatgctgtgggcgacaggagaccccgggccacacacagttgttttcgtccggagttgctgccacgagaagttgtgtgagacgacttgcgcgggacctcccacaggagacaacttgtgcaccacaggcctcggacaagagacgccgcacctccgtcgttgtttcgcgctctccctctcattggacacgacctcggcctttttatgctgtatctaaaaatttgtgagtgaagttagagcgcagcgtcaccttagcacgctcactttgagggcatcctattaaacaccccccactcgtttttttatcgtttcggttttagcccaaaatggaagttagcactgggctccatttttccccacccaaatatttgatttttgcttttagggccccctttccatcccacaaaaaaaaggggaaatttggcttcca

SEQ ID NO: 658047 - DNA, 877 bp, Homo sapiens
  misc_feature (1)..(1): n is a, c, g, or t
  misc_feature (85)..(85): n is a, c, g, or t
  misc_feature (112)..(112): n is a, c, g, or t
  misc_feature (164)..(164): n is a, c, g, or t
  misc_feature (186)..(186): n is a, c, g, or t
  misc_feature (232)..(233): n is a, c, g, or t
  misc_feature (237)..(237): n is a, c, g, or t
  misc_feature (245)..(245): n is a, c, g, or t
  misc_feature (266)..(266): n is a, c, g, or t
  misc_feature (269)..(269): n is a, c, g, or t
  misc_feature (272)..(272): n is a, c, g, or t
  misc_feature (283)..(283): n is a, c, g, or t
  misc_feature (293)..(293): n is a, c, g, or t
  misc_feature (298)..(298): n is a, c, g, or t
  misc_feature (303)..(303): n is a, c, g, or t
  misc_feature (309)..(309): n is a, c, g, or t
  misc_feature (311)..(312): n is a, c, g, or t
  misc_feature (314)..(314): n is a, c, g, or t
  misc_feature (316)..(316): n is a, c, g, or t
  misc_feature (385)..(385): n is a, c, g, or t
  misc_feature (389)..(389): n is a, c, g, or t
  misc_feature (419)..(419): n is a, c, g, or t
  misc_feature (428)..(428): n is a, c, g, or t
  misc_feature (437)..(437): n is a, c, g, or t
  misc_feature (443)..(443): n is a, c, g, or t
  misc_feature (446)..(447): n is a, c, g, or t
  misc_feature (623)..(625): n is a, c, g, or t
  misc_feature (627)..(627): n is a, c, g, or t
  misc_feature (631)..(631): n is a, c, g, or t
  misc_feature (639)..(642): n is a, c, g, or t
  misc_feature (644)..(644): n is a, c, g, or t
  misc_feature (670)..(670): n is a, c, g, or t
  misc_feature (857)..(857): n is a, c, g, or t
nccaaacaaaagctgcttagttatttattttgcatttgcattttgtaggaagtgagaaaaaaacagctctattgggactcaagtntattttcaattaaaatccccataaatnaggaaatgtcttataaaacggagaaattggaaaaaaatgttattcagaaaanaactttcttgagtgtgcttgtntcctgtagcaccttggattttgtgatcagtcttttaaagatatttnncaanaaattcancctctgtcttcacatttaggncanggnagggggggggnggggccttgnaggcnaatgngggggnanngngnggcgggcgtagggtcgggcattgagagcgctcgcccctaattctgccatttgcgcatgtcccacatgantaanagggtacagcttagagaccagggccttgcngccattggntttggggcnaattanganncagagtattaaacacagttgagtacatccatgcatacatgacataccgtcatcacataccggaagctccaatcaagagccccgagcaaagctcgtttcataacatcattaagattcattgtacactgcgtttcagaaaggctttgtcaaagcagataataatggcctgtcagaaannnanaaanagaaattnnnncnaaattgtcctttccctccttttaaantatgggaatctattaatagctgcattcccggtataggggactcaagtcttcagttaaaaaaaagtccccagcttctttaatattgtaagcttattaccaaaataagagtataaaaagttaagtgaaaaatatttgagtaactaggtgggggtattcctgggaatactaatcaaatataatgactgtntcaataacaaaggaaggcgg

SEQ ID NO: 658048 - DNA, 908 bp, Homo sapiens
ctgaggccctccaaagatgtgtgtgcgctctctgacaactttggcctgtctattgaatgtgtccatggtctatgccaaggctgacggcccttggtgttcctacgtaccttcccgatctaaatcgtgcgcctatactctcggttgtgtgctgcctctgtgtggtcatggcgtctctagttagagcttagcgtataggacgtgaacgcttgcatggtaagaagccactggatggtgttatagatgcgttgttgcctccctactttctctcagttcctgctatcgtgcatgcggcacgcgttggatgccggacggctagcggcatgcgctaccgcggtcccagacgtgccagcgtcgagggtctcagtgaggactcatgtaccacacggctgcggtcttagagtcgtgtcttgagggcctctggctccctgaatcgccagtctcgtgccatgtctagctctttggaacacggatgcagtgtgcaacaggcacctgagccgccagcccgtgtccccgtgggtccgtggcatggcctactaccccactcccacttctcctcccaaaaccagagccacctagccagcctcagctgggacagggcttggccgtagcacgagaccccaagctggcccactggtcccactctctcggctctgtagggtccactgggctctggacaagcactgggggacgtagcccccagagccacccaccttctcagtcacctaaccctagtggtccctgccccctgacgtctgcatgattcgggctgtggcctccacgtattatagtgcagtacagtctgcctgacggaccagccctgcctctgggacctgggggctgggctgtagaagagttgttggggaaggagggatgctgaggaatacgcatctgggcaacttctcaccgtt

SEQ ID NO: 658049 - DNA, 84 bp, Homo sapiens
tagaggttatacgctttgttagaaacattaattgtagtttggaagcaagtgtgtatgaataaagataatgatcattcaaaaaaa

SEQ ID NO: 658050 - DNA, 837 bp, Homo sapiens
cgtctcacaactatggcggtggcgtagtcgatatgaagcctcctttaaggggcgccaagagggcccacatgcggttccgcggggagtatacaaaaggttgggagacccatacgcaagttcctgtgctccccgagaaggacagtggtaaacacccgcacgcccggtgtcgagaggtgccaaaagggaattctgcccgggagataagagtaccccccgcaagaagggggtcatctccgcaaaacattcagggtcaaatgagaccgtaaccaggtcttttaaagagttcattttcattgtctggtaccccgccgtttgtcccgtgaaagacacagcggtcccttctccttcatgtgtaagccccgcgttttggcttttatctcgtacgctcccctttctattgggggtaaaacgcaccgtctttagcaagaaaagtacacaaaacagcttcgtagtcgtcggacaaaattgctaagcagcggaccgcccattttgcacaggttagaatcaggaagaacccacccctaaagtggtgtgaaactagtgaaggacttgaaaaatctcatggggggtctgttccacaacataaacaaacgacaactcgttttcttttctgtgtcaagcacggctcggagccacttctcctctttgaaaagaacatgtcggtcccgcatgtagtgcgaataaataaaagtgggaccttccaccgctgctctaaccagaaggaacactaaaatagtaggcagcgtcctctcatggcacctcttgatggagtataattgtatttaccagggttccctgatcttgttaaaagcctaatttccccccccaaaaaagaca

SEQ ID NO: 658051 - DNA, 336 bp, Homo sapiens
aagtgacaataccagcagaatttctcggaatattcaccatttgacctacaggagcatgctcttttttcccagaaaatgccaactgtgagaaggcagtctgatatcctgaagtatcttctatgtcaataaaatgttcctcatcaggaatggcatcagtcttcgggtaactcaaaaagaccaatcaaagactgtaataatggagtccacagtttggtatactcagggtccatcattgggggacattctgttagtaatttgagtatgccaaccgcacaggtctttttctctacatttccagataccttctgaatttcaggaataataatttttttccaa

SEQ ID NO: 658052 - DNA, 763 bp, Homo sapiens
gggcctgcggaagttcccaggagaaggcagcgcgttgtacccgagattcagggtctggctctgcttcccaggctagagtgcatttggcgcgatcacagctcactgcagcctcgacctcctgagctcaagcgaacttcctgcctcagcctcctgagcttcctgagtagctgcgactacagttacctgtagtcaaccacagtctgaaaatattaagggtattttaagacagaaagaggagagaggagagaaaccggattcaccttaccgatgtccttatgacatgaacattctccatggagctgatggaaccagtatcaagtgtggccattattgggagaaatgggttgctcctggcctttgacctgagagtgaacagaaaggttctccaggccacagtcatgcccaggatcagattggttgtcctgttattatccatcctggacggaggctccaggggcaccaatttcagattatcccgaatatttgccaggaagcaagcgcgcagcaccatctcccaaaacagtcattgtcacacctggataggacctattcttgataaagacaagaggctcttgggaggtttggtcaactttggactgctacttgggaatatggactctcttggggacgtgaaactaacttccattaccaatctcggcccagatttgacgttgctgattgattacaaacgactatagcaaggcgcgtccccgggtgcaagacgggcgtgacgaaccgattcttggtgccacttgcatacttc

SEQ ID NO: 658053 - DNA, 470 bp, Homo sapiens
ataaactatagtctattaaacagatcttcctgatgaacagaagttcttaattggatgaactccagtatataaatctttaaatctattaacatacagattatacataaagtgttctgttttaaaaaatttttccctaactcagtgccaagaagataattacctatgtactagaataaagtgttgacttttacgtaggtatttatagtctacctagagttaattgattacgtaagtttgacatgaggcatggggtagttgcacattttaaaaaatagtgtaatttttatagttagctatcttttaatcaacaataaatgtaatctttccatattggtacaaatacatctaccttattcttttaaactattacatagaattccatcaaatggatatattatagttgatgtgaccatttctttatgatatgacattaaagttgttaccatttgttgctaataacaaaataatta

SEQ ID NO: 658054 - DNA, 463 bp, Homo sapiens
  misc_feature (186)..(186): n is a, c, g, or t
  misc_feature (236)..(236): n is a, c, g, or t
  misc_feature (281)..(281): n is a, c, g, or t
  misc_feature (289)..(289): n is a, c, g, or t
  misc_feature (315)..(315): n is a, c, g, or t
  misc_feature (325)..(325): n is a, c, g, or t
gaagctttatagaaccattcgttgggcgcgctgcggcccaagtaaggtagagtgatgcattggtcataggtctgcttatccgtaagagtagagtccttggtgtcatgactttaagttgcgtgtgtgattatcttcaactcaaactaatagagtcaacgcgccgggtagtcgcgaccgggatgcggntatcatgagactaacagtcactaggatgtgtcagtgttacgtgtcagagntcacatgtgacatgtcgtatctaatcagagagacagtggaaagtncccagagnctgactgacttactgacttaattcanaactgtcacncgggccctctcggggaccctgggaggtggaagagagagagaagaaacagagacagaggaggacaacaaaggggatcaaagagagagacacagcgagggacaaagaaagacaagtgtaccgcggggataagcagaacac

SEQ ID NO: 658055 - DNA, 218 bp, Homo sapiens
aacgacaaggcgactccatattaatattgtttgggctactgctcgtagtgcgccgcatcaggtcgtatttggattttgatgctcaccctgatcagcggattgcgtagccggataagctataggtggctagaatacatatgaggtctaggttgaggttgaccatcgggttgagtctagcgaggggcggtcatactagaagagcgatgttgagggctaag

SEQ ID NO: 658056 - DNA, 460 bp, Homo sapiens
  misc_feature (35)..(35): n is a, c, g, or t
  misc_feature (61)..(61): n is a, c, g, or t
  misc_feature (143)..(144): n is a, c, g, or t
  misc_feature (150)..(150): n is a, c, g, or t
  misc_feature (173)..(173): n is a, c, g, or t
  misc_feature (375)..(375): n is a, c, g, or t
  misc_feature (378)..(378): n is a, c, g, or t
  misc_feature (385)..(385): n is a, c, g, or t
  misc_feature (391)..(391): n is a, c, g, or t
  misc_feature (393)..(393): n is a, c, g, or t
  misc_feature (447)..(447): n is a, c, g, or t
gggggggggaatcgggtgtggggggctcccctcgngtcccccgggggctcctgggggtggntggcgttggggggtccggcccggggggccggggggggggggtctttggtgggtgggttggctgcttggccctcctcccctgnngggggngggggggccagcttggtgcggcngggctggggggcggcaggcccgggcccgccggggtctccacaaattgtgtctgaagagaatgcaaaaggtcctcctgcccgtgtgcaaaatagaaaccggggtctgcaggctcagctccggcctcctgctcctctgcaggtgctctgcatgtcctcatggggtgccgggctcagatcaagagactgctggcagtggcggctnttncagccanggccananttatggggacgctgaccaagaagggtgccgagggtcccccgccgctgcccagcnccccagggtcaca

SEQ ID NO: 658057 - DNA, 1283 bp, Homo sapiens
  misc_feature (1)..(1): n is a, c, g, or t
  misc_feature (98)..(99): n is a, c, g, or t
  misc_feature (128)..(128): n is a, c, g, or t
  misc_feature (151)..(151): n is a, c, g, or t
  misc_feature (206)..(206): n is a, c, g, or t
  misc_feature (450)..(450): n is a, c, g, or t
  misc_feature (541)..(541): n is a, c, g, or t
  misc_feature (591)..(591): n is a, c, g, or t
  misc_feature (683)..(683): n is a, c, g, or t
ncctgaaatcaaaatcacgcccttaggggccggccatgacgtgggccgaaactgcatcctagtctccatttcaggcaagaatgtcatgctgaactttnnggggcacatagacttcaataacgaccganacttagaaactgcctgaattaanaaataccgccccaacctactcatcacaaaatccacgtacgccacgaccatccgtnactccaagcactgccgggagcaaaacttcctgaagaaagtccacgaaaccgtggagcgtggtgggaaggtgctgatacctttattcgcactgggccgcgcccaggaactctgcatcctcctggaaaccttctagaaacacatgaacctaaaggtgcccatctacttctccacggggctgaccgaaaaggccaaccactactacaaactgttcatcccctggaccaaccaaaaaatccgcaagantttcgtgcagaggaacatgtttaaattcaagcacatcaaggccttcaaccgggcttttgctgacaacccaggaccgatggttgtatttgcnacgccaggaatgctgcacgctgggcagtccctgcagatcttccggaaatnggccggaaacaaaaagaacatggtcatcatgcccggctactgcgtgcagggcacgtcggccacaagatcctcagcgggcagcggaactcganatggaggggcggcaggtgctggaggtcaagatgcaggtggagtacatgtcattcagcgcacacgcggacgccaagggcatcatgcagctggtgggccaggcagagccggagagcgtgctgctggtgcatggcgaggccaagaagatggagttcctgaagcagaagatcgagcaggagctccgggtcaactgctacatgccggccaatggcgagacggtgacgctgcccacaagccccagcatccccgtaggcatctcgctggggctgctgaagcgggagatggcgcaggggctgctcccttgaaggccaaggaagccctcagagcttcccttggcactgggctaccccttgggaatccattgcaaacgggaacaagcgaaacctttcccctgggcctggggtgtcctctagagcaagccctcaaagagctgggtctggctgagcaccagctgcgcttcacctgccgcgtgcacctgcatgacacacgcaaggagcaggagacggcattgcgcgtctacagccacctcaagagcgtcctgaaggaccactgtgtgcagcacctcccagacggctctgtgactgtggagtccgtcctcctcc

SEQ ID NO: 658058 - DNA, 426 bp, Homo sapiens
  misc_feature (6)..(6): n is a, c, g, or t
  misc_feature (418)..(418): n is a, c, g, or t
atccangaatggtttaccatttaaaaatgtatccaatctaataaacccatattaatgaaccacaggagaaaaatgacttaactagctcaataaattcaggaaggcatttagtacctatttgtgatttataaaaaattgtcaggctaggcacagtgactcacgcctgtaatcctaacactttgggaggctgaggcgggctgattacttgaggtcaggagttcgcaagatgagcctggccaacatggggaaaccccaactctaccaaaaatacaaaaaattagctgggcatggtagcacatgcctgcaatcccagctactcgggaggctgggacaggagaattgcttgaacccgggaagcagaggttgcagggagctgaggttgcgccattgcactccagccagggggacaagagcgaantccgtctc

SEQ ID NO: 658059 - DNA, 956 bp, Homo sapiens
  misc_feature (477)..(477): n is a, c, g, or t
ggaacattccagaggtcgacccatctccggtgctgatgggtgtggaccgaggtacgtcgctaggacagcccctcgcccgctgctcggccgtgtcggcagcgtggcccggtcgtctcctcgctgcgacttcgtcctcctgaccttccttcgtgactctggactctggactcgtggtttatatctgcgccgtacaatcttcatcccgagtcgccggtgtcgcagtcgagcgttgtgggttctatggtcctttatactttagtagcgcaaaaacctgagcctagttcgccagtcagacgctatttgcgttagccgtagtcatttcgtgtgcggaacatcactatgcgataacaacgacagacgaaaagcatttaccacgaacacctgcagttgcgtcgcaatagactttattgtcgactggtaccagcaggaccggacgcaaagcttcgttggcaaagtcgagtgttaattgatacagtncacgcgttaccgttcttcgcatgcacgagagatgagatatcagaagacacggttgtcaaggtcataaagaagttcttcattctacttcgtttaatttgactaaagtagtcccaaccgtaaattaaggtcgcaaaaaattggtctgttcaaaactgttcaatccagcaatgcggtgtcaggacccaggttctagtccgctaacaaagatagccccgtactggattgccaaagagtagaagggccaaacgggcaacatggaatcaaagacaagttaatagtcaaacatggcttgaacagtttgcaagaagggccgcttaagttcgggccttccgaaacggtaattcccagaccaaaataatttttgggatatgttgaacgcttggggaagcaacaaggacccccaaggtttggaatgtataagggaatttgaacgcgtttaacatttcgttcaaatgggaatcctcattgaaggcgaaata

SEQ ID NO: 658060 - DNA, 172 bp, Homo sapiens
caacggatcccagatggaaaaagatgtcagaggcacacgatcctgatccagcaggtccgggacttcctaacagagcccgaaactatatgcagacactatccaggaggtcagcaaggccgtactggccatgagaatacacacagacatcagctcgtgtactgcagaaatatga

SEQ ID NO: 658061 - DNA, 119 bp, Homo sapiens
tgtgtgtatttgctgtggcatccgtgatggacctttttcatgcaagctacatttctcttctccttcgtatgctgaaaaatatggattatttcctagacctttggaatattatgttatga

SEQ ID NO: 658062 - DNA, 326 bp, Homo sapiens
  misc_feature (3)..(3): n is a, c, g, or t
gtncgacgcaaacccttcttgagctgattcaaatctaacctcctttgaccaggcatggtgactcacacctgtaatcccagcactttgggaggctgaggctggcggattacttgaggtcaggagttcgagaccagcctagccaacatggtgaaacccgtgactactaaaaatacaaaaattagctaggcgtgctggtgcatgcctgtaatcccaggtactcgggaggctgaggcaggagaatcacttgaacccgagaggcagaagttgcagtgagccaaggttacgccactgcactccaacctggatgacagaggagactccatctc

SEQ ID NO: 658063 - DNA, 155 bp, Homo sapiens
ccttacctcgccgttgttgtgtgtgctgcctgacgtgccggagaccggtcctgctgctgccgcagtcctgccagctgtccgacaatgttgtcccacctagtcgagccgccgccgcccctgcacaacaacaacagcaccgcgatgcagtggcggca

SEQ ID NO: 658064 - DNA, 496 bp, Homo sapiens
tgacatcagctgagtgtcaggagttcaggaccagcctggccagcgtggtgaaaccccgtctctactaaaaatacaaaaattagctaggcatggtggcacgcgcctgtagttacagctacttaggaggctgaggcatgagaattgcttgaatcctggcaggtggaggttgcagtgaggtgagatcacaccactgcactccagcctgggcaacagagcgagactctgtctcaaaaaaaaaaaagaaaacctcaattattcggtaaaaaaattttattatgaaagatactgggggcttaagggtgaataatacggttttaaaccttcatgtgtcggtgatggtaaaaagtctcaaatataccaccggtaacttggtccttggtatatttaacctcataacggtatagtcacagtatcacagaatttagacacagagcctgggcatactggataccaggttttaacagggcttaattaactactcttttctcatacttcc

SEQ ID NO: 658065 - DNA, 483 bp, Homo sapiens
  misc_feature (337)..(337): n is a, c, g, or t
tatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtctttcgcattgctaatgcgacaggcccccaactttccaaaatgttatcccccattggaaacccaaccaanaatttgggaagtggtgttacccaaaaaaaaaaaaagaaaatggtctcaccccttttaaccacccccacttatcttttgcttgataaaaatgcgttgttcttttttcttttggagggacaagatgaaaatatataatttgaataaaa

SEQ ID NO: 658066 - DNA, 714 bp, Homo sapiens
aagggtcctgtacgccccggaatatcgggatgctctgtgtgcccaggaagggacttcatttctgcctgtggattctttagaatgcccagtcgtctgcgggtctgccctgatcacaaggagaagccaggagcctcctcttcaggctacaaccttccttcttaagggccacagagtttgtggccccacccccagcacagccccaccttggccccaggaaccctgggagtggccttggcttcctgcaggacagccatggacctactctggatgcccctgctgctggtggccgcttgtgtctctgctgtccacagctcaccagaggttaacgccggtgtttccagcatccacataaccaagcctgtgcacatcctggaggaacgcagtctcctagtgctaacgcccgctggcctgacccagatgctgaaccagacccgcttcctcatggtgcttttccacaacccatcctcaaagcaatccaggaacttggcggaagagctgggcaaagctgtggagatcatgggcaaaggcaagaatgggatcggctttggcaaagtggacattaccatagagaaggagcttcagcaggagtttgggattaccaaggccccggagttgaagctgtttttgagggcaacaggtcagagcccatcagctgcaaaggagtggttgaatctgctgccttagtcgttggttgagacgacaaattagccagaa

SEQ ID NO: 658067 - DNA, 435 bp, Homo sapiens
  misc_feature (175)..(175): n is a, c, g, or t
  misc_feature (255)..(255): n is a, c, g, or t
  misc_feature (260)..(260): n is a, c, g, or t
  misc_feature (399)..(399): n is a, c, g, or t
aaaaagccattaatattcaaacaaaggaatcacattttaaaaaccctatacataagaaacagcctccaggaacattcaagcagcagtcaggagggaaaaatgtttcaatagcccagttttcttcaaagtatgccagagaatacaatccaattcactgctacaattcatagaattngtcagtgttttcttgagacgctgaggttcactgttggcagtttccaagtggccgcatgtgctgctcagaaaggccagcgnagacnagctgcccggaagaactttcactgctggaaaactgctccgctcccaaggaaagcccaaggaaggctgggccgtgggctcacaacttcatcctttctccagggtcatccagctccacgtcacttgaggtcaatgtcgtcntccacagggaagctcaccatcctttgccatcccagg

SEQ ID NO: 658068 - DNA, 189 bp, Homo sapiens
  misc_feature (26)..(26): n is a, c, g, or t
  misc_feature (39)..(39): n is a, c, g, or t
  misc_feature (61)..(61): n is a, c, g, or t
  misc_feature (102)..(102): n is a, c, g, or t
  misc_feature (147)..(147): n is a, c, g, or t
ccaaattagcatttagtattttgcanaaagtctaagggnccatggctgcctgccttggggnggaaccatagctccctctgggccgcttctggcctcttgganccatggccaaaggccaaggggatgggcagaggtctgtgtttggtntggcccagttccccatcattaaactcagcctgactgctgcct

SEQ ID NO: 658069 - DNA, 337 bp, Homo sapiens
ccggtgtttatcgatgccactccgtgccggttcctcccgctagggagaagggcaagagaggggagaacagcggcataagtggctggcagaggcagggaaagaccagcagaggaaagagagagaggcagagagacaaagagggagtcaaagagagaaagagagagacagagtcagagagagaagcagtaaagagaaaaacagtgtaccctgttcctttaaaagccagggtaaatttaaatttaaaacctctaattgataattgaaggtcttctctgtgaccctgtaacactccaataccaccttgttgtcactgtaaacaaggtggcatcgataaaca

SEQ ID NO: 658070 - DNA, 357 bp, Homo sapiens
  misc_feature (200)..(200): n is a, c, g, or t
  misc_feature (247)..(247): n is a, c, g, or t
  misc_feature (288)..(288): n is a, c, g, or t
catatgacaaacccctcatgtcactggaggggtagatacggagaaatctcatggttaggcaagctccctgaacatgactgcttctcagagccaaagtgacttgattctgtgtttaataaccaagatgactgacagcaataaaatccaattatatatatatatatatataatatatatatatatatacttatttgagatgnaagaggcaggctttctctatttctaatgataattttgcaaaaaaganaaactgcataatttcttggggaaaaaagtgtaagaaatctncagaccatatggtgcttatattccttttcctaaattataaaactttttttagaatgaaaaagactagtc

SEQ ID NO: 658071 - DNA, 427 bp, Homo sapiens
  misc_feature (1)..(1): n is a, c, g, or t
  misc_feature (69)..(69): n is a, c, g, or t
  misc_feature (97)..(97): n is a, c, g, or t
ngttccactaaggtttccctgttcccccacgtggccttgtgcctttcccccttttcccccgatttacangcacacacagtggaaaaatttactttcnttagtgcccctaaaataccttccacaacgcaaacaattttctgtggtacttgtgttaaagtcgttgtgcgagagtgcagaccaccttcactaaaaaaaaaaaaaaaaaaaaaaaaaaaaattgtgtgtggggggctagggccctctggagaactttttaaaacaccattccgtggggcggcgggcgccagtatgtctagggcgcaatggtggcataagtggtcccaagagacacggtgccaggcaacagggcggggcttcccacccagataaaaaggcccgggggaaccggaggtttgaacacacccaaaggagtctggggacatcggga

SEQ ID NO: 658072 - DNA, 1041 bp, Homo sapiens
ttcttcctgccctctctcccaccatgaccatggccacagttcagagatgggaaaaaaaagtgggtgagaatgctagagtgaaggagacttagctgtcagagcatagaaactgaacaaagccactataggtttcgaagtagcacggaagaaggttatctgggccaataaagatacttaggttcccgtgagagggcacatagtagcatgtccctcttagggtagaccccacttctgctatccacttggtcagaagacacacagaggcagcatatattccagcaattttgctggacttataagagccaaaccagaagcttacacgagatttaaaaactcacaaaggtgccaactcatcataaccaccatccccgtcgtgtggtcggcatgtagcccatccaataatcccacagtcgcatttatagcctccctaactactcattcagacaaccctgcccgcagattactctctgtctgagaaccccaaaggggaaaggagtgtttggtaatcagcccctcttggcaaaaaggaaagcttgcgtcacataggcacgtacaagagggattgatgcttactaccaaagtcaaccaggggacaggagccagatggtagattcacctagaagggatatcgactcttttgtgcctagtaaagttgcttcctggtcccgggcaacttgttgtgcctccgcacaggtcctgcgaagtggcaccagtgcctacagggtgatctttctacaggtatttccccaattcaggcaagccgttccgtcgggtgattgcacgagcgataaagtgccagtcccaaatgcaaaacaatacgtgcattatttagcgttgctattcgatgttaaataattgggcagacaagctcgcttgggcgggaaagaacttaataagataattggagggggcagcccaaatttccggggagggctctcataaagaccccgcttggctgtttacaggttcccgaagcaaattctcttgtgtggccccgcttaccacaccacgtttgttcggcgcgcggacctctcggagaca

SEQ ID NO: 658073 - DNA, 212 bp, Homo sapiens
gactccagagagagatactaagctccaggtaaagatatggaaaggcaacagaatttccgtggtaactgaaggccagaggttgaataaaaataagttcaagagaacctaagagattggcaggaccaaaggagccagtaccgaatctgtggaaacactgatatttacccatggaggaagagaaatagaccctgacaactgagacagcataatca

SEQ ID NO: 658074 - DNA, 223 bp, Homo sapiens
gcggacgtcctccgagacttggagaagttctcgtagaccttgttgtctaccgacgcgtggtagagacactaggacaaggagttgttcgttctagacgagcgactctttcaggaacgaccctttagcttctaactcctgatgaaaggtcttaaacgagcgatgtgatgaggactcctacgatgagggctcgggcctctcctgggtgcgcactgggcccggttca

SEQ ID NO: 658075 - DNA, 157 bp, Homo sapiens
gcgtcgcccgcgtcctcctaacgctcctccacaaggatgggcaaagaggccaaggcaggttaagcaaccaactgagaaccctgctccacccacccagcaggacagtcctgagtacaccaggctccttaggcaccttacaattggcaggtagccttaa

SEQ ID NO: 658076 - DNA, 346 bp, Homo sapiens
ccacaaccatgggtttcgtttttgtgatggagtctcgctctgtcacccaggctggagtgcagtggcgcgatctcggcttactgcaacctttgccttctgggttcaagctgttctcctgcctcagcctcctgagtagctgggactacaggcgcctgccaccacacccagctaatttttgtatttttagtagagaccagttttcaccacgttggccaggctggtttcgaactcctgaccttgtgatcctcccaccttggcctcccaaagtgctgggattacagcactggcgtgagccaccacacccagcccacaacttacttttcgtttggtgatcgtggggttgtaa

SEQ ID NO: 658077 - DNA, 556 bp, Homo sapiens
  misc_feature (155)..(155): n is a, c, g, or t
  misc_feature (546)..(546): n is a, c, g, or t
aagatgcccatgtcctaatcccaggaacctgtcaaaattaccttgtatggccaaaggggctttgcagatgtaatgaagttaaggatctttcgccaggaagattatcccagcttgttcaggagggcttgatgtcctcacccgggtctgtataacanaagagcaggtgacgggagaggaggttggaggtgtagcgatggagcaggaaactggagttgaggagggcagctcaagccacagagtccaggccacctcagagccaggaaatgcatcctcccacgggccaagagggtgcacgctttgaaaagactgagggactcggccaatgccaatgatgtggaaacagtgcagcagctgctggaagatggcgcggatccctgtgcagctgatgacaagggccgcacagctttacactttgcctcatgcaatggcaatgaccagattgtgcagccctgctcccacctggactggctcagtgaggctaattttataattctggctgattttagaactctaacggcctaaatttgtgttgttttaagtccaatntaaaaaaaaa

SEQ ID NO: 658078 - DNA, 603 bp, Homo sapiens
ggcgactcctcgtggcctccactggggcccaggctggaacccaggtggcggaggcggaggcggacgcggtggcggtggccagtggcacagcagtgggtgacgacgtggggtgcctcggggcgccccctgctcgcaaagcccaggctgggcaccggagctacaaccttcaggagaggaggcgcatcgggagcatgactggggctgatgctaggcactgctgccccgggtccccacggatgaggattgagtgcccagactgctggccactggactgaccttagacctcatgaatgagtcaccggtttgaggacgttcctggggtgcggcggcgcttggtgcggaagaatgccaaaggttccacacagagtggccgataagggcgggagcctggccccacagtctcgggcccgacccctgggccccgccagaagccccatgaggtgtttgtggaagctgaagtgagttgctccatggacaaaaaccaggagccccagtggccgggagacgagctcgctggatcacatttgaaggaggacgtggaggaggagaccgagcgctgggggaagccctcatgtggcctccctctccttccgcagtctcctg

SEQ ID NO: 658079 - DNA, 959 bp, Homo sapiens
atggtcagtctttagttaaatcgaccattttcatctctcgcatcatctgtgaagaaagagagaagccccccagagtgaggcgcctgcagggtggaggaatgccatcatggaaggactcctacctgtatcacggattgctccatcaccaatgtctcagtctacctgtatcccttcataaccatccactctgagatggcacgaaaggcccctgtgtgagcacacaagaactctgagcactacacagtgtacccaacatatcaggggctacttgtagtgccttcgcttccccttatcgggtgtccttactcacatagacatgccacctaccctaaaacgagatgtgctctgtgaatccaccttcagtgcatagaacatgcagacgcgaaggagtatgacatgatattagaacactcacctgcagaatcattatcacagtaccctatgatgagaggacatagatcctgctgcatagatccatatagtactcagaaatcatctgtactacactcttcatgcaaaatactataacagagcagctccacggtacatgaggcggacagcctgacaatccgccacagcacacaaaatgatggacacaccggccaagccaccagctgacgatcacgcacaccaggcccaccaacctatggacatggacacgaggacaccacacgccagacacgtaagacacagcacaccacagcgaaacgagaacaacgcaccaccaccacacggaacacaccaggcactggaaccgccgcaggcagcacaccagaacggcgccagcaagcaccagcatccaaagcaagagcgaccgtcccacaacccgacacaaccaccgcacacacacgagcatcacatgaagaaaaagccgagaaacacacgaaaggcccagaaacaagacaagccaagaaaagaacaaaagcacaacaacacacaacacacaatacaacaagcac

SEQ ID NO: 658080 - DNA, 271 bp, Homo sapiens
  misc_feature (116)..(116): n is a, c, g, or t
  misc_feature (143)..(144): n is a, c, g, or t
ggggggatggataagtccgcaaagggttatcggtgatcctttaggatgaggagacttcgtgcgtaaagttcggtccagcttccaagacggggctttgtaaacggtccgggtagcanttcctgacagggacagtttggtctcgnnggcattgagggttgcgagtgtaagcctttccacccctacccaggaccccgtgacgtccataggaaccaaatcccagactcagaacaataaaataaattccgcactccccaaccatataaaaaaaaaa

SEQ ID NO: 658081 - DNA, 116 bp, Homo sapiens
caccctctgtgggtgtggatatcagcagggaggagaggctgcataagtgccggctctgctacaagcagcttaagagcatcagcggcctggtcaagagcaagtccagtgagcggccc

SEQ ID NO: 658082 - DNA, 147 bp, Homo sapiens
ggtcggaccacagatccggggcatgctcggtaactcatttccgtgcgtgaagcagtgcatcgcgaaagctacacggatttctaccgtccggccgtcagtcgtttccaactggtatcggaaaggatgcaagtggttgagcggaaagga

SEQ ID NO: 658083 - DNA, 766 bp, Homo sapiens
gggaaagatgagtaagctttccccactactctgccttcctcgtacagaaactctttacttttgcctgaagtaacagaactcttctagcttctccatctaggagatttgagtgtgtgtgccatcaaggcttgagcaaacgttctagtacggtagctctaacgacttgaagatagacatgctactcgattcagtcttacaacctaataaattccagagtttattttcggttctcctctgtctggccttcctaagagaatatgagtctgaagcagtgacagtcattgtttctttagcatgcttggcttatgacttttaaagttttcatttagagataaatgtcgaagctcaagtttacagaagcgttgcagaggcccacggtctcctgggtcccggccacctgctccatattccacattctgctgacatgtgctccctgcactccactcaagttgagagtacaaatagtcttgaaggggaatcagcttcaggatggaaggacccaggagaggccccgaggtgggagggttctgtaccatacagactagctgcgagtgtccagagctctctgccatgatacttccttggggactgacttggctgagaactgtgttctgtcagaggattcgttgagaactctgccctttggtctgaaactcaaggcccatggagaactgataggagacttaggacagagctgaccctttgcaccaggctgggaggctgcagcccttttagatgccacttactgtaagttggacagaatacc

SEQ ID NO: 658084 - DNA, 110 bp, Homo sapiens
caaacttcgacaaataccacccatgctactttgtgaaagtaggtatgaaacataaccacgttaaagaggaaccagagcgttctgcccaactgtcaacctagacaaattgt

SEQ ID NO: 658085 - DNA, 514 bp, Homo sapiens
  misc_feature (113)..(113): n is a, c, g, or t
  misc_feature (235)..(235): n is a, c, g, or t
gtgctgggattacaggcgtgagctactgcacccaacctgcccacaatttttattgtctcttctcatcaaccatctgtctccccatcttgaaaatgaaatgagccaggcgtggntgcacgcctgtactcccagcactttgggaggctgaggtgggtggatcacttgaacttgaggtcgggagttacagaccagcctggccaacatggtgaaatccctgtctctggccggacacagntgctcatgcctgtggtcccagcacagtgggaggctgaggtggcggatcgcctgaggttgggagttcgagatgagcgtgtccaacgtggtgaaatcctgtctctactaaaaacacaaaaatcggcctggcttggtgcaggcgcctgtaattccagttgcttgggaggctgaggcaggagaatcgcttggacccgggaggcggaggttgcagtgagccgaagtcatgccactgcactccagcctgggtgacagagcgagactctgtctcaaaacaacaaaa

SEQ ID NO: 658086 - DNA, 1465 bp, Homo sapiens
  misc_feature (948)..(948): n is a, c, g, or t
  misc_feature (1465)..(1465): n is a, c, g, or t
gtgctgccgcggcaagcagacacaccccggcacctcctctgcggcatggtgctgcctcgcaatgcgcatgtgccgcatgcgcactgcctggagtggctgtagctgcccggctgcggctgcctgccctgctgcgggcttgtgggcttgcgtggcttggcccccggtgcttggccatgtctgcacgggcttgcggggctctgccggctgccccgggtgctcttgcaaacagcttgcgtgcgtgagcgggcattgggagctaaacggcgggaccattgggttgcgccagaggaatcggccttccggcagggatggagggcgacgtggtggggtcccaggggtgtggggccttgtatgggaccggttgcccccttggcattgggcctggagttactctggacaaaatttttcccagagagcacacgcctttcaagggcgttactcccacactgggcgcgcctttacaacatttcatttggggaccagggtcctataccagggagccagagagattatattaccagcactttaaccgaactgtggggacctcgttgctcgtttaattctgttgtccgtacgccaaaagaaaccttccttggtaggacgcgataggtacgggcatttggcgacaacggtccccaggacatcgaattacggtctatgtgtggagcatatttataacgcatgcgggggtattagattcgcagaaaagctattttcactatgatctaaacagaacttgttgtgtataacgaaaaggaaagttgtgggagaaaaaggggtatcttgaatcgccattttgacaatggttatgtccacgtagcaggggggatttgggacatatggcccccctttgtgggtatttatcacttgagcagggcattagtgggggcgtttacaaggagtgaagaagataggcacggaaggacagccaacgcaatatgagaaganaaagattgagcagagaatcaattatgatggaaggacaagagatggtccaagtgatcagttgatgtgagggaaaagacgcgaccattattgggcgcgagagacaaattcatgtggggggagctgcacaaaaaaaccctggtgagacgataaattacaacggagatgttcctttattgctacaatgtgacggttatgtggacgcaacataaatgaggatgggatcaacgggagaaggctatatcttattaagaagggggttagcgaagcacgcgaggagaaaagtctcggaatcctatgggttgaggggatttaacccacttttacaaggagtgtctcttgtggcctatgtacacagactgggagacggagtaacttcttacggcagttgaagaactttcagctcagtaccgagcgtacagttagtatgcaagaggaagggttaagatcagaaaagagttggacgagtgtgtgtagcatgtgagaacgacaaatcactgccagcgataggagattggtn

SEQ ID NO: 658087 - DNA, 281 bp, Homo sapiens
aatttcatttcaggccgcaatgcatggttgtctattggcatcatattcaccagcgcatggctattgcatcagtcacctgcaggcatgggggtcaggggttgaggtcttggtgagtgtattagtggggtcagcgatggaggtaggattggtgctgtgggtgaaagagtatgatggggtggtggttgtggtaaacttcaatcagtgtagggagctgaataatttctgaaggagaggggtccaggttttgcatccgggaggatcctattggtgcgggggctttg

SEQ ID NO: 658088 - DNA, 349 bp, Homo sapiens
gcgcccccctcccgacgtggacggcatgatcaccctcaaggtggacaacctgacctaggcgcacctctcccgacagcttgaggcgcgtgttcgagaagtacgggcgcgtggtgcgacgtgtacatccctgcgggagccccacgaccaatggcgcccctggggcttcgctttctgtcctgctttcacagaccaggcgcgacagcccaagacgccgagggccgccatggacggggcggagctggacggacgcgagctgcgtggatgcagagtgtgctgctgctatgtgcctgcctgggaccatgccccgacaagccgccaggtgagagccacgcaggcagggtccacaagg

SEQ ID NO: 658089 - DNA, 660 bp, Homo sapiens
ctgcgtgctagcctgttgggcctgcctcggaggaggctgtctgcctgcctgacgctgcctgctgctggcgcctgttgcctgctgcctgggaaacacaaggaaagggaaccagctgcagctgtggcgatgggctggggtgtagagcccctgcggaagtgctgggctgtgtgccggtgacagacgtgtgccctgtccacggtgcctcctgcatgtcctgctgccctgagcttgtcccgagctaggtgacagcgtaccacgctgacaccatgaatgacgtgtctgtcatcgagagcaaggctgtctccacaagcgtggtgaatacatcactgagctggagggccacggtacattcctgctgaacgagcgacggctccttcattgggtacacggagagtgccctgagggcccctgatccaaactctagcccaccttaagcaggcttctcacgtaggcatgactgccagctgcactgaaggacccgagagcgccagacgagacgcgaacgagcgtatagtcgagacccgctccccttccagcgcgaacaacacggcaatccgaccagtgacccgcaacccacgatggatacatcaaagacggaaaggcgcgcactagcactccccgcaccgctccagactgcccccacagagccacaaggccaga

SEQ ID NO: 658090 - DNA, 250 bp, Homo sapiens
  misc_feature (27)..(27): n is a, c, g, or t
  misc_feature (216)..(216): n is a, c, g, or t
  misc_feature (232)..(232): n is a, c, g, or t
cggcgactctacgaggatcccccaggnccacacttgcgcaatatttctgaacgtcttgtacaacgtgttgttacgtgtacccgtgacttactacgtaccttcaccttttttccttggacttacctgggttaacactgacactgacgacacgtgttactgttttttacctaaacacacgtactacacacttacaacttttggaccacgaccaacggncactacttactctggnctccccaacttaaacgtt

SEQ ID NO: 658091 - DNA, 752 bp, Homo sapiens
  misc_feature (471)..(471): n is a, c, g, or t
caacttaacaagttattcttttatcagttgtgttttggtgtactagctaagaaatctttgcctaagcccaagtcacaaaggttttcacttacgttttcttttacaatttcatagttcgatatttaagtctataatctttttgagcaaatgtttatatatagtgtgaatgttgattgaagttgttgtttttacatgtgaatatacaattgttgaaaagactagtgctatttgttgaaaagactatctctttacactaatgaccattacactttgtcacaaatcagttatccatgtatatatgggtccatttctgggctatctagtctgtttcattgagctatttgtcagtctttatacaaataccacagtgttttgattactgtagctttacaaataaatcttgaaattagtaaaaaaaaaaacaaaaaaaaaattggggggcacttgggactctggaaaaagatttttttngaaacccattctcggttgggggcgcggcgcggcacgctcagatggtgtttaatggtcgaacaactgggcgcccaaacagccggtccccgcaaggaaaacaccgcggcgcgcaaggaccactagggtgtcgggtttttcctcccccaatgaaaaaaaaggcccgcggggggcaaccgcgagcgttttgtgaacacacatcgccaaatgggagttccggagggcccgatcaccgggtctctccaaccacagggattccagggggagcgcgaatataaatggcc

SEQ ID NO: 658092 - DNA, 537 bp, Homo sapiens
gagaataaaagaacttgactggaaagagaggaccagaaagcttttggcacaattttcaacagagcctattctaaaaccaaaaaaggccaggtaaagaggagatttcgcttgacagaagagtgactggtaagtcggagtacgacctgggaatactgataacctatgacacagttcaagaacctctaaatacaatgtaggcatttgatgcctaataatcagaaaaactgaggattcattgtgctggcttacatgacctggcaccttatattctctaaagagaatgtaaggctaggagtagcggaaccatggatcaattgggggctgaggaaatgaacggagaaaatgattcgataactggattcattaacttctcatatagaccacgtcctcaagttgtgataagcactttgagagctgttatcagacttaatgatatgacttctatataggccactaaccatgatgactttggagtgaacttgatttcagagcttgactgaaatacttgcattaatgacaccagcaaaaccaccgtaa

SEQ ID NO: 658093 - DNA, 465 bp, Homo sapiens
actgaatatgatatcttctggaaccaacatatatttgaaaaagtggttatattcttgcatcaggacacagtccggcatcaagttactgaatcttatattttagatttgttgtgatacctgtacatcaattagtaatggtactttttttttttattttgttctattagtggtgatttactcagaataggaagaaaagccctgtattcaattttagatgaagttattctcaagcttttttcaactcctagtccagttataagaagtactgctacaaaactcctactgttgatggctgaatcccatcaggaaatcttgattttactgagacaaagtacctgctacaaaggtagtacatccactctttcttttcttgggattctcaaaaagaaaatttctcttcatcgtttatgaaaaaccacattctcatatcttaaagagctcatcaccgacccatgtagatcacac

SEQ ID NO: 658094 - DNA, 364 bp, Homo sapiens
ggttcgtgccggtcaggatgctgtgatgccaatgggaggcccagggctcaggagatggctgagccgtggatcttcctccatggctctgccatttccagtgctctgggggtcgcggttgtggcccgtctcctgtccccgcaagaacctacaacactttgggccggtcagatgcagcggcatccttctggaaagactgtgcggaagagaggaaggaatggacagctgtgtcagtacatagtcgtcgagagggagaatgatcatggacgaaatgcccatgatgggtgtgcattgattcttgcacagccttgcctttcttccaagtcatactcacttccaacctggaccctaaaaggccgggccaagt

SEQ ID NO: 658095 - DNA, 350 bp, Homo sapiens
tttttttaaaaaaaaggcccccccccccctttttatttgggggggggccggggtttttcccttttttcccccccctttgggggggttggggggggggttccccgggggggggggttgggccccttttgggttccccgggggacccccctttttttttaaaaaaccaaaaatttttgggggggggggggggcccccctgggtccccccccccccggggggtgttttgggggcggggttttctttttccccgggggggggggggttgggggggccgggggggccccccccccccccccccccggggccggggggggcccccttttcccattttttttttttttttttccgca

SEQ ID NO: 658096 - DNA, 142 bp, Homo sapiens
gaagcagtagtcaccgtgcaggaaattaaggaggggtccgtgaaatattacgatacgtcttaaatatgagacttgattacaggttcgaggtctgagagatagcagtagtgggggaagatagagttgggaaacataattggat

SEQ ID NO: 658097 - DNA, 429 bp, Homo sapiens
  misc_feature (283)..(283): n is a, c, g, or t
ccctaaggatacaaggcaatcctattttatagccatataacaataaggtttacgaccttgtggtggatcaagacattccgaggggcaacccctataaagggtcggttggtaacgataaaggccaccggatctgagttcaaaccggagaatccaggcggttttatctacttaaattcctcctgtccaaaggcaagaaaataagggctcttacaaagcgcctttccccgtaatgatatcatctaacttagattatacccacacccacccagaacagggttgtttnaaaaaaaaaaaaaaaaaaaaaacctgtcggccgcttggccaatcgatttagattgacaaggttatgatgcggccgaattcgagctacttggccattcgcctataggaggtgattcaattcatggcggcgtttaaacgccggactgg

SEQ ID NO: 658098 - DNA, 412 bp, Homo sapiens
  misc_feature (336)..(336): n is a, c, g, or t
ggatttccagctttgccatgaaccctcagtaatgagaacctatctgttcctgtgcctggacttcctaatatatagaactgtgagataatgggtcacattggctggatgtggtggctcatacctgtaaatcccagcactttgggaggccgaggcaggcagatcacctgaggtcaggagttcaggaacggcctggccgacatggtgaagccccgtctctactaaaaatacaaaaattagacgagcgtggtggtggacacctgtggtcccagctgcttgggaggctgaggcaggagactagctggaaccagggaggtagaggttgcagtgagctgagantggccactgcactccagcctgggtgacagagtgagactccatcataaataaataaataaataaatgggtcacatta

SEQ ID NO: 658099 - DNA, 666 bp, Homo sapiens
gggcgcctgaggcggccaccctgagacgctggcgcgcactgctcctggcctgcgccctggccctggccatggctggccccccgccctgtctccctgctgatctcctgtttctggtctctggctccggctttttactgcccctgcagaagaagttcggccctgtgtgtggccccaaagcccaaagtgaatcccttcctggcccggggacagctgagcctccccctggcaccctggggcccaagcgctgcacagcatgggcctgggtgtggcgagattccccacggacggcccccggaaggactttcccctgccttccaacctcgcccttgctggggcgattggcgacgaatgcagagcggtagctctgcggaagagtgccttcccggcacgaaccaactccaccgcggatcggaggaaatcaaagaggaccacgccgctgacggaccgacgaggagaacgacgaaggcggaccagaccacaattcaacaccatatatcacgccgcggaggccgggacgcatcaacatcacccggaagcaacggcgcagagagcacagcaggaaagcgggacgaccagtcgcacgcagcacccgccccccgagatacagcctggaaccgacccgccgagcccaagcaccagggcgcacaaagagcggaagagaacact

SEQ ID NO: 658100 - DNA, 784 bp, Homo sapiens
ctcccattcagctgaggtccgcaaaggccaagtggggccccggtgcctgtcatggtcgaggctagggaatgggtgctggaagggcgcttggctatcactgaggccacttgctctggaagacggggaactggaggctcgcttatcccattcgctcgcagccgtccctgtaccccagcacagtgcttctgagaggtttgagcggtggtggtgtggtggctggctcgcgcgatttccacggcctgtgcctccgcaagactgaacttacgatagacgagggggaggggtgcccgtatcgtcgttctcccaagaaggtaggcagtaggcgccttccatgatgcagatgcgtgggctttttgcatttgtgccataaatcggcgaagcaggtgcccttcggcagattcgggcacccattctctggggaggatggtgtcccggaagctgtacgcgggtgaggaagtgaagaacaagaaatacttcactgagggaacacagctgtacgtatatgtggaaatctttcttttgaggagcaactgaagaacaaatctatgaactcttcagcaagagtggtgacataaagaaaatcattgtgggtctggataaaaatgaggaacacaggatgtggattctgtttgtgggatattactcacgcgcagatgcggaaaacgcatgcggaccataaatgggacgcgtctggtgacggatcattcggacagactgggacgcaagctttaaggaagggacggcatacgggccggggcgaattgggggcccacgtcgcgctgga

SEQ ID NO: 658101 - DNA, 205 bp, Homo sapiens
ggtcgacgtctagtaggactcccctgcaagtaggtttcgagagccatcttgagtcatacatccgagtagtgcggcggcgttattaacagggtcgttagcttgggaagaaccctgcgggtagtgatctgaggttcagaccggagtaatccaggtcggtttctatctacttcaaattcctccctgtacgaaaggacacgaatgttca

SEQ ID NO: 658102 - DNA, 746 bp, Homo sapiens
gccgtttcctctggctggtagtgcgaagtctgagcgatgcttggagttactgtaatagatggtgacccagcagtagttcatctgagttctgaaagtcttgctcaacaacaggtctggaaagctgggagtccccgaatgggtggataccgtcaagctggtcaagcacaaagagcttgctccctacgatgagaactgttctacaggcgagctgttccacagcgcggacctgtacctccgggtgcgctggagttggctccatgaccaaagatctatgggggacgtcagagaaacgggtcattgccaagccatttcagccgaggctcccaagagtgtgggcctgccggtcctccaaggccctgagggggcttgacacatgggtggaaaacggaccaagatggggccgaaaattgagacctcaggaccaagagatctggaccagaatcgccggacaggtggcagttgccaacaagaagcattagaacaaaccatggtggggtttaataaattcgcctcattcggccaaaaacgaaaccaaaaacaaaaaaattttgtgggcggcctgcgtcactagaaagatttttaaacaacattctgttgtggccaggggcccaggtgtttggtgaacctgtgattaagtgtcaaaagaccaggggaggcacaggcgtgggtctacccaaaaacgcccggaccagacgttttagaacctcagtgggtcggaggcaaggatcataagggcacgggcatta

SEQ ID NO: 658103 - DNA, 367 bp, Homo sapiens
gtccttccgccagggggcctgggtggtgacgggcagtaaggaaatgtgggtgcactttttttatgtggagcgggcggccaaggctgctgtcaacaaactgcagggccccagtgcacctgtgctttatgtcagtttcaattgcgacgaaagcccattggcctcccattaccccaaccggaattttttttttttggaggcgggagcaaaaatagggtcctgttggccctggtgttgtcctccatccccccccttttactccacccttgtgttgtaaataaagtttcggtggtcatgtttagggccggctcccagttttgccggggacggacagggcaaagggcagcgggcagctccaggaacccggtta

SEQ ID NO: 658104 - DNA, 163 bp, Homo sapiens
gcgagtagcggggggatcaggagcaggacgcgctcagacttgcagcacattgtgattgggtgttcggaatatttaaattactgatcagaagatgaaagtagcttttctcttgggaagtcttgcagcccgtgtggagtgataccagtgagcaaacacagagctc

SEQ ID NO: 658105 - DNA, 125 bp, Homo sapiens
cgctttttcttcagcttcctcatcatcaaaatcatcatcatcatcatcttcatcatcatcctcttcatcatcatcgcatcatcttcgcagcagcagtttacttttttctgggccttgctaccacc

SEQ ID NO: 658106 - DNA, 254 bp, Homo sapiens
ccccccctttggggggcccaggggggggggtcccggggtcaaaatttttagacccccctggcccccctggttgaaccccgttttttcttaaaataccaaccctttgcccggggtggttgggggggcctgttatcccccccccttgggggggttgggccggggaatcccttttacccggggggccagggtttccgggggcccagttggggccctttccccccctcttgggcccccaggggggatttccctttcca

SEQ ID NO: 658107 - DNA, 100 bp, Homo sapiens
aattttttataaaaggggtccttgttttggaacccacccttggatatgtgaagccaactctaaaattaaaaaagcccccccgaatttttttttttctcca

SEQ ID NO: 658108 - DNA, 101 bp, Homo sapiens
gttctgtggggggggcctctgacgcttgctcttgagtgcgtcacctcgcggccatggctcgttgtctccgtggcctcatccagctcccgttgcagcttcct

SEQ ID NO: 658109 - DNA, 329 bp, Homo sapiens
gcgtaccacagaaagggccgcttttgaaaatgcacccaagcctcagaagcgaccagcgcgaacacagcgcagcgtccagaaaaacacacttgagatcggcatttctaggatatgcacagcgtcttctcctctccacagatctgaaccactataaccctcttttttgctctagggcattgccaacacgaacggtatgacagggcctttgaccataacgcaccgatacggcagcggcagatacctgagaggacctacagaagcttggactgccagaccacacacacagcatttgctcctacagcagcgctggagtgaagaccaacagcgag

SEQ ID NO: 658110 - DNA, 1117 bp, Homo sapiens
ttccgcgccgtctttcaaatgctgtctgtgctcggaaaatacactaatatacaagtaccctatactgaaccccctacagatagtcgttcataaaggtagactatacactagctgtaggtctaccataggcctactgttatgtactcctgactcatttactgtggccttcattcaagtagtaatagattatttacctattaagagtatagggtggagcgtggctggctcatgtaatctccagcactattggcgaagccacagatgggctggatcacttgaagatcaggagtttgagaccagcactgggcaacatgatgaaaccccatctctactaaaaatacaaaagttagctggatgtggtggcagcctcctgtaatcccaactactcggcaggctgaggcaggagaatcgcttgaacccaggaggtggaggttacagtgagctgagatcatgctacagcaccccagcctgggcgacagaactagagacactgtctcaaaaaaaacacaaaaacaacggtgtatacacggagcgggctaccaatttctcaaaccattataaccccaatagaaaacataaacaccagccttccaggaacacacacccactacacaagcaggaattggacagaatcaccaaggaaaaggacaaggaaaaaatatcacaggtaacaaagaacaaaaagacccacagaaacacagaaaacagaacaaagagaaatcaaacacgggaacccctcagagcaaactcatatacaagaatattgtacaccctttgtgccctttttcaacaaaatattttatcaagccctgtgaacaaaattatgggtcaccatgttgtgacacataaagagcatacaagtataacaatagcgagaagaacaaacaaagcaatgagatgtacaccgccaccaaaggcacaagaataagcaacgacgagccaaaacaacacaaacaccagacaacacaccacaggaaacagcccaatgagaaaaggcaaaaacacaacacacacaaccacgcaggacagcgaacaacaaaaccggcaacacacactaatgatagcaacagcataacacacacgaaacaaaacagagcaagaacaacagtcggacaaa

SEQ ID NO: 658111 - DNA, 921 bp, Homo sapiens
gacccccgagctgtgctgctcgcggccgccaccgccgggccccggacgtccctggctcccctcctgcctcgagaagggcagggcttctcagaggcttggctgggaaacaccgaacggaggtgagggatcgcgctgcagtataaacagccggttttcggcggctttatctaactcgctgtaagtaattccagcgagcaggcacgagcggagcgagccgggcggccggctagcggtggacagagccgggcgagcagagctgcgctgcgggcgtcctgggaccgggagatccggagcgaactagcggggcttccgcctctggaccagccctcccgctggatcccccagacaagccggtccgcaaccccttgaccaggccatcccaacgaaaacttttgccccataagaccaggcggggcggggccacttattgcactggaacttcaacaaacaacccagaaccaatggaccgcgactcttccccgaaccgcagcgtgacgcgctatctctgcccattctgggggaccactttcacccagcacagcgcttggccagcgaaaccactgcattacttcttgtaaaccggcttcatcacatttgccaagcctcggctacagcaccgcctgggaaattcgagtataccgagagcttagactgcacagccaccacagccagacctaccccgagccgaccgaaattgcccccctacaaaggctaagccttgccacccaaacacgggacactcatcaaacctctcggactctacagaacctaccgagttgcaagcccgcgctcgcctacattggcgcaccggacgcgacggaagacaccttccgtagcccgaaccgggcaggcagcgccggctgccggccgtctgtgagacccacgggagcccccagcaaagccacaccctcggacacagca

SEQ ID NO: 658112 - DNA, 100 bp, Homo sapiens
aagatggctgctgtaagatcatcctgccactcagagaggtggtgagcatcgagaagatggaggacacgagcctgctgccgcatcccatcattgtcagtat

SEQ ID NO: 658113 - DNA, 1622 bp, Homo sapiens
  misc_feature (1112)..(1112): n is a, c, g, or t
tttcacgctcggtaattttctttgttgctcccccttagtcggttcttgggtctgtttttttcttgtgtgggtggttgctcctcatccttgttgtgagtgagtgctctttctgttgggcccgagctgcttgtgtcccttttgttacgccttgttgggaaaatggtgtttctctcgtcagtccgtggctatctgttccttcttgatgaagtcctttgttcgcccctcgtttgcccgtttgccacgcggggggaacctcacaaagggggctcttgttgttgacgcacccacgccgcgctgttgttgtgggctccctcccgcccgttcccacacagttgtgtctcgctgcgggcccctgtttgtggatattctccaaacccaaaatttgctttgtgttgttggccgccaccagatatagttctgttccccacacccccgggatttatcaacgaagggtggcaaattaagggattgatagccccacaacacctttatggggtgtccacaaatttttggggagacttcttataaagactgttgttgtggtttcccctcggcgtctcccccgtgggtaaaaaagaagggcccaacagatggtgtttttgttgttgtgttttgcccaaagcacaggcccccctttggggaaaatatggtgaaaccagtcctggtgctttccacaatgtttggttttttggggggatatctcttggggcccacaccccacaaaagtttctccaccggagcatttggaagtatatcaccctgcgattatccacgcgtggccaaaggaaaaaagttgttctacttacaagaggcgtcctttctcggggacccccctctaaggggggcttctgttttggggagagaaaaagggcctttttccaatagtcactcgcacaggagatcctttgaatttgcgttgtgacaaaggcgctctctgttggttgtgttctcgcccacttgtctcctgcacgaactgttgtttctctgttggcctctctctgaggtgtccactaagacaccccacacggagataaacacactcttttgtgggagaagggcccacacaaaaaattgagaccaacctcgtgtcgtgttcacattgggcacagccncgctggtgtgtgtgtttgagagacacacacagagagggcaccacagtttctctgtctctgtgggagaagagccctctttctgtctctcacaaatggggcactttttcggggagagtgtccactgcccacagagatcacatgtggtgcttctacatgaggaggactgtagcacgctatatcacaggggttgttgcgcacacttaagtgaggggaactcttctcctccccccacggtgttgttgtcgtgaggtgagacacacaataacacacacaccctgagcaataggcttgagatctttcttcgtggttcccttttacatctggtagcccaacaataacacaccatggattttaaaccccttttgtaaataatcttatccatgggttctatacccttgtcccaaaagccaggagatcagaagactatttgtacttcattattatttccacaggcgaatagattggctttctttttgccaaaaataattaaagtttttgtatgttgccaca

SEQ ID NO: 658114 - DNA, 181 bp, Homo sapiens
gggggggggtttaaaaaaaaatttttttcccccccccccccccggggggggggggccccctttttttcccccccccccccctaaagggggggggggggtttttttttttaggggggccccccccttttttttttttggttttcccggggttttttttccccttttttcccctgggggagga

SEQ ID NO: 658115 - DNA, 488 bp, Homo sapiens
atatgtgatgggttaatataacacaagtaagggggtgtgggaaaggtcctcaattcatttgatttccttaaaaaagcgattccagggtgtgcaattaatccatgaccacatacaaggatccaatgaactaaataaggtaaaatctctcaggtaacggtaaaatttggaggataggataaaaaaatactccaggggttcatactctgaccacgttccttaacggattctgtggcccttgggcttgggggtcaggggaagaaaagagggagaaattgtcgagggagaaggatagggggatgagaggagttccccttagaagtggagcccatggggtgggaacttttcttcccccattcacggaagcggtagtacgagcaattcatggtcactttcacagtcatctctgggtaagccacactattggagctaagcaaaatggggaccttgccaaagggatcttatcggacttggacgtgcttcaggtgact

SEQ ID NO: 658116 - DNA, 258 bp, Homo sapiens
cttttatggtgatctgatgagcgtcgagcatcgagcgacatataccccggcgtacggatacatcccagaagcgccagtatctgctataccacaagtggcccactaagacacacgcattccaagcacggcaccacgccagacaagccgagctactatacccatttaaagtatgagactaggttgagatcgtatcggccccaacacctctcactcattacgctttaccggatcacactgctggagggggccgcgcgagaa

SEQ ID NO: 658117 - DNA, 366 bp, Homo sapiens
  misc_feature (232)..(232): n is a, c, g, or t
ggggaagattactcagggacattggttttaacatctacagggggccaggaaagggggtgctgggccgatacaaggttacatattagaactgagatgcctgctaaaagtactctagagaagcacaaccttaataagatgatggactaaaaaaaataaaaacaaattttaaaaaatcaccagtggcatagaaaaatttgcccctgcctagtttctaggaggaaaaaaaaaagtnttcaccaaagaaattgaaacattagttgtgcccctcaggcttaaggtttgattttaaacaccatcactgtggtccaagaacttccaaacttgaggaaacttaacatgaaaattgggcccaaaggcatcctgttt

SEQ ID NO: 658118 - DNA, 271 bp, Homo sapiens
gcccctcccccccaggggggcccttttttggggggcccccccccccatttgggaaaaggccccggggttttggggtttttttcccccccgggttggtttggcccccaattttttggccccttcggggcaaggaaatttttaaggggaagattttaagggtttttttttttaaaggggggggtttaaaaaaagggggggattttttttccccctttttccccccctccggttttttttttttttgggggccaaaaaattttgggttttttga

SEQ ID NO: 658119 - DNA, 334 bp, Homo sapiens
tgaagattgcccatgtagcatgtctcaaaagttaattccttttttatggctgaatattccatcgtgtgaataaatcacatttggttatctccattcttctgtcgatggacacttgggttgttcctacttttgggttgttgtgaattgtgctgccatgaacaagtctgtctgagtccttgttcagttcttgtggggctacgcctaggaagagaattgctgggctgtatggtaagtctaggtttaactttgtgaggaaccagatgttttccacagcagctgcaccgttatatgttcccaccaacagtgcatgaggctgccactttttctgtatcct

SEQ ID NO: 658120 - DNA, 916 bp, Homo sapiens
  misc_feature (173)..(173): n is a, c, g, or t
  misc_feature (205)..(205): n is a, c, g, or t
  misc_feature (207)..(208): n is a, c, g, or t
  misc_feature (221)..(221): n is a, c, g, or t
  misc_feature (247)..(247): n is a, c, g, or t
  misc_feature (269)..(269): n is a, c, g, or t
  misc_feature (275)..(275): n is a, c, g, or t
  misc_feature (280)..(280): n is a, c, g, or t
  misc_feature (286)..(286): n is a, c, g, or t
  misc_feature (294)..(294): n is a, c, g, or t
  misc_feature (314)..(314): n is a, c, g, or t
  misc_feature (343)..(343): n is a, c, g, or t
  misc_feature (357)..(357): n is a, c, g, or t
gccccccggtccgaccaggaaggtgggatgctctgatggccgggcctgcggcgctgagcgctggcggcggcggctgctctggcggccgccctgctcctgctgcgtcgtgaggacccggggccgggggctggccccagcatggccgaaaacagagctggcaaaagctggagggngcaaacatttcaacttgctatcctctaaaggngnngataaatcaagcnattttttatatctacaagttaagggngaagtagaagccaaggttgaanaattanaattngatcgntactctgnatttaggcctggagttctgntatgtgataggcaagaatctcgcccaggngaatggctggttanaaagttctttggctccttaccagactcttgggccagggggcattctgtgccttgtggtgaccgtggttagagcaatgctgaacaatgtgtgtgagaccaagagacaagcagatgggaactggctgggagaaacaaggccatccatgaccttgggggaaagcgcaatggtctctcaaagccattgacacaactgggagaacatggttttcatgtgtcaaccttaaacacccaattcagcaaatcggtaatttccagggtcttaaagaaaaatgtcagcatgttttaacctttgtggttatactattcctcaaggcatccattccaatcaagaaatgatgggtgctcctgcatcaagtggttcagagccggggtgtattcatttagatcccctcacggagcttgggacaaattaacgatctggtcagcctatctcaaatttggatcacaattcctgggtgtgggccccataatctgtactttccttgtatatagctcccttgatgccactggttccgatgcactggtggggggccgctttgaaatggtgtcttgagagtcc

SEQ ID NO: 658121 - DNA, 455 bp, Homo sapiens
  misc_feature (2)..(2): n is a, c, g, or t
  misc_feature (29)..(29): n is a, c, g, or t
  misc_feature (40)..(40): n is a, c, g, or t
angtacattcataccgtgagtgctactcngcaataaaaangaacaaactatgggtacaggcagcaacttataattcccagagaattatgctggatgaaaaaagccaatttaaaaaggtttttgtacccaaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctgtatcacagctatcaatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaa

SEQ ID NO: 658122 - DNA, 383 bp, Homo sapiens
agactgctttaaaaaaaatccttctaatctgctatgcgtgaatgccacgcgcggccaaggaaaaagtgtcttggggatattatgcgaatttccagatttgaagaccaaaatactcttattctaacacaagccaggctttttattttttatacagggggatattttattccagggaaaattttaaataaaaaataaatggtttttatcttttctacagccaatttataattttaagattccctttcttgtttatcagcaggtggtattacatccttgtggcacattttttttttaattttgtaaaggtgaaaaaagcttttatgagctcatgtagcaatcagattttcctgtggattgataataaatgaatatgatatatagtt

SEQ ID NO: 658123 - DNA, 920 bp, Homo sapiens
  misc_feature (41)..(41): n is a, c, g, or t
  misc_feature (70)..(70): n is a, c, g, or t
  misc_feature (76)..(76): n is a, c, g, or t
  misc_feature (79)..(79): n is a, c, g, or t
  misc_feature (94)..(94): n is a, c, g, or t
  misc_feature (120)..(120): n is a, c, g, or t
  misc_feature (124)..(124): n is a, c, g, or t
  misc_feature (177)..(177): n is a, c, g, or t
  misc_feature (209)..(209): n is a, c, g, or t
  misc_feature (211)..(212): n is a, c, g, or t
  misc_feature (225)..(225): n is a, c, g, or t
  misc_feature (251)..(251): n is a, c, g, or t
  misc_feature (273)..(273): n is a, c, g, or t
  misc_feature (279)..(279): n is a, c, g, or t
  misc_feature (284)..(284): n is a, c, g, or t
  misc_feature (290)..(290): n is a, c, g, or t
  misc_feature (298)..(298): n is a, c, g, or t
  misc_feature (318)..(318): n is a, c, g, or t
  misc_feature (347)..(347): n is a, c, g, or t
  misc_feature (361)..(361): n is a, c, g, or t
aatcaagaagtgggggactttgaaaagttggatgactaccncctctggggtgggggggggataatattanattctnttncctgggtaccaccanagggaaagctggggcggagggatttnttcntgtggaccgagattatgtgctgaagtctgcaaagctggcaaaagctggagggngcaaacatttcaacttgctatcctctaaaggngnngataaatcaagcnattttttatatctacaagttaagggngaagtagaagccaaggttgaanaattanaattngatcgntactctgnatttaggcctggagttctgntatgtgataggcaagaatctcgcccaggngaatggctggttanaaagttctttggctccttaccagactcttgggccagggggcattctgtgccttgtggtgaccgtggttagagcaatgctgaacaatgtgtgtgagaccaagagacaagcagatgggaactggctgggagaaacaaggccatccatgaccttgggggaaagcgcaatggtctctcaaagccattgacacaactgggagaacatggttttcatgtgtcaaccttaaacacccaattcagcaaatcggtaatttccagggtcttaaagaaaaatgtcagcatgttttaacctttgtggttatactattcctcaaggcatccattccaatcaagaaatgatgggtgctcctgcatcaagtggttcagagccggggtgtattcatttagatcccctcacggagcttgggacaaattaacgatctggtcagcctatctcaaatttggatcacaattcctgggtgtgggccccataatctgtactttccttgtatatagctcccttgatgccactggttccgatgcactggtggggggccgctttgaaatggtgtcttgagagtcc

SEQ ID NO: 658124 - DNA, 1371 bp, Homo sapiens
  misc_feature (599)..(599): n is a, c, g, or t
ggagaactagtctcgagttttttttttgttgggttttcattggccgtcctctctaggctgtcttgggcgaggagggccccgggggaatcggggtctaatattcccgcgaatacatatttcgtgcctcagcgggctctaccgtgggtcctcctgtggacccgtggttgtgtcagcacccctccatcatattctcccgtgcacaggagggtgggaaatacgtggtggtcgaggcccaatgagggcttctcgcgacatgtgttagtctacaggggtggagaaccccttatcagcgctgtgggcgtatagagcgccaggacagtgtgtgagtgtggcgcctggtggcctatctcgaggagaaggcactctctctcgcggatgtccactctcgtgtatctttttctcccccaactttcttacaacgatattgttgcgtgggtataaagactgtgtgggcgtgggtataaagtgtggcgtgtgtggagggtacccccacttaaggagaacgcgtgtggagatatgaggggggtgttatatatatacaaggtggttatacgcgggagctcgtgggcgtgcacatatatctttaatagtcgtgggcncttttgagaagatctggggtggacaacacagcgcgagcgcagagggggactccttgtgtggtcaaccaattttctgtgtcgggtggctctactctgcgagagaccccccgatgatatatctctcgctttttcgagagagcaaagactatgtcgaaagcagcctccccacagaaaggtgatcttgtctcatccacaagtgcgttccctataaacaagcgtgtgcagaacaggggattcacaatatcgcggggcggggggataacaagtcccgtatccctctataagggggcgcgaaggctcccgggggtgctgtgttcaccaaaaactattaacgttttctgtcgtcccatggtgggggtggatcacaaataccccctgtgtgttgtggacgatggtagcaccacacacatgtatatttccgcggggatatcccccttattaccacactgttgtggacacccgcacatttgttttacaactgtgtgtgcccccgccacaaaagagaagctcttgctcaaccggtattgcggccagaaagtagagacccgccttgcttacttggtggttgcccccccgagcgagcgggtgacagagggggtgcagcaccggacactggatataggtaagaaaggggcacgcctgcggaggaggcacaaaccgcggggtacaccctgggaggagcccgtcgttagagccccagataaatgtgccccgggggctactgggagtgcgtcacgaggcagggacacataaacagtggcctggcggtccg

SEQ ID NO: 658125 - DNA, 400 bp, Homo sapiens
gtcatttctacctgacctcagcctcccaagtagctggaactacaggcacacactgccgcgcccagctaattttttgtattttttagtagaaacaggatttcactgtgttgcccaggctggtctcaaactcctgagatcaggcaatctgcccaccttggtctcccaaagtgctaggattacaggtgtgagccaccatgcccggctggcagttgtattttataaagcccttctagataattccaatgtgttggaaagtttaccttgtactacagatataactaggtaaaaggctgatttctaaatattctagtaaactgcagcaacctaactctcctgtctacccttaaagtaaactgtatgccatgtattagttttggttaacattgaaagaaagttattt

SEQ ID NO: 658126 - DNA, 709 bp, Homo sapiens
aacaaaaaaaaaaaagaaatataggcattaggatcatgatcctgagtgctgcacttggacagaggtggtttagtccaatgtggaaagtgatgcgtggagcgttccctgataaaggcaccttgtgaggcttcccattgccgcatcctctcccctcaggaaggggactgacctgggcattgggggaagggactgtcagcaatggatggctctgaccctccacagtgtgactctgccaagcagatgtggaccccagggcataccctacacaactgccctccccagtgaccaccacctaagctgctctcccattggaaacatgcacagctctctgaaatggggcataatagtatgggaccagtgacccctgagcatggggaccacacacctggagcccagagtgcaagggagaacatcactgtgaaaccactgtcacttcaatccatttgcacccagaggaccacaagagactcaatgctcttgaactctgagatgagagagatgctgcttcaggagacaaaacagagacaacaaaggataagaaggaaaaagaatgttgaccattgtagtagcgttaagtggacaataaggatatactgtatagaattgaattggaaagggtgaagtgtgaatagagattaaaatataatgttgagtgttagataattgggatctgtggtgaagagatgtatggtggaatgagaggtgaaaa

SEQ ID NO: 658127 - DNA, 331 bp, Homo sapiens
ggccccccccccctaaagggggggtttccaatgtttttgggatgaacccccaagtttggcccccttcccccttggaacggaaaattttttgccctttgtttttttttgaacccaaaggggggcccccctttttaaaaaaaaaatggccccgggggccccaaggggttggttgtttgggggcccccccggccccccggtttttggggggtttggttccccaaggacctttccattttttttttttttgacccaggggggaccggggttttgggggttttttttcccccgcccccattttccctccttttttataaggggggttttttcccca

SEQ ID NO: 658128 - DNA, 940 bp, Homo sapiens
  misc_feature (17)..(17): n is a, c, g, or t
  misc_feature (940)..(940): n is a, c, g, or t
aggctggtactggtccnaggtcgtaatgatcagctggatgcattcggcagccgcaaccgagctggacaggctaaagaaggactggtgaacgaggcagagcttcatgctaaacaatcctccccaaagcagagaggcagactctgattcagcacttccaagccatggttacagcttgagagaaggacagcagccagtgtagaagcaggcagctggtggagacccagcctgtgcccgaggtggcaagctatgctgaatgaccggcggtcggatgagctcttggagaactaccgtggctgccttgcgagtctgacgccgccacgggccgtcgatcgactattctccgagagctcttacgggacggtttagtgtccggtgctgaagcaagcgaacatgatcagctgtacataagccatcccgtgcattgtaccaggctatgtagttcgagcgttgctaacgtaaccctaggagaacagggctgggacccctagggattggacaatccgccatgggtcggattgaacataacaatctttcccaacggtttgaatgggaaacggacccaggggatggtcaaaaccgctaaagaggtgagcttccatgcgtttcttagtcctacgtgaacaacaacggttaaaccgccctatagagataggttaaggacccccaaaaggaataagagttctaccagagcggacaggggagaccacttatcgaaggcggaatggccttacgcattaatacaaaaggaggaatcggcgaaagacgccgggaatgtccatggaaaagtaagtttgcggcaatcgccgaaggggagtatccgaagccttttgcgccccggttccgagaatattcccgttccgacggtaaaagaaaaagccgcaccacatggaatttgaggaaacagaggattcccacaggtggtagactttgaaaagaaccn

SEQ ID NO: 658129 - DNA, 256 bp, Homo sapiens
acttgcatcccactatcttccttcaccaacatgcaagttctttccttccctgccagccagatagatgacagatgggaaaggcaggcgcggccttcgttgtcagtagtttctttgaatgtgaaagggggcagcacaggtcttttaaaccttgatccaaccctctttgcatcttacaaagtgtagccagctaaaagaagtaaaataagaagggccattgcttgtggaatgtacagtgcatatggattgcaccctggga

SEQ ID NO: 658130 - DNA, 975 bp, Homo sapiens
gatgaaatttttttttttctcgagacagagtctcgctctgaactccagcctgggcgacagagcgagactccatctcattaaaaaaaaaaaaaaaaaaattcgggggtggaaggacaccccagggggggaaaaatcttttcacattttatacttccaacaaagggattattttttagattctacaaggaacttcaaaacaaattcggttagggaaaaaaccaaattagggtctctccagccgggggggacagaacggaagaattccttcttctttaaaaaaaagaacaacaataaacaaaacaacacaaaattgtgtggggggggtctgggggacatgaaaaagagtttttaaaacaaccattggctgggggggggggggccgcacgatgtgtttgactgcaaaccgtggcgtcacaaacacgtgcctcccccagagaaacacatccggtgccgaacgaaaccaggcggggcgtgggcttctccccccacaataaaaaagccggcggccgggcaaacacgcggcgtgcctcttcggaaaacacaactccgaaccgggccagctgcggggcgacaaggcggggtcctcacaccaggggacgtcccagggcgagactcgaatataaaattagcccgccgcgccgcggggagcagcaaacaactccaaagatcagaaactaggacaccaaacagaacaaaaaccaccccgaccctaagccaaacacctgatagagacactagctatagcccactaactcgcgccataatctacgcaagcaaaaacactacaaccacgcaagaagcaccgcacacaccacggtcatgcccacccagcacacaaaaagacaaaggacgaacgcaacgacaacaacacacaagaatacaagacaccggacccgatacacgaagactacagagcacatcatccacacagacaaaaacagccaagagaccaccacccaacaatccaacagcacc

SEQ ID NO: 658131 - DNA, 924 bp, Homo sapiens
gttgttatgcatttagggaaaatcttacagtatttttacattattttttatacattatttccccccttgtatattcaaagtttgaaaacaaaagtttagaattgaatatcaagttagagaaacacagaagaaatatttggaagtgttgataatgaaactacgctctctattcttagagacaatttttaggaaatagctttaacataaaggctcagtatttattttgactggtatgtggtacattgtaatgtgtttagaaatcgtatctagtttaatattttgggtgtttttcttccgagatagatcattattcatatcaatggacagaatagtggattgaaatgtaccttgcgatcttgaagtgtttttccttgatcctccactccccttcttttgcgtattattattggatgtttattagttgcaatgcttaactctttgaaaatagtataatgattgatgtaaaaatggggaggaattaaattttatctttattattctctaagtagtagtattcctagagtaccatgctagtttctgtggatttaacatatagttattctgtcttgaattatggactataataatgttgcctggtttattggacgacacagaaacatttcaaattgcaccagtttaattagatgctctaactctaacatcaaacaacgaaatctacactgtgtaaacttcaagttaaccgaacaagtttaaatgctcaatttgaaattaagccacaaaattacacggttgtaactgtaaattaacacactctgacttcaacggttaaacttggaatgtaagcaaaaaatttgaattgtgacattgttattgcacgtgtaaggaagaacacagggtggactgactgtaatggagagggaatagatatcgttcagtatacatgcatgtggcatagataagaag

SEQ ID NO: 658132 - DNA, 257 bp, Homo sapiens
ggatagaggtggagaggaaacgggatggagacggtctaggaagcctcctgatgtgattgatacttgtaccgcgttagcaagtgaatgcttacataattcagatttactttccagaaaatccaaaatattaggttgctgcaaaagtaattgcagttttcaattacttctcaaaaaccgcagttactttggcaccaacctaatagtacttgggtaacaaacatctgcccatgacaattagttaagccacagtcaaacca

SEQ ID NO: 658133 - DNA, 266 bp, Homo sapiens
gtggtgttctccgagttcttctttgtggtggaggaacatggccggatggtggacggaccgttcgcgagttacggcagtgcgaccggtgagttgactaggagaaattagcggaacctcggctcccccattcgctccggctgtaacgacgaaccccgtactagtgactctaacacccgtgagcaccctaccaaacctgcacaaccctcgaccgcgacccgcccctcaaacccggcggtgtcagcaaaaaccgaactctccagactcca

SEQ ID NO: 658134 - DNA, 639 bp, Homo sapiens
cctttaaagaagccagacaaaatgttgctgaagtagagtcatcaacagcaatgcttcagcaggaccatcattctgagcaatactctgtattccacatgcataatggaagtaatttacagcgtgaagcaactgtcatcagtgcaagcacacacaagtcccaagcaaacccaaacatattggcgcaagcaaacccaatacataattcccaaggcacaaaacatagcacaagcatggcaacatggacctcaaagcagtgactattgcaaattctcccctcaaagcccttcagcaaaaggattctgtagttatccttgcagtacccgcaagacacctgctgaccccaacactgaaaactctaagtcaaaccaaaaaaaacaaaggatctgatagctcactctctggtaacagtgatggcggagaagcaatttcgtgcacagcaggcagcacaggcactattttgcatgcatagcacagcaagcaaaggtttttacaagccagtcttccactgtctgacagatagtgatagcggtgacgacttcttcatgggcacagtcagcacggacacgcacagcacggcaaagtagttgtcattctttcggttcaaggaacaaaaaaccactagaaaaagtgtttcttcaa

SEQ ID NO: 658135 - DNA, 442 bp, Homo sapiens
tgagaactgttcatccttcttcaagaagaagcttgccaggccgggcacggtggctcacgcctataatcccagcacttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctcaaaaaaaaaaaaaaagaagctggtctaatggatttgcctaaaaaatgcggggactccaaacaacaattggacctgtcttcctcaataaaagtcagtgtctcctggaattcttttacacaaaaaaaaaaacacag

SEQ ID NO: 658136 - DNA, 885 bp, Homo sapiens
ggcccgctggcgggtggtcctgggctccaggtaaccactgcaactctggggagttggatatcacttctgattgaattcactcctggtatgaatgtggatgttcacattcaggccaatctggaggatgagcttagtaaaggaagctcttatgacgggtgtagatctccgtcactattccaatgctagttgagctggagctacatgcatgattgaccagaagatccattcgtggattatattcaagagagtgagaagtactagcatctctacagcaacctagatcactagctctgtgactgtctgtcctggacgccgtaatggattgctatgatgcttgggagcttttcagagtgacctcatgtatccatcagctctgagatccggacactgacaggaacagtcacggagccatgatcattcgatttcgacatcgccaggcagttcgggggaagacttggggacgcttgttgatggtctggtggtgccttctgctctggtcctcggcgttctggcaggctctctgtgtcggatccacgttctcggcgcactctgcgggtagctcggattggccctgcggagccagcagtccagagcaactgtgcatgctagagtgaccgctaagccatggcacaaatgtacacgaagcgtagtacgatccgtgtccccgggtcaagcgcagcaaccccattcatcccgaagtatgttccttccatgtaagattcaaccccgcgtcaaggatgaccccattgagccactgtatttcagaatcaccctacaacgaggtcctgtacgatgaacgatccaggatcacccctttcgaacttgctggatgaggcgatgtccgacgcaaattcagggtctaccaggataacatcgtggagccct

SEQ ID NO: 658137 - DNA, 218 bp, Homo sapiens
ttccaagctatcacagagaaggtcgtttatggtgaaccacatgggacacgaggaatgatacggtgctaggtgtagatatgttatatttgccatgagagtaagtatggtgtcagcagctggggatggctttggaatgcttagttggaaacaatatgttatatatgtcctatatatacctagtcattggcattggaccttaatcctgtctgtaatggata

SEQ ID NO: 658138 - DNA, 80 bp, Homo sapiens
gcggccgcctactactactactgctcgaattcaagcttctatgtacggggacatggaggggatgtagttgcatttttgcc

SEQ ID NO: 658139 - DNA, 145 bp, Homo sapiens
  misc_feature (22)..(22): n is a, c, g, or t
gggaaggaggcgccgtgctgtngctggcggcgggagctgctcggaagctacacctcgcaagggctccccctttcctactgtagcgaaaaatcaacacagacccaaccactccaaatcagcgacacatgctgaacggtaatagaca

SEQ ID NO: 658140 - DNA, 104 bp, Homo sapiens
ctagaggaccccgcacttgctaggactcagacggcctgcttcactgcggtcacttcctaggactcagacgggccttctcccactgcggtcacttcctaggactc

SEQ ID NO: 658141 - DNA, 443 bp, Homo sapiens
ccctcgatcgaggtttcagctggacagagcaatcgtctcaacaaaagaatatatatgagtcgagacagctgacacatgggaacccatttgtaaagtacaaatggcggcatgtgcgcatgctgtaatccagctattgggggtgaggaggagatcacttgaactgggaggggaggtgcgggagcgagagcatgcattgactgagcctgggcataagagcgaaaactccgtctcaagaagaaagaaagaaagaaagaatattatatgacattagtcgtagatggatgcaggaagaaacctaaggcaagacaaaagttatgccctggttcaatattcatacctcattcaacactttccagttcatatttgggaaggaatgtggtatactggaaagaccataagttttataactaggtgtcctgagaaaccgtcgaattcgaggggta

SEQ ID NO: 658142 - DNA, 1206 bp, Homo sapiens
cttctcagcccttcaacaagcggtgtacccacatgaaagcacagataatacgacgtgtggtgcacgaggagtagcttgagccgagaacgaggcgagaaagctgtgagaccgaggagaatcctgctctagagtcggagttgaagcagggggacgggtggtacccgatgagagtgaaccgtgcgttgtatcagtgactgctgagacatccgttgcatacgcaacgcaggcaagtctttcaggctaacgagaaggttggcaagtgatgctgcgcaagttagaagaaacggcacctccgcatgcgctgatggtggcttgcgtcacatggcgatgccttagtctctcgagcgtggacgtgaatctgtggactccgctgtggctgggttggatgcacgtgcaaagcgacgatagctgcgccagtacccccaaggtgatgcctcgcgcttgaaatggcgggccttctctcatgaagtggagtgaacttaagcatgatagaacatccgaaggcttatctagttgagagaagtatctcacaatgctcagagtgacatggaaagagtgcaagtccaagatgctgtggcaggaggctgggcctactcccataccttgtcatctatcatctttgtaccggcatggctgtcgagctctactgctggaagcgcatgtgcccatttgtcgtcgttgagtcactattggaggcaagtctgcttgtcatcgcacgtctgtctcctgtcgcgtgggcgatcttgtcctacttgctcacgtcacttaccaggggttgtatcgaaatcttgcgaatttggcttgacggaccattgcgtaacatttgacattccccacatgttgttggctctgacctaagctggaaactggtgaacaccgcattgctggggggaaaaggatgcggagatggccccaatgaggaggagagcgtgtttcaaggtgcaggatttagccagattgcctcgttgataaccgtcttggagcaaaaagctagtattcaccttgtttggttgtgaagaatcctggtgacttctcttgtgcaaaatgcatgtgggtcctaaacacaagggttggggaacgctggagatcgaagaaagccgtgccttaacctggaaaggggagattcctaacttaaaaggccaggacattgggtgccatttcgtccggtgaacaagaaaggctgggagtattaacccttgggaaaag

SEQ ID NO: 658143 - DNA, 127 bp, Homo sapiens
  misc_feature (65)..(65): n is a, c, g, or t
  misc_feature (67)..(67): n is a, c, g, or t
tttcaaaaacccccgtttttttttggggaaaacaagaatcccaaagggaagggtgctttattggncncccgggaggagggggtggcccccaaaattatttttcttaaggaagggttaaaaaagggaa

SEQ ID NO: 658144 - DNA, 699 bp, Homo sapiens
  misc_feature (539)..(539): n is a, c, g, or t
  misc_feature (583)..(584): n is a, c, g, or t
  misc_feature (631)..(631): n is a, c, g, or t
tgattattccttagatactaagtcagtgagctgattatcactgcaattacattaccagtgtcaacagatgccgcgtgtaggcaacgagttaacaattaagtgggctcctggccctgagacctcactccacagcaaagcctgtgtaaactcttccactttagatacctgcatggacgaatctgatgcctgaaaacagaggaaggtgtttcctgaccacggtgtagctgacagacaggcttctctgctttcagggcggggatctccccttcagatgaggcgattctgcactccaagatctgactttattgacatctgtaaattaattgagttacaaaataagaaggtaaatgtggccacatgcaaatgcgcatactcattcttccagaaaaaagtcacatgatgatgaccatttgcgtttttgaataaaatggtgtttcttatttctttaagaagcttccataccagcagaacacatttcccaacaagggatagtgagtttcactgtgagtgtgtgtttctggataaaacacaatgctctncctagaaggcccttgagggctgtttggttccagctaacaatgcnntgggtgggggtggtcccgttctttgctgtcagaagcacatgcgcttngccctggcttcctttcctgggtctgctgggcaacgtgcactttgtataggtgagtgcgtctctttttt

SEQ ID NO: 658145 - DNA, 316 bp, Homo sapiens
  misc_feature (205)..(205): n is a, c, g, or t
ccctgacagtatagagagtgaatatgagatctgcgaataagcataaaagatgtgactgatggagagatagacatgtgcagcgttaaattggatggagaggggggaaaatgcaatggcagtgtaattaatctggggaatcaccaggatggggagacgagaaatgtatctgaaaagaccgtagggaaatgggcaggtgcaccgtganagctgatatgagagtatatgtgtgaactgcggagtggtcggatatcaatacagatcgaggagacgttcaggatgtcatggaaatgggtgtgaggggaacatattgatatca

SEQ ID NO: 658146 - DNA, 148 bp, Homo sapiens
  misc_feature (123)..(123): n is a, c, g, or t
tctttctcttaagtttgtggtgggtttaaacttggaagaatcggaggttctgtgaaaattgttgggtgtaattatggggtatgtgagttgtgctgagtgttggcttttgtctttaggtcactngttcatggttggtagtcagtaactt

SEQ ID NO: 658147 - DNA, 693 bp, Homo sapiens
  misc_feature (324)..(324): n is a, c, g, or t
cgtgaacgctttcggtgactcatggcgtgcttatatcagatggttctgcatgacacacttagtagagaatacactgtgatagcttatgtaaatatgtctccagtgagaaccgaagtttcgtcgcgtgagcgcatatgcttgctgatcactaatacctgaggacactgaaacatagtcttatgagtaaccacatttgtctttttacttgcagtgccagtgtacatctgactacacattagcgactgtagtgtgcgcccgaaagggttgtcagcactgcagtgaccggatctacacaagactgactatggagaagactagagctantgcttacatatgtctatatatacgccatgctccgtttaccatgcccattcgaagcttatgccattgctctcgtagattaaacgacgagataatgctacatgtcttaagattgagcacctgaccctgggtgcttttactgggatatataatcataacctggtgacttagccattctgagcaatatagcggattgaagtctaagccggcttactgccttgccttcccagaattcataactgttggacccgaaccgtgacggtgacagccgtataggtaacctgtccattttgctttgatgccagcataaattgggtcatctagggaccacggaatttgcaatggaagcattgatcctttaccttggtacaa

SEQ ID NO: 658148 - DNA, 416 bp, Homo sapiens
  misc_feature (36)..(36): n is a, c, g, or t
  misc_feature (42)..(42): n is a, c, g, or t
  misc_feature (71)..(71): n is a, c, g, or t
  misc_feature (97)..(97): n is a, c, g, or t
  misc_feature (141)..(141): n is a, c, g, or t
  misc_feature (151)..(151): n is a, c, g, or t
  misc_feature (154)..(154): n is a, c, g, or t
  misc_feature (201)..(201): n is a, c, g, or t
  misc_feature (233)..(233): n is a, c, g, or t
  misc_feature (280)..(280): n is a, c, g, or t
  misc_feature (327)..(327): n is a, c, g, or t
gggcggattcaccctgaggccccaggagtttcgaanacccanccctggcccaaacatggtgaaacccccanctcctacctaaaaatataaaaatcanctgggcgtggtggcacgtgcctgtagttcctagctactcggganactgaggcanaanaatcgcttgaaccctgggaggtggaggttacagtgagccaagaatcngccattgcactcaggcctggatacagagcaanaaattgtctcaaaaaaaaaaaaaaaaaagggaggccgggtgccaagngcacgcctgtaatcccagcactttgggaggccgaggtgggtggatcnccaggtcaggtgatctagaaattaaaatttttgttttttttcaagacagggtatcactcaggcctggatacagagcaagaaattgtctc

SEQ ID NO: 658149 - DNA, 139 bp, Homo sapiens
aggtggcaggtgtagttttcttctgctgtttatgtattatctggtttcgtgtagtctttcttctaaatgggagagttatcagttagttctctgtacatttattattttcttgtatacatatgcaatgaatgtttattgg

SEQ ID NO: 658150 - DNA, 101 bp, Homo sapiens
gcagctggtcgcttcgagttttgtcacgccactgctttgggcacccccggtacccatccaatctcacaccttgccatgcaaatcaaggatcaaatggcccc

SEQ ID NO: 658151 - DNA, 381 bp, Homo sapiens
  misc_feature (57)..(57): n is a, c, g, or t
  misc_feature (64)..(64): n is a, c, g, or t
  misc_feature (183)..(183): n is a, c, g, or t
  misc_feature (191)..(191): n is a, c, g, or t
  misc_feature (223)..(223): n is a, c, g, or t
  misc_feature (249)..(250): n is a, c, g, or t
  misc_feature (252)..(252): n is a, c, g, or t
  misc_feature (306)..(306): n is a, c, g, or t
gcggtccaagagcgagtggaaagatttgggcgagaacttgcgcgggaccggactaancggtgcnagcgcacaggcgacacagacaggggcgggctgctactccggaatctgctaatcccagtcggtgccgcatccccagcccgccgccatggccagcctacaaactggtgctgatccggcacngcagagangcatggaacctggagaaccagcttcaggcatnggtacgacgccgacctgagcccggcnncnacgaggaggcgaacgccggcgggcaggcgctacgagatgctggctatgagtttnacatctgctttacctcagtgcagaagagagccgattcggaccctcttggacaagttgctaagatgcccatttgat

SEQ ID NO: 658152 - DNA, 160 bp, Homo sapiens
tttgttttggagaacagagtcttgctctgttaccaggctggagtgcaggggttaaatcttgcctcacggcagcgtccaattccagaagttcaagcgatcctctagcctcagccaccaagcagctgggactacaggcatgtgccaacacacccaggaaggg

SEQ ID NO: 658153 - DNA, 331 bp, Homo sapiens
  misc_feature (3)..(3): n is a, c, g, or t
  misc_feature (65)..(65): n is a, c, g, or t
  misc_feature (330)..(330): n is a, c, g, or t
cgncgcacacacatgcacgtacgcgcgtatgtacagtcatgcacgcacgcacgcgcacacgcacncatgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgng

SEQ ID NO: 658154 - DNA, 314 bp, Homo sapiens
cttggtaattatttcattcctttgttatggctgaataatatccactgtatggatttaccagatttgctttattcattctaatgttctctctcagggttcactaagggttttttgtgtgtgtgtggcttttttttttttttttttttttggaaagggggttcttttttttccccccggttgggggccgggggggtaattttaatttaatgaaacccccccccccggggttccccccttttttttttttaggcccccaaggggggggggcccaaggggccccaaaacccccccgggtttttttttttgtttttttg

SEQ ID NO: 658155 - DNA, 360 bp, Homo sapiens
  misc_feature (134)..(134): n is a, c, g, or t
acaatccgttatgattactcattatcgctttgacagctggctgtacacagtagatgctgaaacttgatatcacacatcagtatgtattctatctctcttacatttggtctctatactacataattaatgggttngtgtactgtacagaattagctgtatcaactagtgcatgaatagattctctcctgattatatatcacatagtcccttagccagttgtatattattcttgtggtttgagacccaaattagtcctactttacatattgcttaagaatcgatgggggatgcttcactgtgaacgtgggcgttcaagctgcttctcttgcctaagtatacctttccagatcactatgcatt

SEQ ID NO: 658156 - DNA, 188 bp, Homo sapiens
ggtcagacacagacatggaacatgagggcagacagcatgactgatgatactcctttgctgaagattaacacagagcttaacaaaactgaagcacgaaactgtagagatggacattagaatcggcatcgtggaacacacactactccaatcaaagttgaaggagaagtccaacatgactagagtgggga

SEQ ID NO: 658157 - DNA, 679 bp, Homo sapiens
  misc_feature (465)..(465): n is a, c, g, or t
ggccaccatggctggctggtttttaaacttttgtagagacagggtctccctatgtgcctggactagtctcaaactcctaggttcaagtgatcctcctgcctcagcctcccaaagtgtgggattacacgcatgagctgctatgcctggccctctttttcttgcttaaagcaggggtccccaacccccgggccacagactcatactggtctgttaggaactgggccacacagcaggaggtgagcagtaggagagcgagcaaagttcatttgtatttacagccactcctcatcactcacattactgactaaggtcccccttctgtcagatcagtggaggcattagattgccatagtagcatgaaccctattgtgaactgtgcatgcaagagttctaggttgtgcattccttatgagaatctaatgctgatgatctgtcagtgtctcccatcaccccagatgggactgnctatttgtgaggaaatcaagctcagggctcccactgattctacaaaataatgagttgtataataatttaatttatatattctaatgtaacaataatagaaataaagtgcacaatacatgtaatgtgttgagtcaagcagataagtctttcctataaaaactatccaaatatgtggaagatgtgagttcactaggatgctagaaatcacttaggg

SEQ ID NO: 658158 - DNA, 272 bp, Homo sapiens
atacggcaggccataaattatggagtgtatcgtagggacgggcttccagtcctctcggaggatgtggaggcagacgtggccctcgaggtcaaggtgggggtgatagaccatggtctcacacttcacctgggggggatcatgcgggtaacccgggcccaccttaaaactgaacataaacttcccactctggtagaagccctcatcaggacagatgaccagcttgaagtggaggaggtcgtcgggatctgagaagctgatatcacaggggtacc

SEQ ID NO: 658159 - DNA, 877 bp, Homo sapiens
  misc_feature (309)..(309): n is a, c, g, or t
gatgggactgacgccaagtgttcgcaagatggttgtctctgttacccaggctggattgcaaggtcgcaatcttgatccctgctggttactgacttccggagattcaggctcttctcccgattcgagccttcgtagagtagctgtgggatgtaccggggtcgcatgtcatcactgcctaggttggtatggctgtatgtttgggtgagatgccgtgatatcccgcggatgttaggaccattgtgctggtttgctgtgcagacgtctttgtagtctcatggtgattctgtccaggctcgaggacaatccganagaagtcggtgggtgcattcccaagggacgtagaagcacaacatagcgtcggtgtggccttagtattgtgtctggcattggagaccccttgaaggtacggacgcaattcccttaacagtgtctatcacacgtgagctaattcttcatcattcattctcattcatccgtagttcacatccattcggcatcttgggaggagtgaagcgaagcgatggggtcgtccaacgttattagtttggtcccaagtgactcgccacttttgaaaacatcgcatattgggctcgaaagactaaatactttcttttaaacgtgcaagccttatcttgaaaattagcctgggttgatataaccggcggtagtgcaacctaccttctaacacctgttcggcgtcactactggcaactacgttaaacggaaggccctaaaattatgtaaaatctatcttctcgaagcacgggacagtcctcattatgtctgagtgagacctgcacgaggtcacctgaggtgcagaacattctatacgtacaaaggccattggaaaaataaaaggcatgtgttgacctttggg

SEQ ID NO: 658160 - DNA, 187 bp, Homo sapiens
tgttattataggtgctggggacttcaatggtgaacaaagtagataaatgtttttctcccttgaagtttattttggaagatggaggtcatgtggtcctagccagtcagctactttgggaggctgaagcaggaggatcccttgagccccagaagtttgaggctgcagtgagctatgatacatggccact

SEQ ID NO: 658161 - DNA, 162 bp, Homo sapiens
atgcccccattgcttgtggtgtcaggttgtcaaaggatcagatggttgtagacgtatggattatttctgaggcctctgttctgttccattggtctatatctctgttgtggtaccagtaccatgctgttttggttactgtagccttgtattatagtccaaagg

SEQ ID NO: 658162 - DNA, 302 bp, Homo sapiens
gcccccccccccccccccccctgttctttgaaattgggggggggggggaggcccccctttggggggtcctccccccccccgggtggggccccccgttccggggggtcttcccggttttttgcgccaccaggcccacggcttttattttttttttttttggcttccctgggcccgccgggaccaaaaaattttttttttgggtttttcccccttgggcccttttaaagccccttgggtttgtcctttgtgggggggggggggagaattgggttgaataccccccgggcggggaggccatttta

SEQ ID NO: 658163 - DNA, 1254 bp, Homo sapiens
attgccccttttgctcgttatgcccgggtttgtccgagtcttcggtccgttgtggtggtatctattttggtgggatgtctgtttccctcgtgctttggtcggccctacctcttgggcgagcggccctcgtaatccgtggcgcacggcagtcgcgactgtgaccccttgcgtggggtaaccggtgatcgtcgtggcgtggctcgtctctttttgttgcccttggcttatcagcttactttcttttggctctcctcggtaaatgcgtttgttactgtggggttctcattgttcccgtctcgtcgcctgttcgtccgcagttctcttgtctccttccgttcggttcgtggtcacacttggtgtctgtgcccttcttgttgccgtcaggttgccctatcttccctgttcgtcccctgtggggtcacggtcccgtgggcaggatgcgacacgtgtcgacccctggagtatgagtccatctcccgaccttaccaccagtttattggaccttttgaggccctctgaagtcactcgatagacctgcgtgctcccaaagcgtgggtccgttgacgtctcacgtattaatctcttagaacgcactctcttgttttgcacttcagtgatcagtcaggttgggagcctgaactgaccatgacgcttcctcacagcaatatgcagtcgccccagtcgtactcttacccatgggtaggaggaatgccttctgccagcctcccgtcctgagccctgctggtacattcttacactgacccctgcctcatcttgtctacttcacctgctcctttgacccctggactgtggtataccctccatcgtcggagttcccttgggccgacgaggtgttctcctgtgctgtcgaattcagtcgagggagctgtatgcggcggtgggggtctacggttcctccccccttgggccgagggccccttccccttggtgctctgtccccatccacctcctttgcagctgctcctgggcctcagctctgcccagggccagccacggttctgctagggaagggaagggaatcggggagaagggagaagcaagcagtgtgctgagcctcaggagcttccccctctcccctttgcctatcccctccctctctgcttgagaccttgagcgtccacctgggagctgaaaggagttcgcagctgttggcatgagacctccttctccccgtcttggggaggtggggaccagcagataaatcccataaccccggagcgtcgctagatcgtt

SEQ ID NO: 658164 - DNA, 145 bp, Homo sapiens
tactattgatacgggagtgctgggaagggaagagctggtctctttaaaagatagggaagcagggaagggaagtgctgggtagaggagggcgtggaccctggctaaaggccccacccccacagacttaagtgaatggcccgcattt

SEQ ID NO: 658165 - DNA, 215 bp, Homo sapiens
tgcccggtagacgtaggactcagtagcttgagtaccatcgctggattattggaacgacgacacttgagcctcagtagacgttaccagatgccaaaagtacacatctaattgtgagttcctgcccgagctctaaagctatgtagctgcaaacatacgatatctctacttgggcgtcttactatgatctcacactcagaaacaccgtagtagctaga

SEQ ID NO: 658166 - DNA, 584 bp, Homo sapiens
tgcccaggccagactgttgaggaacgacctgcgatgactacaacctgcgcctcctgggttcatgcaaacgaccttcctaaacctgccaagactctaggcgcacacgtgggtgcgccaccatgcccagatattttttgtacttggagttaagacgcgttgtcaccttgctggccaggctgatatgaaactgcggtgctcaagtgatccgaacacccgtgcctccagaagtgctctgctgactgacatgagccacggcgcctggccccttcttcaaaagttatgctaggcgggcatatgaagtagagccggtgctttttcttattcaacatacacgaagccctctgtttgcacgaactttaccgaaaatgcatcgcagatggcccactcaggtgagtaacacggatgtcttcattgtgacttaccttcttcagacatgtgattgatgggatcttccttagcattgaaaacatatcgacactgcgtgacctaggggggagcatcttgcggatttttggacctacgaatgttgcattctctagcataaacaattggaccccttttgcagccctatggaatcattccgg

SEQ ID NO: 658167 - DNA, 109 bp, Homo sapiens
atattagccctgagggagcggtacttctcagggctaatatatacgtactctggcctcttctgcgtggtggtcaacccctataaacacctgcccatctactcggagaaga

SEQ ID NO: 658168 - DNA, 354 bp, Homo sapiens
ctggatcttctcctttactgaaattgatatcagaaatgttgttcagttacttatagatttgacaagaacaagtagattaaatcctcaggccaagaattcctaagattatcaggccttaacagcacatgacaatttggctatgaaaatttgcaatgagatcttaagaagtccatgctcaccagaaattcgggtctctataaaagccttgagttctacttttacactgttggtgggactgtaaactagttcaaccattgtggaagtcagtgtggcgattcctcagggatctagaactagaaataccatttgacccagccatcccattactgggtatatacccaaaggattataaat

SEQ ID NO: 658169 - DNA, 120 bp, Homo sapiens
tcgatacgactttttttttctttctttctttctttctttctttctttctttctttctttctttctttctttcttccttccttccttcctttcctttctttctctctctctctttgtcttt

SEQ ID NO: 658170 - DNA, 477 bp, Homo sapiens
gataagttgccttaagtccacatgggttttggctccttggcaacaatggctgttttttaaaattagtttaggcccaacattgaagaggaggaaacccaaaattttgttaaccaaaccattgcaactggcattttcaacgaccttggctccggaaacaacctttacctttgggttatcaacaaaaaccaagtggattttttccggccaaacccagtgccccacaaaaaaggggccagggttggccgggacaggtgttaaaaaagggcttctgcagtcctcccttaaaaaatccctcctttggaaatttagggggtggaaaaaacagttccaaccatggacccttccttaaaggcatcaatgggtggctggccccggttttggaaagtggttagcatttaggcccagtaaaaccctcatgtgggtagtgtttgccgaattaaactccactccattaaaaaccaaaacccaattgggaaa

SEQ ID NO: 658171 - DNA, 493 bp, Homo sapiens
gacgcctttttttgggggggcaggatcggtggctaacatctgcaatcccagcactttgagaagctgaggtgggaggagtgcttgaggccaggagttcagaccagcctgggcaacatagggagaccccatctttactaaaaacacaaaaaattgccaggcgtggtggtgggcacctgtaatcctagctacttgggaggctgaggcaggagaatggcttcaacctgggaggcagagcttgcagtgagccgagatcgcgccactgcactccagcgtgggtgacagagcaagactccgtctcaaaaaatacgacaagaaaaaagaagtatattttcacctgaatcctttggataattctttgtttctaccatgagttgtctgagaacacactatttcaaggtactgtgtttaacaaggaccgaagagatttacaagttgagtcctttctcctaaagagcctactgtccaaaacaaagggcggccgctgggtacccga

SEQ ID NO: 658172 - DNA, 454 bp, Homo sapiens
  misc_feature (88)..(88): n is a, c, g, or t
gggcaaaaaaaaatttttgtttcctccgggtattttccaaaaaagggaccccattgtgtcttaacgaaaggggatagtttaagtcaanaaggtcaccccgagaggtgctgcccacaaaagtgattctgaagaatggttctttttaagataatgactttccaatagatcaatgtttcatgttacttgccccaaaaaactttaattaggttgaaactgggaacgtttgtttctcatattagctacttctctattaggagcacaagaaccatagttaaatgcaacatgagctactttagtcctgtttgtttaaatttgtgttgtccatgtattatgatttattaacttgttgatgcatgtaaattgggtgcattttgttgccatgtatgttaaatggtgaccaatgtttttacaaaggaattgaacaaaaaaagtattttttaagaaaaaaaaaaaa

SEQ ID NO: 658173 - DNA, 1177 bp, Homo sapiens
caagacgagcctgggcaacatagcgagaacttgtctctacaaaaaaaaaaaaaaaggccaggcattggtggcgtggcgccttgtagtctcctagtttacctcaggaggctgaggcaggaattactttgaccccaggagtttagacgccttgcagttgagctaatgaccacaccaccacacttacagccctgggtgacagagcaagacccttgccgctaattaaattaagggaacattctttcttatttaaacggggtgcccttttaaattgaccagacttttagaagattgatcccattcccagaagaatttctcaaattaagattattccattattaattgtgctgaacagggcaatttgcgagcactattaagggaaatatctcctatattttatgggaacactggtgtcatcttgcgcaacattgtggtgcgcacatttcggcgaatttttcaccaccaaaaaaaactccccacaatatgggccaccacttttccaaagaggttccccaatgtttggtgtattctcctcactaaaaaacaccttttcaccacattctggtgcggcatccctaaatgcttttttataacctctatatttatatttcacatcttttgggtccccctggaagaaatcgtgcgcgggtctgtttctcaaaaacaccaccaattattccctgggaaaatacacgcgggatgcgtccttaatattttttgtatatcccccaagacactttattttttcccaagactgggcccttaaaattttacaatttacagccagggcccacctctttgggggggtttttctcccccactttttacgcttagcggagtttgtgggcgcccccctataggttccaacccttttacaaacgggtttttttctcccaagagtcgttgtaatcccctcttcttcaacaccgtgaaaatttctaaccctcgggtcatataaaatcttttgagagcaatgtggacacctcttccagcaagaaacttttcccaaagggcttttccccccataaagtttgtgttaggacacacataaattgttgtcccaaggggcgcccaatattttacagggcccaccctccaggagagaaaggggccccgcggtctcttttaagggccacaaaaaacatttttctgacgcggaaacgaaaaaaaaaccccattg

SEQ ID NO: 658174 - DNA, 97 bp, Homo sapiens
  misc_feature (14)..(14): n is a, c, g, or t
ctaccctctccccnttttgtgcctagagttgctctgtgaaggggcagctctggccgcagtgccctcctgaggggaagagggcaggcctgtggggggc

SEQ ID NO: 658175 - DNA, 230 bp, Homo sapiens
gtagcatcagttggaacagatattgtgtgacatcagccaccttaccaaccaaattaattgacagcatgtatacttcgcatactctggtaccaccagagctcagggcccttggaaagtcaggtgcagaaaggtgccatcatcattcatgctgcccatacgcctgcagagatagtgtacctgcttactgtttagctacactcacatccctaccacaaatactagtgacccaa

SEQ ID NO: 658176 - DNA, 202 bp, Homo sapiens
gcaggtcgacatctagagactcccctctccgctcatccgaacaggctcaggcaaaggcagtcctcccacctcggcctccagagatagctagggtctacatggaacatgccaccacaaccggttaaattgtatagccaggatttcaccatatatgtccagtggtggtctcacaattcccgagactcaagatgatactgcccac

SEQ ID NO: 658177 - DNA, 226 bp, Homo sapiens
atagacttacgttaaataatgtgttcatattggttcattcattgtaacaaatgtatcatactaatgtaagatgttaataatagggaaactgggtacaaattatatgtgaactctgtactatcttctcaatttttctgtgaatccaaaactattctaaaaataaagtctattaataaaagtattaggcaaagtatttcagagaacatttatccatagaaaatatctg

SEQ ID NO: 658178 - DNA, 627 bp, Homo sapiens
  misc_feature (566)..(566): n is a, c, g, or t
  misc_feature (581)..(582): n is a, c, g, or t
  misc_feature (603)..(603): n is a, c, g, or t
  misc_feature (615)..(615): n is a, c, g, or t
ctttcccaaagaagcgccctacctttatttccgccacttatttatccaacattaattcctccaataaacccttgttttgcccaattctccccttcttcatatcccaacaaaatgccatactcaaccaccttgttggtgaataaaccatatgtccctcctgcattctctaataacaaattcatttcccataagtatctgtcccaagctcagggtatacccctccaaacaattaaccaaaatattctcattaaccttgtaaatcaaaatccacaaataacaaagaaccaacttaaggctgtcattccagatttctcaggcctgttgaaaaaattctgccaatgccaccaacattaactctactttcctcaaaacacacaaaaactgatttcaaaaactcgtactactttcggacttaaattacttcaccggaaaacaacccaaaacaactctttcattctgtctgccttttctctttaattttaactcatttaaccctttttttaaccccaccccttaaaacacttaattcattttccataccaaaataacttttcaattttcccagnccgtttccaaccagnnccgtccagtcatcactcaacncccgccgccggnatccagaacccc

SEQ ID NO: 658179 - DNA, 265 bp, Homo sapiens
atcccggccctgtacatttcagcagcgcaaaagctcgataacaactgctggacgccaggcagcacaatgccacgatgggaccgtggatggaagacggtccatctcatgtgaggggtccggagcccctcatgctgtacatgtcatgtgtatctctgctcttctccagaaggcaacaacacagcttgccacttcttggaatgttctatctcctgctgggtctggtctccacaagctcagtgtcctgagtttggtccttgccataccg

SEQ ID NO: 658180 - DNA, 174 bp, Homo sapiens
ttttattttattttatttttaaattaaggtcgggagcctggctattttgcttttgggattgggaatgttgggtgggtgtttggtccattttaaggtttttaccaacaggtgtgtgtgtgtgtgtgtaaaggttatgcacccaaaatcccttttggccagaggggccccccccca

SEQ ID NO: 658181 - DNA, 309 bp, Homo sapiens
ccaccccttttttttcccccgggggggccggttttgggggtttaaaaaaaaacgccgtccttttccccggggttgggcccccccggggtttttgggggaagggcccccccccgaggtttaccccccggggggtggggggttttttttttttttttttttttggccccccatttcccccaattttttttgggcttttaaaaaccccggggggggggggatttttggcgggtttttgcccccccttttccccccctttttttggcgggggcccattttttttggggttttttaccccggggccctttttta

SEQ ID NO: 658182 - DNA, 798 bp, Homo sapiens
cagttcagctggctttccatttgacacacaggaagtgtccaactatacacaacgaacggaacgaaactgcttgaaccaaaactttagaaactgccatgttaacagagcactctgctgacggttcgttgcattctggagcagatcaggtgtaaactagtgaactagtgaagaggatcttgaatttcttaatgcatccaaagccttctggcaaaccattgccgaaatctaaaaaaacttgtagcaaaggcagtaaaacaggaacggaacagttctggaatggcaaggcaaggctaagcgaaccaaatgtcctgacaattctgtcagatgaactctagctagtgcatgaagatgaaacagcacaaaacaaggcaagagtcttcagatgatgacagataacagaaagtgacagacggagccaccaaccaaaagacagtccaaaacgagcaaaaacctaaaaccagaaagctactatctacaaagtacacacatcctgtgaacaagtgcccaatgttcactccacagcagcattagccagccaccacccaaagaagcaatcaacaaccaggtacccacaacaaaggacacgtgacgtctgagcgcactacgtcccagactgaatcgaaaaccttccacatcaccccaaccgccgaacgaaaaaccccccatatcacgaacgcaacgcacgtcaacacacgaaccaaccaccaccaagaaacacccacctggcccaacgtgccctacctcggccaaagaacccccacaacggcaaaccagaaccaggccaacacacggccctag

SEQ ID NO: 658183 - DNA, 350 bp, Homo sapiens
atgttcctttattaaaaaaaaaattataggggggggtttctcccttctcttcatcctgtgggcaatatcccagttattttcaggttttgccatgcccccacccctctaaaaagataatattattccctttattattttcccggctctccctctccccttgtgattaaggcccaaggctgtggaccccctggggccccactgcccagattgcagccaccggccctgggtcccttcctttatatacctttatattaacccttcccaagccggacttctctttatatactcctattttttctggttttttttggttttttggtttttttttttttttgggatggggtctccga

SEQ ID NO: 658184 - DNA, 143 bp, Homo sapiens
gcgcgcgcagctccctcacgtcgcgttcgtgggccgcgtcgaggcctcggcgctgcctgcagccggcccagcagccctcgagggcggcgcgcccagcgcctcctagactcggctgcgcacccagctcgcgtccaggcggccgc

SEQ ID NO: 658185 - DNA, 858 bp, Homo sapiens
aagccggcccttggcttatggcggtggcggagctgctgtctgagcagcggttgcggaccgatgcgaacttggcccaggacgcccgggcctagggatgaggcgcggcggcggcgggagcgcgaacggctggagctggccttcttcgccttctcctcggctgtggagccctggtggggggtctgcgcccggtctaccatgactagcgccggcagaatgcccagaatgccagcaacaacgtgggaactgagtctgtatgagctgcaccggaccccgcaggaagccataatggatggcaacgagagattgcgtgtttcgcccctcggacacatgcagttcaagaactctatgtgccctatctgcctggacatgcgtgaagaatacgatgacacacacaaggagtgcctccacagattctgcttctgagcgtgcaattgtcacatgccctacggagcgggaacatagggagtgtcctactctggccgaaagaagctggtgtccaagcgatcccctacggaccatgagccccaagcatttgtagttgccctgtatctctaaagagtctatccgtagccggggaggaataccgaagggccctatcaatgaccgagtgcttaattcctgcctgatgcctgctgtcgcaaaccatgcgagggcattgaggctccagtcattgaggatggggcctccgcttgctggccatgcacagggtccagcgtgtgaggcggccgataccagggtcagatcagaccacagatgatgagtggggggtgaaggagagccgcgggagggagcaacgggatggcccaagaatgtgagctccagatccgccctggtctgcccgggcctgtcccggcgacc

SEQ ID NO: 658186 - DNA, 611 bp, Homo sapiens
cactctaagatcccctgagctcgatcctggaaccgcctgtcgtcactgctgatcacggcatggttgacatccccgacgaccaccgcgtcatggtggaggacgagggtggactgctcgctgacgttgccttgttggctggtgagcctcggttccgccacatttacactcgtcgtcccgatgaggtcgcgcaacgatggcgacgcgtactcggggatcgtgctcaggttgtcattggcgacgatgctgttgcggctgacctgtttggaccagttgacgtgtctacccgttcccgtttcggtgacgtactagcgattactcgtggtgattgggccatcatgagccgcgctacccccaaggaactcaccctcgtgggcatgcacggatcgctcactccgtgtgaaatgcggatcccattgctggcccagatctgtgaaggatgaggatggctgagcttgttttccacaccggtccgatggactctggcaagtccaccctcgcactgcagatggaccatgcgcagtccgctcacgaccgccaaggggtgcgatacacgatgcacgaccgctctggtggagatcggatcacctcgcggattggtttgagtgtcgaag

SEQ ID NO: 658187 - DNA, 369 bp, Homo sapiens
  misc_feature (26)..(26): n is a, c, g, or t
  misc_feature (56)..(56): n is a, c, g, or t
gaaagaccccaagtctcgcctctgtnaacccccaggctggaagtgcaagtggcccnaatctcggcccgctgcaacctccaacctccctgggctcaagcgatcctgaaactgcctcagcctctctagtagctgggactgcaggcatgcaccaccacacccagctaattttgtgtgtgtgtgtgtgtgtgtgtgtgtgtgtgtgtgtgtgtgtgtgtgtgtatttttggtagaggtggggtttcaccatgttggcagggctggtctcgaactcctatcttcaggtgaactgcctgccttggcctccgaagtgctggggttacagctgtgagccaccattcccagccaacaatgacttttgaagatgcttgc

SEQ ID NO: 658188 - DNA, 159 bp, Homo sapiens
ggatttacgggagtagtccaagaagcacatattagtgaccaaagatagcatcaactgtatttgaaggaactgtagtattgcgcattttatgacatttttataaagtactgtaactactttcatttgagggtgctatgttgatggggacagactaactca

SEQ ID NO: 658189 - DNA, 127 bp, Homo sapiens
cgctatgcggctgctttcctactgtgtactgtagcatcttcacagtggttacagcttcttttggattagagggggatttgatgggagaaagctggagatctgaacccagccatttgcacactataag

SEQ ID NO: 658190 - DNA, 988 bp, Homo sapiens
gtatggttagtggcatgctaggcctcaggtgtttctgctgagtgtggcaggcggatctcgatggtagatacctgcgatgatacacgtttttttttctctgtgaagtataaaaacttaatacaatttagttatccaatatatggcgagatagggttacataggataattgattagtcgttaacgttgtttaaatgtcattaatataatatggctgtagagattgtaatgagcacacttatgaagaggttaagaagaggttgcaattgatggaagtgaaaagggatataaggttgctaatacttgacgtgtgttatagatgtgatgttttttcattggtcgtgacattaatgtatttatatgcaaaagtggaatgtatggactaatcgtagccctcgtaatttaactgccatataccatatgctccaatgcgttaagaattactatgtctgagtgacttaaaacgatggctttagaggtttagtttaatagtcgtaggtgataaaatatgaactttgaaaggcgatcttttataacagagattataatcgcacgtgaattagaaagacctttgagaatccattggacgccaggtaggattagcttcattatggcctatgttaacgcgatctactaagtgtcacacgataaatgtacatcttagttgggcagcggtatgaggtccctattgggagccagataagatgtgtggtgggtaactggaagactgaagtatgggatgcgagataagatagagagctagggaaatcgcagatctaccactatagaggcaaggcgttattttgactgaaagtggactcctcataaagacagctcggcacaagctcatgcaacttcattttaagacatggcatgaaaccgcacagaatttacggtcggttaatgccccctcacgttgcataacgacacaacttcccgcgcgaaaaacaatgggccaaaacactctgcgaatgtccaagccaacgtggat

SEQ ID NO: 658191 - DNA, 867 bp, Homo sapiens
  misc_feature (767)..(767): n is a, c, g, or t
  misc_feature (867)..(867): n is a, c, g, or t
ggaaaagacattcgcccgcgtccgcacgcgctgcttgcaaaggggtggggttgtggagtggatgcttggcaagatggcgggagcggcgtccgccaaagtattctaccgccagcaccttcgtgaagcccattttcagtcgggacatgaacgaggcaagcggagggtgccgcgagctctaccgcgcctgtatcgggaggtaccgaacacttgtgcaccatttccagtcgtgacatcactgtgaaacatgggacgggataaagtccgagaaatgtttatgagagaatgcccatgtcacagaccccagggtgttgatctcctgtcataagggaaagatcgaatgaaagaaacacttacggtatggaacgcagcggacacatgttatgcggttcttccatgaaacagaagcgccagggccaaaggatttcctatccaagttctatgtggcgccacgatccatgaagtcattcagtggaaagatgcacgtgatactatttaagagcacaaataatcactatacaatcaaaaaaaaaacaaaaaaaaaaaaaattgggcggcgcggcggggccaagaaaaagtttcaagaccatcggttggggggcggggaccgagggtttgtggaacgtggcccacacggtgccaaggaacacgcggcagacacagtgcgtggttttcccccacaaaagccgggggaacgcggttgcgaaccatcccgaggttggagcaagggtcaacagggccaggcgctatccccccgcgcgggtgagacnacacacaaacaaaagaagacgcacgacgaatgagaaaaacaagcgaaagacacaagaagaacacgaaaagagaacgacgaaacaagaacgctacaaatan

SEQ ID NO: 658192 - DNA, 2313 bp, Homo sapiens
  misc_feature (2)..(2): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataa

SEQ ID NO: 658193 - DNA, 2335 bp, Homo sapiens
ttccatgtttctaccatggatgtgttcaggtgccttgcatctatctagacattctgtatttatttgaaatatctaaaggctttccaagtatatcttgattaaaaatcttaatttactctttttctttgtagcccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataa

SEQ ID NO: 658194 - DNA, 2144 bp, Homo sapiens
gctggtctagaggtatccctcccatatgagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataa

SEQ ID NO: 658195 - DNA, 2363 bp, Homo sapiens
  misc_feature (2)..(2): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatagttgcagttttgtgaagcaaaataaatattcagttttaaaaaaaaaaa

SEQ ID NO: 658196 - DNA, 2368 bp, Homo sapiens
  misc_feature (2)..(2): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataatattgtcagttttttgaagccaaataataaataataaaaaaaaaaataataaata

SEQ ID NO: 658197 - DNA, 952 bp, Homo sapiens
cccgtcacactccagagcggatgtgaggggcgccgatggcggagggaacggcggaggctcctctagtaagaatggtggtggtggcgactcgggagccggagctttggaacgaggagtggcgcccattaatgcgtcaatacctcaccaccaagggagcagtttcaccaattcctggaagccaaagggcaggagaagacttgccgggaaaccgaggtaggagaccctgctggcaatgagctggcgtgagcctgaggctaagcggatccgactggaggatggacagacggcggacgggcaggacggaggaggcagcagagcccggggagcagctacagactcagaagagggcccggggacaagacaagggccggccccatgtgaagcccacgaactaggacaaagaacaggctgtgtccctccctaatccaggagctcggcgttgtctaaggtgtttcttcgggtgatcggctgccgctttctgcacgacgttggggcgctacctggagaccaagccggcgaacgtgggcgccccgcgtgcgtgctcttcgagaccttcgtgccggtgcccctacgggtgacctggcgtttcgctggggcccagcctgtagggcccgttgggacgagcaacctggtgcaggaggagttggcgggcccgcgggaccagcccccgtccaattccgcaagtggctggacctgaagccctgcagcgatgcagctgcggaaaccggcgaggtccgttcgagcgagctgcgcagggcctgtgccgggttcagccagggtcccacacccggctgcctgctgtccccggggggcacggcaggcgaggcggtccaggccgacacttgtgtgccacgaggtccgcagggcgggggatacgcctccagcgcccgtggcggcttgtggcctgtaggttacgcttttcggttcgcccttaaaaaacgtgggccctgca

SEQ ID NO: 658198 - DNA, 742 bp, Homo sapiens
  misc_feature (20)..(20): n is a, c, g, or t
cctcggcaatatcggacagngaagacattctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataa

SEQ ID NO: 658199 - DNA, 195 bp, Homo sapiens
gtaaaaagtaaaaatagatgctggtgaggttgcagagaaaagagaatgcatatacattgttgattggaatgtaaattagtttggccattgttgaagcagtataccaatttctcaaagagcttaaaacagaagtgccatttgacccagcaatcccattactgggatattttcaaaagaaatccaatcattctacca

SEQ ID NO: 658200 - DNA, 2306 bp, Homo sapiens
  misc_feature (2)..(2): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactaccaatacccttcccccactataatgccctcatcaaaaccaaggactatcggtcattcaaaccacgtggggtcgtggtgctggtgttatgtgcatccaactacaatttatttttggc

SEQ ID NO: 658201 - DNA, 205 bp, Homo sapiens
gggatatttacacagtggcttctaagtatcttggcttcgtctctactaaaaatacgaaactagccaggtgtgatggtgcgtgcctgtggtcctagctgctcgggaggctgaggcgggagaatggcttgagcccaggaggggaggctgcagtgagccaggatggtgccactgcactcccccctgggtgacggagcaagaatctctc

SEQ ID NO: 658202 - DNA, 2321 bp, Homo sapiens
  misc_feature (2)..(2): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagtactatcaatcaatcatactactttggattgttgtgctggtgtaatgtggatttaacatcaataaatatttgacaaataatagttgcagttttgtgaagcaaaataaatattcagttttaaaaaaaaaaa

SEQ ID NO: 658203 - DNA, 328 bp, Homo sapiens
  misc_feature (18)..(18): n is a, c, g, or t
  misc_feature (24)..(24): n is a, c, g, or t
  misc_feature (214)..(214): n is a, c, g, or t
  misc_feature (223)..(223): n is a, c, g, or t
  misc_feature (225)..(225): n is a, c, g, or t
  misc_feature (236)..(236): n is a, c, g, or t
gaagccatgctgtccgcntcccgnagtcgcacagccatcacctcctccttgctcttgcaactcgcctcggcctgcttgcggcgctttcgctgagtgcgtctgcagccccttgttctgtgcagccaggtactgcagcttctcctgcaggccgcgcgtcgcctccacgcggttcagaaggttgcggtggatgtggtcctgcgtctcaagttccacncacgcgctngnagctcgcgccntgccaggcctgggcctgcgcagacgcacgctcatcagctcgtcctgcagctcgcccacgaccagcttccgtggggactccttccagcggccc

SEQ ID NO: 658204 - DNA, 389 bp, Homo sapiens
  misc_feature (10)..(10): n is a, c, g, or t
  misc_feature (57)..(57): n is a, c, g, or t
  misc_feature (71)..(71): n is a, c, g, or t
  misc_feature (105)..(105): n is a, c, g, or t
  misc_feature (143)..(143): n is a, c, g, or t
  misc_feature (312)..(313): n is a, c, g, or t
  misc_feature (334)..(335): n is a, c, g, or t
gggccctggnaatctaaaacccgtgtcaacctaactaacttggactgggatccaccnaactaatgtccccnaaaaaagccgtgaagtcaaggcctgggttggcancctgggtcactggaggaccaacccctgctgtccaaaanaccactgcttcctaccccaggtgcgactgccccccaaaccttccctgccccgtcctgagtgccccttcctgtcctaagccccctgctctcttctgagccccttcccctgcctgaggacccttccccatcctgagcccccttccctgtcctaagcctgacgcctgtcgannctccggccctcccctcccagnnagctggtggtgggcgctaatcctcctgagtgctggacctcattaaagtgcatga

SEQ ID NO: 658205 - DNA, 2343 bp, Homo sapiens
  misc_feature (2)..(2): n is a, c, g, or t
  misc_feature (2098)..(2098): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccataccacatgttcttcttacaantggagaaccccttattatctcctttagtgtcgttagggacactataatgacttatgtcttacttggcaaatttttctgaatgtgacctttttttgctgatttgctgggtttgggattaactagcattattttgccacctttatattgtatttataaaaaaaaaagtactatcaatcaatcatactactttggattgttgtgctggtgtaatgtggatttaacatcaataaatatttgacaaataa

SEQ ID NO: 658206 - DNA, 2130 bp, Homo sapiens
  misc_feature (2)..(2): n is a, c, g, or t
tnttccagaagcgagatgctgttccaaagcggagatgctgggtggtatactgtgtcagccaagaatgaagcagggattgtgtcctgtactgccaggctggacgtttacacccagtggcatcagcagtcacagagcaccaagccaaaaaaagtacggccctcagccagtcgctatgcagcactttcggaccagggactagacatcaaagcagcgttccaacctgaggccaacccatctcacctgacactgaatactgccttggtagaaagtgaggacctgtaatccagcattcttgttaaagctgaaacactgaaacagccattgccttgaccaacatattcctttgtcacattatgtaaaaggcagaaacatacctttgactataagaaattaaaaaaaaacaccaaaataatatttttcttacttgatataccaaacttagtttaagtagataatgctaatacaaatatacacattgcacagaaaatacacatttactgtccaatttaaaactttggaattgctgtgattaaagtgatcaaaatgccaaaatactaaaggaaatcaattgttcacaggtaactacaatttgtattatctacaagtgcctttaaacacaagatataggtgctgtgtagcctgatagtgtgaaatgtttaatgagggagttgtaccacaaacagtactacaatgattctgaagcacagtgtattcagacagatacagtgaaccaagtgcaatatgtaaggatgaaagaagaagagatgacaaagaaatccaagtaaatgccttgtctttgcaaatgtttttatattaaatcataaggaaggaactacttgccttaaatgttaatatcaaaagagttttctaacaaggttaataccttagttcttaacattttttttctttatgtgtagtgttttcatgctaccttggtaggaaacttatttacaaaccatattaaaaggctaatttaaatataaataatataaagtgctctgaataaagcagaaatatattacagttcattccacagaaagcatccaaaccacccaaatgaccaaggcatatatagtatttggaggaatcaggggtttggaaggagtagggaggagaatgaaggaaaatgcaaccagcatgattatagtgtgttcatttagataaaagtagaaggcacaggagaggtagcaaaggccaggcttttctttggttttcttcaaacataggtgaaaaaaacactgccattcacaagtcaaggaacccagggccagctggaagtgtggagcacacatgctgtggagcacacatgctgtggagattgcagtgtgtctgaggtttgtgtagtagtggaagattttaggtatgtagagcaagttgaaaatggattgagactgcatggtggcataaatgagaaattgcctgtagcatctagtctacttgaaggaagtggagacataaggagagacaaaaacaggtttgtgccataaagtattttttcaaagacaccaagatgtggtaaatgaaaattattagttcacttccctgctgccatgaaactttgccttaagaaggtgctggattccaaggtttgtaaaggcatctcggtaaagactgctttttgaatgcatatgattttgcatcagctagactgagttgattctgaccagacttgatggttttaagtcggaaccgataaattttaaaaaggagaaaaaataatttgacctagtagtataaaacatgaggctttaatggtactttgctatgaaaagaaaacactgtattccttatgcaaaacacatgtatctttcattatttataagtggcctctcttagctcagttactcaattcatacgtagtattttttaaaataattttatatctgtgtaccaccccatatatttcatattactgtttcacatgtacagctttctacttctttgtaagaacaccaaccaaccaaggtttaagtgattaataggcttgagcaccgggtggcagatgttgcattattttgccacctttatattgtatttataaaaaaaaaagtactatcaatcaatcatactactttggattgttgtgctggtgtaatgtggatttaacatcaataaatatttgacaaataa

SEQ ID NO: 658207 - DNA, 611 bp, Homo sapiens
  misc_feature (111)..(111): n is a, c, g, or t
  misc_feature (172)..(172): n is a, c, g, or t
  misc_feature (252)..(252): n is a, c, g, or t
  misc_feature (288)..(289): n is a, c, g, or t
  misc_feature (326)..(326): n is a, c, g, or t
  misc_feature (378)..(378): n is a, c, g, or t
  misc_feature (573)..(573): n is a, c, g, or t
gggaactaaaaaaaagtgtgtaactttgaagcctttttatggatcaacatgaagatgaggggatctcaaacagaaagggcatcctggtggcaaaggttaatcattaccagnctgcaagagtagtttcaatggcaagaaagcagcaacagaatcaatgaaaacaaagcaatgnttagaatgccctttccccttctcctcctgacttgtagacactgattgtcttccttggacttagggaaccccttaggttcntgaaaaattcaatgatcaggctatagtagatggtcnncagtacacagcacaagatttttgataaactgacattntgaacccaaataactaattagaaaaatcaaacatgtgaaactactttatccnatgcataggggttatactggaaataaaatgtacaacattggaattctgaaggagaaaagtcctaaaagtttcaatatcaagaatcctgcacctgctgctacttatctagccttttgcttgatttctggctgatgaacttgcacaactcttgaaaacttaaaaacttgaaaatttgtcacttcaaaactacttttnccaaactatgaaatctcacctgatatataagatgccgg

SEQ ID NO: 658208 - DNA, 327 bp, Homo sapiens
  misc_feature (23)..(23): n is a, c, g, or t
ggaggtggagtcctgagcttgtngctcaggctggagtgcagtggcgcgacctcggctcaccgcaacctccacctcccgggttcaagcaactctcctgcctcagcctccagagcagctgggatcacaggcacccgccaccatgccgggccaatttttgtactttaagtaaagacggatttcgccatgttggccaggctggtctcgaactccgacctcaggcgatccgcccgcctcagtctcccaaagtgctgggattacaggcacgagccaccatgtcccgcctggtttgttttttaaaaaatctctggccttggagtcttaagcccc

SEQ ID NO: 658209 - DNA, 126 bp, Homo sapiens
  misc_feature (26)..(26): n is a, c, g, or t
  misc_feature (33)..(33): n is a, c, g, or t
atcgaactgaactgccagactctgtntcctcangccaatgatttgactcacagtctttcctcatacctaaaagaaatttgtcctaagtgggtaaaacttaggaagaaccacagtgagaaagaaatc

SEQ ID NO: 658210 - DNA, 347 bp, Homo sapiens
  misc_feature (172)..(172): n is a, c, g, or t
attgagatgaggtcttgctatgttgcccaggctggtcttgaactcctaggctcaaacagtcctttcacttcagcctcccaaagtgctgggacatgatggatcctcagtaagtgctggcagatactgaccacaggaaagaagtttgggggttggagggtggaggggttcctanacaaatcactactgtggtgtaaagaaatccaagaacttgaggactatttcacaaattgcatggttgtgctcctatcagaggcatccttctggtgtaatggcagacaatttaacacctctgaagattaagggtgcccaggagtgaacactatgtaagatacacaaagggaagagac

SEQ ID NO: 658211 - DNA, 230 bp, Homo sapiens
tgtctgcctctgggctgaccccataagccaccagttagccaagtagatggagcttggagcaggccgtggcacacatcacaaagctcgctgaggcctctgcctctgctgcctataaggcatacttcgcagagtgccttggcccagaggacagggaccagcctgcacaccaagcaaggtgacaaatagctggctgtggccatcggctccatcatcaatgccctttctgggga

SEQ ID NO: 658212 - DNA, 335 bp, Homo sapiens
gacgttgtgtttttgagacagagtcgtggtgttcacccgggctggagtgcagtggtgtgatcgtggctcactgcaacctccacttcccaggttcaagcaattttcctgcctcagtctcccaagtagctgggattacaggcgcccactgctacgtttggctaattgtttgtatttttagtagagacggggttttaccatgttggccaggctggtctcaaactcccgacctcaggtgatccacgcacctcggcctcccaaagtgctgggattacagacgtgagccactgcgcccagccaccatcttggctttgtttatttcataaatgtcgacgcgg

SEQ ID NO: 658213 - DNA, 1364 bp, Homo sapiens
tggaaaaagtcttgggggccagggggttgggcttgaaaccagcttgggggggttgcgattccttccttttttgggtctagaattttagtgtttagcgggttcttcgaagtggtggtggtaggggtgggggggcattccatttagttcacctcgcgagggttaagtgggaggaggtctcttctataccatattagagcgaaccttttcgcgccttcgaaaggcgagagaggcttctcaaattcagtgaaaacatttattataaatattaagcgggcgtgtttagaagaaaatggtgcatagtagaccccctacaagaggatggtatagagggtatgtgtttcacagtgtggggtgtgtatatgcgcgtatcgcggggataaagtccgggagagtaaacggcgggggggctatcccgggtatgaggcgccggagaaacatgttgtttggtggggcgaacacacaaacgtgttcacatatttttccccgcgcgcgtattcgcatattcatgagataaagtgggcaaatggggatatctagggggcgtgtcaagggttcaggggccccaaaagggggtgagttacgccttggcacacaatagcggggggagacaactcaaagtagagcaactgagaaacccctcacactaatgagatgcgcggcaccaaataaacccgggctccactaaaatggggaaaagagagcacataaaagcggggaacacccgggggccaaaacaaaacggtaaaacacacctgtgggtaccgcgtaggacaccgccaaaccgaagcgctcccaacagtgagaaaccgaacagtaccgcgcgggaaaaaatacacaaaaatggcgcccaactgcacacagcggaccacccaaaaaccaggggatacaacaaatcgagacaaccacactgaggaaacatcccccaaacaggaacggacacacgacaaagaaacgttgggccagagaaaacactccaaatcacccaaacatatgggagaccccccgaggagaaagtcagctggcagaaagcaacacgaccataacaaatcactcttgggaaccaatcccgacagaggacaaaaatcgcgaggacggaacaaacacaggagaaaccacgggacgaatgaaaaacaaatccagcgcgagtgaatgacaacaacgagatactatcacccccaaaacgaggacacacacaatcatgcacgaagagaccccacacgagcaaacaacaccccaaggagatgacgaccacaaggaatacaaccacatgcgaagacacaacacacagaagtaataaacccagccaagagtacccaatcaacacggagaaaggaaaaaatagaacaacagagaagcacatacga

SEQ ID NO: 658214 - DNA, 111 bp, Homo sapiens
gacgtagcccaactgttgccagacggctaggtggaagccagtcagaaactgaagtcagacagaaacaacaactccagctgatgcaatctaaatacaagcaaaagctaaaaa

SEQ ID NO: 658215 - DNA, 158 bp, Homo sapiens
agtattcacgagtggaatcgagatagattaaagatctgaatgcaaagatggtacaaactacattaggctgggcgcagtggctcacacctgtgatcctagcattgtgggaggccaaggctctgtaaaaaaaaggtttctacattagtgttccgggctag

SEQ ID NO: 658216 - DNA, 333 bp, Homo sapiens
gtcagctagtggctgtactaccatgggagaagctatgaaatgacgacagaatagaatgggcctgtgaggctggaaggagatactttccttggtccaagaaccatttgccttgtgtgggaagagattgataggtggaagtttcagtgggggagtaggtgggagtgaccagataagaaggagaaaagctgctgtgagggatagaagttggaatgctagctgcttttttagctaccttatcagcataagcatagccctgaatgatgggatctgatgccttttgatggtgcttgcagtgaatgactccagcttcctttggaagtataaagcgttgag

SEQ ID NO: 658217 - DNA, 512 bp, Homo sapiens
gagacccttgactgtgactggcaggcaggtgagggcacagcacccctccccagcatctgccagctcagcacagaagacaccgaatgtgcatctggaggtgttgcggcagaggtttgagtgaaccctctgtcaaagacaatacatccccccaccttccacctcctcactcgcgacacgaatgagcacctacccctcttcctgaaccatattttaattgctgcctttattgtcccaaatttaccacttaaagaattctattttcatttctgtcctgtttgccacttcatttcatttccttgagtaaatgagctgaagtgtaaagcaaagaatagcagaagcagcttggtaggatggaaggcacgcagctgcatggcctggctccttccctgagtggccttgttgccttgggcgtgtgttcagcacctcccatcccatggatacagtggagattccatacaggccttacttagctccttgcgatactgtgagccagagagaaagtacaagcactt

SEQ ID NO: 658218 - DNA, 343 bp, Homo sapiens
agaacagttattaaagatatatttaatatattccagatttcttagttttgctcagcaggatggttggactgaagggggctggtttacttcttcagtggaagtgttcatttttgcaaatactagttactggaatacttgtgagtctgtagatttttcttttatagaaaatgtgttcaatctatatgtccttaagataaacaatttctgttagggcaaatgatattaccaaggagtgcatcatttgtatcattatacttaatttatttcaagttaaatatctgtaacttcagtacatttatcattgatctcagttatcatttaaataaataatagaaatcatatt

SEQ ID NO: 658219 - DNA, 421 bp, Homo sapiens
cgcctatgtaatacttttcctaaatttctaacctttaagttatttaaagcctatgtgtactgtgtatgcatgcactaaagtatgtatgtatgtatgtttctaattgaagtggaaagatggttagttaaaagtgtaattctaggatgggcgtggtggcttgtgtttataatcccagcattttggaagacccaagtgggaggattacttgagcccaggagttcgagaccatcctgggcagcataaggagactccatctctacaaaaaattaaaaatagcaaggtatggtggtgctctgtggtggcagctattctggaggctgaggcaggaagatcacttgagcctgggaggttgaggctgcagtgagccatgatcacgccactgcagcctgggggtcagaatgagactcagtcttaaaaaaaa

SEQ ID NO: 658220 - DNA, 621 bp, Homo sapiens
gcccgagaactgtactggtgaaaaggatgacagaccccgagaactgtgctggtgaaaaggacagaccccgacaactgtactgctgaacgaggaggacagaggcccgagaactgtgctggtgaagaggaccgatcccgacggactggtgtgtggctgatgaggaggggaggcctggataactgatagatggctggatggaggaagagaggaacggaggaagcaggtgagtagaatggtagacagaggcacaaagccccgatcatagaggcaagtgactgagggagtagtaccacgacaaccgtactaagtggacaaagggttgaaggagaggagaagagacttcgagcccagatagaatagacctcgagtcgagaaggccctagactttggagcaccattacactcacccacatctaaggttgaacacgggccaggaaaacctaggtcacgctcacagcaacgtacgtttgctagccctgacgagggcgaacaagaactcccctataggaaaagaggctcactcactagagaaccacaccgatagtagcaccctaccttagcccccaccttgcgatcgcccttgttgaccccgtgagacaaagctccgacacatccaacacg

SEQ ID NO: 658221 - DNA, 375 bp, Homo sapiens
aagtgattgctgagggagaacaagtcaagagagtgcagtcttcacatgttatatatacatcaggggcagcaagtgcagggtctatctgatctggatggacttttaacagatcagcagggaggagacttttgaagaggaaatccatcttgatacaaagccagatggtgagacagaacatggggaccgggaactcgcaggtgaatgtgttggacattggggactgggaaaaacagtaacaaagtcagggtgtgtaagacccacctcagtgcctgccacatggcaaatcattaccatcattgttgttatttccattgtgaaaacgtggttcagaattttatctaaataaacttggctcttctagctgaaagaaaaaaa

SEQ ID NO: 658222 - DNA, 401 bp, Homo sapiens
  misc_feature (262)..(262): n is a, c, g, or t
  misc_feature (387)..(387): n is a, c, g, or t
ggggttccatggacatacgatgggagagcactgccagcagcggacgtgggtacttggaagattttaaacgctgccccctccatctcaccaccttacaaactctcacatgtcctgtgaagatggggggaccctctccaccatcaccacttggctgaaggtggtccagacttgaacgccaaggattccaggccgcatagcctcgggcaggactaatggacttcaaaaacacaggctcagcaaaatccacttcacaacccagatngtccacatcacaccctctttcagggacccagagcagccactggaagagaaggagtaggaacgctctcttaaagtccacttatcctattccttcacattaagaccaaagtccaatgtatttaggtnaaaaataatttctt

SEQ ID NO: 658223 - DNA, 115 bp, Homo sapiens
tgaccggttcgcatgtgtccacccagcattacatgttcttgactgtatttctccacttactggtttacagtggttttagtcactggataagtattataatagagctacttagctg

SEQ ID NO: 658224 - DNA, 2557 bp, Homo sapiens
tgtcggtccggaatcttaggatggagctggtccctgcgctccctgcgccctggggatgcccctgccgccctgacgcccgccagcctgagccaccggcgcatgtgaccgcgcgtccgccccagtcccatccgtagcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcgtggggagtttgtggtggccatcggcagtcccttcgccctacagaacacagtgacaacgggcatcgtcagcactgcccagcgggagggcagggagctgggcctccgggactccgacatggactacataccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagactggaagaagcgcttcatcggcatacggatgcggacgatcacaccaagcctggtggatgagctgaaggccagcaacccggacttcccagaggtcagcagtggaatttatgtgcaagaggttgcgccgaattcaccttctcagagaggcggcatccaagatggtgacatcatcgtcaaggtcaacgggcgtcctctagtggactcgagtgagctgcaggaggccgtgctgaccgagtctcctctcctactggaggtgcggcgggggaacgacgacctcctcttcagcatcgcacctgaggtggtcatgtgaggggcgcattcctccagcgccaagcgtcagagcctgcagacaacggagggcagcgccccccgagatcaggacgaaggaccaccgtcggtcctcagcagggcggcagcctcctcctggctgtccggggcagagcggaggctgggcttggccaggggcccgaatttccgcctggggagtgttggatccacatcccggtgccggggagggaagcccaacatccccttgtacagatgatcctgaaagtcacttccaagttctccggatattcacaaaactgccttccatggaggtcccctcctctcctagcttcccgcctctgcccctgtgaacacccatctgcagtatcccctgctcctgcccctcctactgcaggtctgggctgccaagcttcttcccccctgacaaacgcccacctgacctgaggccccagcttccctctgccctaggacttaccaagctgtagggccagggctgctgcctgccagcctggggtccctggaggacaggtcacatctgatccctttggggtgcgggggtggggtccagcccagagcaggcactgagtgaatgccccctggctgcggagctgagccccgccctgccatgaggttttcctccccaggcaggcaggaggccgcggggagcacgtggaaagttggctgctgcctggggaagcttctcctccccaaggcggccatggggcagcctgcagaggacagtggacgtggagctgcggggtgtgaggactgagccggcttccccttcccacgcagctctgggatgcagcagccgctcgcatggaagtgccgcccagaggcatgcaggctgctgggcaccaccccctcatccagggaacgagtgtgtctcaaggggcatttgtgagctttgctgtaaatggattcccagtgttgcttgtactgtatgtttctctactgtatggaaaataaagtttacaagcacaaaaaaaaaa

SEQ ID NO: 658225 - DNA, 2123 bp, Homo sapiens
  misc_feature (2103)..(2104): n is a, c, g, or t
  misc_feature (2107)..(2107): n is a, c, g, or t
tgtcggtccggaatcttaggatggagctggtccctgcgctccctgcgccctggggatgcccctgccgccctgacgcccgccagcctgagccaccggcgcatgtgaccgcgcgtccgccccagtcccatccgtagcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcgtggggagtttgtggtggccatcggcagtcccttcgccctacagaacacagtgacaacgggcatcgtcagcactgcccagcgggagggcagggagctgggcctccgggactccgacatggactacataccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagccccctcactggcagttcattgagagcagggggcttcctcacgtttccccctcctccatgaccccgtcagccaagcacatggaccccagtgcagccaaggctggtgccatgagggctggtcacatgaagagctgctgttgaggatgccgccattgttcttctgtgtccattatgggaagacaatctggagccaggcagagcctgtctttcccaaagaagctgaagtcttcttctcttgaacagtggggaccatctaatctcttgagcccttttcctgttggcttctaggaagctcagagctagattcaggggtgcacccagacctgtcctagcatgctcctttccctaatgaccgagtctttcctgttgaattatcccattctccatgggtgcctttgactttggcctccttactggaaattagcggagctgctgtttgcacacactgagctgtgaggtggctttccttggaagtggatgatagtgtcctcttcccttcttgcctctctctttctcctgagacaggatccccctggggcctaggtttgctcctttgttgtacaggggctgtcccagttagtgctgacctcatcccagaaccccctgggaaatatcccctgtcctcagagctgtgtcccctccccaaggacagtgcagactaactgaggagcctgataaaccttagctgcatggcacacttgcaattttaaaatccttctgaagttgactggtgtttgtacttgcttctcttttttatttaataaaatccaatgatccaaacccagttaatctaaagttctttgaaatgaaccatctttttattaaannaangagatgttaaaaaaaa

SEQ ID NO: 658226 - DNA, 236 bp, Homo sapiens
ctttggtggtaatcgtgccgaaaggggtctgttccttcttgaagctgcctggcgggattggtctccttttaaagcaggttgtgtgcagcatacagtacactgaaggtaagctaaaccatcaacatctctggtgttttaagatgttattttattgaaacaactgaaccaaatgagggatgttagctttgtggcagaattccctgcatgtgtgataactgatcttgtattattttttg

SEQ ID NO: 658227 - DNA, 1371 bp, Homo sapiens
  misc_feature (1351)..(1352): n is a, c, g, or t
  misc_feature (1355)..(1355): n is a, c, g, or t
tgtcggtccggaatcttaggatggagctggtccctgcgctccctgcgccctggggatgcccctgccgccctgacgcccgccagcctgagccaccggcgcatgtgaccgcgcgtccgccccagtcccatccgtagcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcgtggggagtttgtggtggccatcggcagtcccttcgcctcccttcttgcctctctctttctcctgagacaggatccccctggggcctaggtttgctcctttgttgtacaggggctgtcccagttagtgctgacctcatcccagaaccccctgggaaatatcccctgtcctcagagctgtgtcccctccccaaggacagtgcagactaactgaggagcctgataaaccttagctgcatggcacacttgcaattttaaaatccttctgaagttgactggtgtttgtacttgcttctcttttttatttaataaaatccaatgatccaaacccagttaatctaaagttctttgaaatgaaccatctttttattaaannaangagatgttaaaaaaaa

SEQ ID NO: 658228 - DNA, 3396 bp, Homo sapiens
tgtcggtccggaatcttaggatggagctggtccctgcgctccctgcgccctggggatgcccctgccgccctgacgcccgccagcctgagccaccggcgcatgtgaccgcgcgtccgccccagtcccatccgtagcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcgtggggagtttgtggtggccatcggcagtcccttcgccctacagaacacagtgacaacgggcatcgtcagcactgcccagcgggagggcagggagctgggcctccgggactccgacatggactacataccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagactggaagaagcgcttcatcggcatacggatgcggacgatcacaccaagcctggtggatgagctgaaggccagcaacccggacttcccagaggtcagcagtggaatttatgtgcaagaggttgcgccgaattcaccttctcagagaggcggcatccaagatggtgacatcatcgtcaaggtcaacgggcgtcctctagtggactcgagtgagctgcaggaggccgtgctgaccgagtctcctctcctactggaggtgcggcgggggaacgacgacctcctcttcagcatcgcacctgaggtggtcatgtgaggggcgcattcctccagcgccaagcgtcagagcctgcagacaacggagggcagcgccccccgagatcaggacgaaggaccaccgtcggtcctcagcagggcggcagcctcctcctggctgtccggggcagagcggaggctgggcttggccaggggcccgaatttccgcctggggagtgttggatccacatcccggtgccggggagggaagcccaacatccccttgtacagatgatcctgaaagtcacttccaagttctccggatattcacaaaactgccttccatggaggtcccctcctctcctagcttcccgcctctgcccctgtgaacacccatctgcagtatcccctgctcctgcccctcctactgcaggtctgggctgccaagcttcttcccccctgacaaacgcccacctgacctgaggccccagcttccctctgccctaggacttaccaagctgtagggccagggctgctgcctgccagcctggggtccctggaggacaggtcacatctgatccctttggggtgcgggggtggggtccagcccagagcaggcactgagtgaatgccccctggctgcggagctgagccccgccctgccatgaggttttcctccccaggcaggcaggaggccgcggggagcacgtggaaagttggctgctgcctggggaagcttctcctccccaaggcggccatggggcagcctgcagaggacagtggacgtggagctgcggggtgtgaggactgagccggcttccccttcccacgcagctctgggatgcagcagccgctcgcatggaagtgccgcccagaggcatgcaggctgctgggcaccaccccctcatccagggaacgagtgtgtctcaaggggcatttgtgagctttgctgtaaatggattcccagtgttgcttgtactgtatgtttctctactgtatggaaaataaagtttacaagcacaaaaaaaaaaaaaaaaaaaaaaaaaaaaaaaaaaaaaaaaaaaaaaaaaaaaaaaaaaaaaaaaaaggggggggggggcgccaagaaaaatcccccggagggggcgcgccaaacgaaatagggcgaccccaggatttttagaggacaagggggcgcgccacaaagggggagcagcagtataaaagcgagaaggacgggggcgcgggtaaaaaaacgggggcaggggggaacaaccaggagaaccgggggacacctctgggaggagaaaccccatacacgggggggggggcaccatggggggccaaaacccccagagggaaattaacagcccaagggggaaaataacacacccgacgggcacatggggggtccacccccacacggcctcagtgagcggtcgggagaaaaaaattgcgaccacggcgacacgtatcatatccagacaaacattttcagccccgagtcctcgatacacaccgcgagacacaagaagaaccaccaagaaaaacaaaagccaaggagtaggggaggaggcgaggagacacacacaggagagagcaacaggcgaacggggagcaggagggcaaaagcaagaaccaaagagggaaaaaccaaacagccaaggcgcacacaaacccacacagacatcgcaggacggggaaaaaaaaaaacaacggaggagcgacggatcaagcaaagacagacaaactgaacagacagaaagaagcaacacatgaggacagaagagacagaaagaagaaaaggtcaagggagggacagcgaagaagagagagcgaggacaaaacagggaaaaaaagaagagagagaagaaagaacaaaaaccgtctt

SEQ ID NO: 658229 - DNA, 659 bp, Homo sapiens
tctagcgtagccgtctgtgtggccaggtgggggacctgcggtcggagtgggagggccagtctgcacccaagaggtggaagacggacgggctttaggctggaagcgccttagaggagccatttttccagcaggatgcctggtttgcttttatgtgaaccgacagagctttacaacatcctgaatcaggccacaaaactctccagattaacagaccccaactatctctgtttattggactgtccgttccaaatggcgagctatgacgaacagccatgtgatacactgccccttcgcacgctgaacgacagacaacacacataactgaactactcttctacccgggacgctctgtggaccctggagctgtgctgaacgctactgccgctggctgtactgataacaacacgcagcaccctggagactcctccttaaaagatcgatgatgactgacttcacgactctgcatggtgcatggccaagatcttgctgcctcaagcagcacaatctcgcagtatcggccacggatccctgcaacccgactcaacccaacagacaccagctcttacatccatcaaaagggccgacacatcgaaccgccttctcaacacaacgtacccactttctccacaacccacaacacatctggatgcctcaccaag

SEQ ID NO: 658230 - DNA, 2689 bp, Homo sapiens
tgtcggtccggaatcttaggatggagctggtccctgcgctccctgcgccctggggatgcccctgccgccctgacgcccgccagcctgagccaccggcgcatgtgaccgcgcgtccgccccagtcccatccgtagcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcgtggggagtttgtggtggccatcggcagtcccttcgccctacagaacacagtgacaacgggcatcgtcagcactgcccagcgggagggcagggagctgggcctccgggactccgacatggactacataccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagactggaagaagcgcttcatcggcatacggatgcggacgatcacaccaagcctggtggatgagctgaaggccagcaacccggacttcccagaggtcagcagtggaatttatgtgcaagaggttgcgccgaattcaccttctcagagaggcggcatccaagatggtgacatcatcgtcaaggtcaacgggcgtcctctagtggactcgagtgagctgcaggaggccgtgctgaccgagtctcctctcctactggaggtgcggcgggggaacgacgacctcctcttcagcatcgcacctgaggtggtcatgtgaggggcgcattcctccagcgccaagcgtcagagcctgcagacaacggagggcagcgccccccgagatcaggacgaaggaccaccgtcggtcctcagcagggcggcagcctcctcctggctgtccggggcagagcggaggctgggcttggccaggggcccgaatttccgcctggggagtgttggatccacatcccggtgccggggagggaagcccaacatccccttgtacagatgatcctgaaagtcacttccaagttctccggatattcacaaaactgccttccatggaggtcccctcctctcctagcttcccgcctctgcccctgtgaacacccatctgcagtatcccctgctcctgcccctcctactgcaggtctgggctgccaagcttcttcccccctgacaaacgcccacctgacctgaggccccagcttccctctgccctaggacttaccaagctgtagggccagggctgctgcctgccagcctggggtccctggaggacaggtcacatctgatccctttggggtgcgggggtggggtccagcccagagcaggcactgagtgaatgccccctggctgcggagctgagccccgccctgccatgaggttttcctccccaggcaggcaggaggccgcggggagcacgtggaaagttggctgctgcctggggaagcttctcctccccaaggcggccatggggcagcctgcagaggacagtggacgtggagctgcggggtgtgaggactgagccggcttccccttcccacgcagctctgggatgcagcagccgctcgcatggaagtgccgcccagaggcatgcaggctgctgggcaccaccccctcatccagggaacgagtgtgtctcaaggggcatttgtgagctttgctgtaaatggattcccagtgttgcttgtactgtatgtttctctactgtatggaaaataaagtttacaagcacaaaaaaaaaagaagatttaactattgctgtttgtgtgagtgtctggtaccctacaaaatcttgctatgattgtatagattaagcggggaggaccttacacacttgacgactgggacttcctgggggagcccgagccccttag

SEQ ID NO: 658231 - DNA, 2490 bp, Homo sapiens
tgtcggtccggaatcttaggatggagctggtccctgcgctccctgcgccctggggatgcccctgccgccctgacgcccgccagcctgagccaccggcgcatgtgaccgcgcgtccgccccagtcccatccgtagcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcgtggggagtttgtggtggccatcggcagtcccttcgccctacagaacacagtgacaacgggcatcgtcagcactgcccagcgggagggcagggagctgggcctccgggactccgacatggactacataccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagactggaagaagcgcttcatcggcatacggatgcggacgatcacaccaagcctggtggatgagctgaaggccagcaacccggacttcccagaggtcagcagtggaatttatgtgcaagaggttgcgccgaattcaccttctcagagaggcggcatccaagatggtgacatcatcgtcaaggtcaacgggcgtcctctagtggactcgagtgagctgcaggaggccgtgctgaccgagtctcctctcctactggaggtgcggcgggggaacgacgacctcctcttcagcatcgcacctgaggtggtcatgtgaggggcgcattcctccagcgccaagcgtcagagcctgcagacaacggagggcagcgccccccgagatcaggacgaaggaccaccgtcggtcctcagcagggcggcagcctcctcctggctgtccggggcagagcggaggctgggcttggccaggggcccgaatttccgcctggggagtgttggatccacatcccggtgccggggagggaagcccaacatccccttgtacagatgatcctgaaagtcacttccaagttctccggatattcacaaaactgccttccatggaggtcccctcctctcctagcttcccgcctctgcccctgtgaacacccatctgcagtatcccctgctcctgcccctcctactgcaggtctgggctgccaagcttcttcccccctgacaaacgcccacctgacctgaggccccagcttccctctgccctaggacttaccaagctgtagggccagggctgctgcctgccagcctggggtccctggaggacaggtcacatctgatccctttggggtgcgggggtggggtccagcccagagcaggcactgagtgaatgccccctggctgcggagctgagccccgccctgccatgaggttttcctccccaaggcggccatggggcagcctgcagaggacagtggacgtggagctgcggggtgtgaggactgagccggcttccccttcccacgcagctctgggatgcagcagccgctcgcatggaagtgccgcccagaggcatgcaggctgctgggcaccaccccctcatccagggaacgagtgtgtctcaaggggcatttgtgagctttgctgtaaatggattcccagtgttgcttgtactgtatgtttctctactgtatggaaaataaagtttacaagcacaaaaaaaaaa

SEQ ID NO: 658232 - DNA, 2124 bp, Homo sapiens
  misc_feature (2104)..(2105): n is a, c, g, or t
  misc_feature (2108)..(2108): n is a, c, g, or t
tgtcggtccggaatcttaggatggagctggtccctgcgctccctgcgccctggggatgcccctgccgccctgacgcccgccagcctgagccaccggcgcatgtgaccgcgcgtccgccccagtcccatccgtagcgcccggcgcccggccccgcagcggcctcgttgtccccgccggcccccgcccggtctcccgcgctgccacccgccgccggccctgccgccatgcaggcgcgagcgctgctcctggccgcgttggccgcgctggcgctggcccgggagccccctgcggcgccgtgtcccgcgcgctgcgacgtgtcgcggtgtcccagcccccgctgccccggcggctacgtgcccgacctctgcaactgctgcctggtgtgcgccgccagcgagggcgagccctgtggcggccctctggactcgccttgcggcgagagcctggagtgcgtgcgcggcctatgccgctgccgctggtcgcacgccgtgtgtggcaccgacgggcacacctatgccaacgtgtgcgcgctgcaggcggccagccgccgcgcgctgcagctctccgggacgcccgtgcgccagctgcagaagggcgcctgcccgttgggtctccaccagctgagcagcccgcgctacaagttcaacttcattgctgacgtggtggagaagatcgcaccagccgtggtccacatagagctcttcctgagacacccgctgtttggccgcaacgtgcccctgtccagcggttctggcttcatcatgtcagaggccggcctgatcatcaccaatgcccacgtggtgtccagcaacagtgctgccccgggcaggcagcagctcaaggtgcagctacagaatggggactcctatgaggccaccatcaaagacatcgacaagaagtcggacattgccaccatcaagatccatcccaagaaaaagctccctgtgttgttgctgggtcactcggccgacctgcggcgtggggagtttgtggtggccatcggcagtcccttcgccctacagaacacagtgacaacgggcatcgtcagcactgcccagcgggagggcagggagctgggcctccgggactccgacatggactacataccagacggatgccatcatcaactacgggaactccgggggaccactggtgaacctggatggcgaggtcattggcatcaacacgctcaaggtcacggctggcatctcctttgccatcccctcagaccgcatcacacggttcctcacagagttccaagacaagcagatcaaagccccctcactggcagttcattgagagcagggggcttcctcacgtttccccctcctccatgaccccgtcagccaagcacatggaccccagtgcagccaaggctggtgccatgagggctggtcacatgaagagctgctgttgaggatgccgccattgttcttctgtgtccattatgggaagacaatctggagccaggcagagcctgtctttcccaaagaagctgaagtcttcttctcttgaacagtggggaccatctaatctcttgagcccttttcctgttggcttctaggaagctcagagctagattcaggggtgcacccagacctgtcctagcatgctcctttccctaatgaccgagtctttcctgttgaattatcccattctccatgggtgcctttgactttggcctccttactggaaattagcggagctgctgtttgcacacactgagctgtgaggtggctttccttggaagtggatgatagtgtcctcttcttttctttcttttgtgggggggagggggggagggggggggtggggcctaggtttgctcctttgttgtacaggggctgtcccagttagtgctgacctcatcccagaaccccctgggaaatatcccctgtcctcagagctgtgtcccctccccaaggacagtgcagactaactgaggagcctgataaaccttagctgcatggcacacttgcaattttaaaatccttctgaagttgactggtgtttgtacttgcttctcttttttatttaataaaatccaatgatccaaacccagttaatctaaagttctttgaaatgaaccatctttttattaaannaangagatgttaaaaaaaa

SEQ ID NO: 658233 - DNA, 725 bp, Homo sapiens
gctcctatttattctagccacctctgagcctagccgtttactcaagtcctctgatcagggtgagcatcaaactcgaaactacgcccttgatcggcgcaactggcgagcagtagccgccaaaaaatctcatatgaagtcaccctagccatcatcctagtatcaacatataactaataacgtggtcctttaaacctctccagccttatcacgacagaagaacaacctctgattactgctgtcatcatgagcgcgtaggccataatatgattcatcttccacactagcagagaccaaccgagcccccttcgaccttgccgaaggggagtccgaactagtctcaggcttcaccatcgaatacgccgcaggccccgttctgctcctatgcttcatagccgaatacactaaacattgattataataaactggccctcaccattacaaatcttcctagtgaacaatcatgtgacagcatgtctcccctgaaaatctagcatcaacactatattgtcaggcaaaggaggcctacgtgtgcgtaaccgtccctgttctctatgaattcgaagcaggagtataccccgatgtccgcataccgatgcaagtcatagagctcctatgaaaaaacttcctaccgaggtcaccctagtgagttactgtgatatgacatgtctccatacccggttacaatctccaggattgccccctgcaactagtgtaaacaaaaggaa

SEQ ID NO: 658234 - DNA, 308 bp, Homo sapiens
  misc_feature (156)..(156): n is a, c, g, or t
ccgaggtgtgtggtgtgactgtactggggtgggacgtgctgatgcgggagcaagaggtacacgacgcgggtctgacagcacagccaggcagcgtgactcggaagcgaaggtggtcgatggaggtgagcgcagtatcatttcagcatttcatctttncactcagtcactctcttcaaaagaaagaactagagcaaaccaaagttaaatatctcaacgagaagggacacctcacgtcgctgacagctcggcacgtggctggtcccagggcccagagatactgcgtagtgaactgggcgctggaacgcagt

SEQ ID NO: 658235 - DNA, 381 bp, Homo sapiens
ggcatggtagtgtgtgcctgtagtcccagctacttgggaggccaaggcaggagaattgtttgaatctgggaggcagaggttgcagggagccaagatcatgccactgcactccagcctgggtgacagagtgagactccatctctcccagctacttaggaggccaaggcaggagaattgtttgaacctgggaggcagaggttgcagcgagccaagatcgtgccactgcactccaacctgggtgacatagtgagactgtctcaaaaaaagaaaaagaaaagcaatagttgtgttgtgggattcaggagactggagagaccaatgggtgagacaggagaatttcattggtggccactggctcagtggattctccggctgagcccc

SEQ ID NO: 658236 - DNA, 414 bp, Homo sapiens
ttgaggatcccaagtctaggaaagaggggaggccccggcctctccggtatcattcctatgacacaggctcatccatcaggtttgatggcgggattaagtgtgctcccggcggcctgtctcctgcacggcgagctccgacggaagtcccagatacactctcacacgctactaaatgtctaggtttgcccgctgtgtcctgctctcaagtaggctaactgatagtgccaccatgcagagtgcgttggagctgaggatggagccgcccccagccgactccaagcccgcagagggcagacgccaccctggactgctctccctgcccagctgggcctctctggcctattcctgccttccaggcccactgcactcctgtctgggaggcccttatgagggcagcccagcccccgcacccaa

SEQ ID NO: 658237 - DNA, 217 bp, Homo sapiens
cggcccagagcccagacccaaaaggagtgtcaaaaagtccaactaaaaaaatcctttcaaaaagggatgggccgggggccagttccctttggactcaaagtgtccagtgtctcaaagggtaaatgtgtccaaggaatgacgggcagtttttgactatttccctcccctgacctctgccccttttacataaagcaggttggagtttttctcctttcca

SEQ ID NO: 658238 - DNA, 1439 bp, Homo sapiens
gtagaacaagcaaagagaaccagacatacaatagagaaaccaaacaagaagacacagaggacaagaagacagtaagaaacccagaagagactaccaccagagaaaaccaaagatacacacaatacgatagacatacacatactatacgcaatagacgcacgaactagccatactagagacccgatacgctatgggcgtaactcctgaatctacttatgagctcagaatttgactcgtaagttgctccgtttgcgctgcggcgtgcacgagacataggtacatataccgaggcataatagcagggacgaaatcacaactacactatacaccagacgcacgggataagcctatatagaagacctatacttacatataccagaagagtactagcagtatatagccattaccgctaggtaccgtagtatactacgcctacgcagagggggtacctatacacgcgcaaagactctagtagagagagaagcctagaggtactaagtatactagaagctagaatattaccctatatatactaccaggtatactaactagctaggggatagaaagacaagtttagggacactacgagtagggagaaccaagctagccagcgtagggtatatacacctaggtagtaacaaccaaggcagcaagtaaccacacaataacaatagcactactaacaaaggaggagacctagcaaagcctagggaaacttaagggcactacgtatggggccaagcacggatagacggcagcaaaaggggtactagaggcaccaggggtagggccctagtactagctatggtagtagctaccatagcacaagaacatagccccaacgcccaatagcgcagcccagcgggcttttataaggcagcaggcgaccacgtagactatcccagaagtctcccatcccgtacagttgcagcgcgtgactaggggcgctaggcgggcattaggggatagaagggatctataacgcaggctaccccccagggtatccggcgacaaattctaaacccccatcctaagagacttagggcagggcccttcttactaacgccacgcaagcgcatagaggaaatgggcagacgaaccaccgtatgatggattgacgacctaaacgcgacacagcacactgtccccaactatattactacatctatagcccctcactgggctaaattgaggcacactgggaagccacgggctggcttgcgaaacaaaattcacctggtaacacagcaacgagcacaatatacttgagcaaattagttgggcctgggaacccacataatatgacaagcgctagtagaaacaagtgagaacagtggaccacattggtccaccagctagactagtgtagtggccataagggcacacatgcatgcccactatttcattatacccatatacatgacagcatgttatgcaac

SEQ ID NO: 658239 - DNA, 361 bp, Homo sapiens
  misc_feature (283)..(283): n is a, c, g, or t
gagattgtggcactgcactccagcctggccaacaaagcgggattctgtttcaaaaaaaaaaaaacaaaaaaaaccacacttagagtagtatacgggtgtcattgagtattaggtaattgttagaagaaacagccaaaggattggatgagggcttgggggaagcagaattcaagagggggtgtccccataattttccttgataagttgggaagtactgtgggacatcttaaagtatgtgcatgcatcactttgataaactttagttgaaagggcgtatcagtgnccaccaaaaacagacaagtagggtggatcggtgaaaggatcttcaggaaagcacattttagacaatttcccagtatcg

SEQ ID NO: 658240 - DNA, 329 bp, Homo sapiens
tctagaggatcccggtcgacggtaccaacacaggagcacccagatttataaaggcaagttcttaaaagacctaggaagagacttagataaggacacaataatagggagagaattcaaggctcggatgaggtatcatacataaaggccgagcatataaatttaaatctttaaggaacagactatataatccaaagtcatgatcataggggccatctacgtgatctttccgcgcataagtagaggcattcatctcaagaggcatctgttctatcttcccattcatgacgttcggcatttccatgtgccaaatcaacagactgtcacctccg

SEQ ID NO: 658241 - DNA, 909 bp, Homo sapiens
aataatagtgtaggagatttctatagctagaagtgtggatatgttttgtctctgttgcgtgttgtggtgggtgagttagttttttcagtgtgtggcattgtacgtatatcaattggacgctcccgtttcgggtcccgccggagtgttttcacaccaaagcggttctccccacctgtaggcccgccccagttttttgtgcgagaccctcccgaaacttttgttcgcacaaaataaggggttctgctgctcggctcccgaaatttccgggggctttcgcccttcgccccggggccctcttttcatgtgcttgccgccaaacagggtgtcccaaacaaagttctcgcgaggcgcctttctcactcggggtgttcccattgggaacggacggcctcccccctgggggtgagaaagtgttcaaattccgcccgttgtatggccgccattttcccgcctcgggcccaggagggcgcgcctattccctgtctccccaagcacggggtgtatctccgtaggcgattttcaaccacgggctgccacaaataacaagttttgtggcaggagcaccaatcaagttgaagcaagtttcctattcctcataggcttcgtccttgatttttcccgaaatgctctgtcccctaacatactaaagccactccatgtgcaaacaacatgtttgacggcccactcatatgaaataagaaaggtcaatcccgcccaggttttataaataagaggcgccggttttccccccgttctggacgtctcaaaacattacaatacaccctcagcggactctttccctccccccatttgggaaaattatcattgctaatcatgaccccttcccgcccgggtgcaaaaaatttttgggggcccccaaccacaaaaaaatgtttttacccccaaaac

SEQ ID NO: 658242 - DNA, 929 bp, Homo sapiens
actaaacaccgtatgaagcagaatcgctacagaaagagtttgcttgtctgtagtaatataggatcctgagagaaaagcgtgtcgaataacccaggtagtgtgactggattgcggagcaattgtccagtccatctgcatctctattgaaagcatcagcaggtgaggtaggatagcgctgatgtgagaccgcttaggggtctataattaacataccattaacatgtaggtttggacataacaagacagggattgagaggggataccgacacgtagtgagaagtcatatctgtgaccgtagtaccgctactgtttagcctgggtgtggacggtagcttgaattatatatactgatgctagtaaagcaggacttcgtcagttgtgacactgatacgcgacggggtgctttgtccccacgggctgtactgacagtactgtgttcctgcaaaatattggagaggttgattgctgacaaatataaaacgtattttattgaaataactcgaggttaactggtctgaatgtgcagtgcaagcagcagttagaaaaactccttgaggactgcttgtgggagggataaaggggcccgggcattattccctaacattgttggaaacctgtggtcgataccatttgttgtccaccggtctctgaaagctcggggataatgaatttccgtcgctcatgttgaaagtcggtctagcggtaactatgtggcttaaaagtactcggtatactaacccagtctggtacctatgcacggaagcatgtgcatgcttcatgaggctttgtgcatgttatcccaaatctcgtcttgaacccccatatttggggccccgctctgggcaaaagagcctgaggggcagtctccaccaatggggtgtgccctatccttttatgggccccggccctggtgtccggcgtacacgaac

SEQ ID NO: 658243 - DNA, 363 bp, Homo sapiens
gaggtatctcaagcagcatttcgactaaaccgaactcattttgacccactgtgtctatgcacagatgcacctctgatccagtctaaatccatccttttaaagtacagcaccgccacgtacagtggaggacacgtcagaaatccattgccagtcaccttctgaagtggcggtaattgaaagagctgaaatgtcagtgaatgacaaagcagaagcatgtggctgcagaagatggtaaatgtcgagaagaactggttctcaggtgtctgtatggatggcgtcatagctctctctaccaactgtaggtccaattctcttctttcaattcagtagcgtaaaaataaaaaacagtgtcattgtcattca

SEQ ID NO: 658244 - DNA, 375 bp, Homo sapiens
tgagcggacagtcttgtctaggtaccactgctcatccaaggttataacctttagatctatgttgcctttttatagttgtatatttttagctcttatctttaaaacttttatccataatgagtcattttatatatcgtgtgaggtagaggtccatcatatttttttgcacaggaatgtctagctgtcccatcaccaccgacggaaaagactattctactgacaactattatcaagcctagttggcttgaagttgagaaggctacgatttttttgatatcattttgtgtgattgcacatagtgctgtaaataaggtggtgatagctcctaggcatagtgttatagtttgaactagtttgttagtttctattaagggg

SEQ ID NO: 658245 - DNA, 205 bp, Homo sapiens
  misc_feature (13)..(13): n is a, c, g, or t
gtcctctgaggtngagctgcaagacctgaggaaggagctggagagagtgcgcaagagagctccaggctcaaggtgggaaacaaatcagtgcatcagtctcctgaaccgtgggcaaacggagaggcttcgcgagcaggaagagaggcttcaagagcagcaggagaagctttgggaaccggagaaagagtgcttcagcagattgccc

SEQ ID NO: 658246 - DNA, 1310 bp, Homo sapiens
ggctccttgtactcccgtcgtactactgccgtgtgtccaacccctcgccccggtgtcttgctcggcggctcccacaaccctcgtggccgtggtacgtcgcttctgaccatcgtgccgtgccacgaagaacatgttagcaagacacgcaagagtagcagggggtctccacggatctcgcgacaggaccgagaggtgggagtaatgaatggctggcctatgtatggatgagaactcagtgtgccccggattctgtcgtcgtcaagggagtggctccgaccatatgcgacgaggcaggccattgagattgcccgggcgtagggtaaagcgaaggtgcgcgctcgtatgaggcgccagacacatctcgcactgactagagggcagctgtacagggcccttaaggggcggtcaccagagtggtcctttgggccaaacggtgttggccacagtggccttaaacactgtgcctggggctatgcccatccggagacacggcgttgggtctgcgcacgattgtgttgccaacattctcgcgtaccttgtggctaaagaaacgtagaaattgacatgcacggggatgttcgcccaatgccaattagcggcctcggtgacagaaacggataggataggataacggctctggttcagtggacgcatcctttgggaccgggacatgtgcttcgatagcgccaccggcggacctatttcgagtcgtgcccaaaggggaggcccggggcagagaaggacaccttagtagacaggggcatagttcgttcatactcgaagggggtggctcttggaccgtcgtttgaagaaacccacggctttctgggacacgtcggacgaatggtcagaacacatatcggaccgttttactcactttcccatctgaaacttcccaaacgcccaagaaactttgaaatatcacgccttttctcttgggataagggacatcgaaacggggaacgacggagcggagaaccgcgcgcatttccatagcggcgaccagaagtacgaagtcgtgcagcccaaagaaaattctcggtaaagacaatatgctttaagttgtgagcctatgcattccgcgtattgtgggcaccgttttaccctcgttatttagatagattgcaccaaggtagactataggcccagcacagagagtggacacaggtgtcccccaagttggctctttaagggcaaatgaatagttcttggcaggcaacgatgtaaagggtggagacgttggcacaatacacctggatccaaacaaacgtaactcgcatttatactatgcctatatgtggggaccttcg

SEQ ID NO: 658247 - DNA, 848 bp, Homo sapiens
  misc_feature (12)..(12): n is a, c, g, or t
  misc_feature (21)..(21): n is a, c, g, or t
  misc_feature (31)..(31): n is a, c, g, or t
agaaggaacggngaggggaanagggggtggnaggaagaggggggatgagtgtaatgaaacatggcccactaggctgtgctcgtcaaaataatccatacagtggaaggaacgtacaagtaaataacaaaagcccccatactcttctgactccctggagacagctcctttttaggagtttcatttgccttcttcaagagagctttcttccactgacataaaatgccagcttgatcgcacaataaatctgtctatctacctgggtccaattccaggatctctcttctgtttcatcgacctctttgcttggcttggcaccagccttgtactctactatttattgtacactgagcatgcgatctaaattgcatgtgctggaggatcggtccatgtctctctgcacgtcccaacaggtgcacggtagggacagagagtagtccctccgcgtcttcaccttccccgattccctcctacccgtccccgtcccccacatccgtcgatcgtccatctcatcgcaacttcctccaacccacccctctccctccttctccagtccccgcgtccttccacctgtccctctccagcccccccacactcgtatttttctcctttcctcctacttcttcccccttctcacttcacatcgcccaccggccactctccacctacatccgcccattctggactcgcgctcgtaccgaccgcgtctgtccgccttcctttcccccctcccaccctactgttcagctcacctatccgtcagccaggctctcgcttacgcccgggttttttgtccccttagactcgcttatgctgttgtcccattcggtaactgcactaccctcccgatc

SEQ ID NO: 658248 - DNA, 122 bp, Homo sapiens
gttgtagcatcatagctcatgcagcccccaatcctggatagagaaatccttttgcctcagcctcccaagtagctggtctagaggcatgtaccaccatgcctggttacccactaacacttttt

SEQ ID NO: 658249 - DNA, 190 bp, Homo sapiens
cagataatgtcttacaattagctgtagttatgacattttcctgctcactgataactgttcaaagcaaaaggaaactcccaggcactaagtagtagggtccttctccatcccactgtacacacatctcttccacctcccaccatgtattcctgtggagccaaccgagcgctccactgtgaacacgtacttg

SEQ ID NO: 658250 - DNA, 745 bp, Homo sapiens
  misc_feature (38)..(38): n is a, c, g, or t
  misc_feature (63)..(63): n is a, c, g, or t
  misc_feature (68)..(68): n is a, c, g, or t
  misc_feature (71)..(72): n is a, c, g, or t
  misc_feature (88)..(88): n is a, c, g, or t
  misc_feature (96)..(96): n is a, c, g, or t
  misc_feature (134)..(134): n is a, c, g, or t
  misc_feature (183)..(183): n is a, c, g, or t
  misc_feature (218)..(218): n is a, c, g, or t
  misc_feature (241)..(241): n is a, c, g, or t
  misc_feature (248)..(248): n is a, c, g, or t
  misc_feature (255)..(255): n is a, c, g, or t
  misc_feature (264)..(264): n is a, c, g, or t
  misc_feature (329)..(329): n is a, c, g, or t
  misc_feature (391)..(391): n is a, c, g, or t
  misc_feature (408)..(408): n is a, c, g, or t
  misc_feature (411)..(411): n is a, c, g, or t
  misc_feature (418)..(418): n is a, c, g, or t
  misc_feature (434)..(434): n is a, c, g, or t
  misc_feature (438)..(438): n is a, c, g, or t
  misc_feature (448)..(448): n is a, c, g, or t
  misc_feature (450)..(450): n is a, c, g, or t
  misc_feature (540)..(540): n is a, c, g, or t
  misc_feature (586)..(586): n is a, c, g, or t
  misc_feature (602)..(602): n is a, c, g, or t
  misc_feature (615)..(615): n is a, c, g, or t
  misc_feature (633)..(633): n is a, c, g, or t
  misc_feature (736)..(736): n is a, c, g, or t
acagttacagccacatgccatcagcctatcaggaaatnaaaagggagggagagaaccagaagnaaaanaanntcctctctcaccaggnagcaactntagctccaaaccagatgggtgattcagcgccacatggngaaagataattcagccattgtgtttttaggatttagaagcactcattcnctcgcgggagcctttaaatgtcactggtgcctggnaccaaatgtagtcttcccaagcngtggttnggatggnaggtctgcnacatggcagggtcacagtcagtttatggccccggctgggcactcggtagttgagcttgggtcggnacctatcttctcctcagttgcggtgtccctgtgccatgacgacggtgcccgtgggtgggggngcctggagctcgctaanggnatctgcnatgaatatggctcggnaganacggcgcaancnagctgctgtgctcaggctctggtccacgctgtagggggccagcagagacaagtcgagttcatagatctccttggggcttagggcattgcncccaaggagaatcagcactcgcggtactagtgtccgtgcaaagatntcctccaggtggctgnggacactctccanttctgccagggcttgttngcatttcctgctgctcacctcagtggtggcccgaggtttcttcttctgcatctcctctgcctggggagaaggttttcggtaaaagtgcttaagctgttcatanggcagaggg

SEQ ID NO: 658251 - DNA, 149 bp, Homo sapiens
  misc_feature (100)..(100): n is a, c, g, or t
caagggtcagatggcaatatattttaggctttaagggccatacattctctgtcacaactatcacactcggtggttgtagtgcagaagcagcccgtggatnatacctcaatgaataagcatagctgttgtactccagcgtgctgatacaa

SEQ ID NO: 658252 - DNA, 580 bp, Homo sapiens
  misc_feature (306)..(306): n is a, c, g, or t
gtcgggagagcgagcagagagctggctggatcgccgagtcgcgagtgagggagccgagccgaccagcctgcgatcgatctccgcctcccactccgagaacaggagcccgggccggggcccggtacgccgtcccagtcacagtcctctacggcgtcaaggccgctgagggtagcgctgctgcgagcgagcgagggggagaggagagcgagacgacgcgccggggacggacggccgcgtcgcgacctgacgtcgggtgccgccctgcggcgttggtggaccgctgatgcgcggaaacgcctgcattgnacacgaggggtcaaaaacgaaatacacaccacccgcctgtaaacaactcaagagatcaaagccacgggaacaacgccagaatggcgcacaccgtaggaaaccgcgcatcaccagaaggattacgagccccgggagcagcaacagcggccgcgacaccctaacgtgcgctgcccaaaaacgtccctgaggcaggtaaacgtgatcccaccccccaagtcacacgttggagacttagggaagagacacaggggcccgcacacacctggacggcagc

SEQ ID NO: 658253 - DNA, 177 bp, Homo sapiens
  misc_feature (116)..(117): n is a, c, g, or t
  misc_feature (137)..(138): n is a, c, g, or t
taggtagacacacgggcatagccagcccaacctactgtcacaggcgccccgccattcaaccttccgggaggtcaggcaccttctatatgaggcgagtgggtctcagtctgcttganntggtgatgagattctgctgnnatctcacgcacgctgcagcgtgtcttattgatgagcatt

SEQ ID NO: 658254 - DNA, 419 bp, Homo sapiens
  misc_feature (373)..(373): n is a, c, g, or t
aatactctgggtcttttattacaagccaacccgtagtattcccattatacacttccttcttgttgtaaataagttgggttaatctccattcaggattctgttgcttaggattttttccttctgaagtgtttcacgacgagcccggagagctgctgccctagcggccccgatctggtggctttcagccatctgcggtctgagctcattggccggtgtgggcgatggtgctgagagggaggacagcgctgccctggccagtaaaacggatgttcaactgctggactccagacagaccagtgggggagaaagtactcctgacgtcttccttccccagagcccattgggcacggccaaacatccatgctccacgggncctcccatgagtgaacggccggtgcaagtcgtcagaaacacatcaa

SEQ ID NO: 658255 - DNA, 207 bp, Homo sapiens
gctgcctacccctgggtagacctaacaacaacaagccatttagcgtgccccaaccattgccttccggaccccctagacaagcgccccggctaagtactaactacctggacgtgcctacccctcgacaatgcatggcaggccaacggccaggtatccagtgaagcactatcgacgaacaagaactctacctgggttaggtctagctgg

SEQ ID NO: 658256 - DNA, 406 bp, Homo sapiens
  misc_feature (46)..(46): n is a, c, g, or t
  misc_feature (86)..(86): n is a, c, g, or t
tagagcactctactgcgggctctgcaggcctacagcagagcacaangcgagatcatcactgtcagcgatggccgagcgtcagttcnctagcagggactgtctccctttatttcttactcccaactttccagggctttcaaaaggagacagacccagtgtcccccaaagactggatctgtgactccaccagactcaaaaggactccagtcctgaaggctgggacctggggatgggtttctcacaccccatatgtctgtcccttggatagggtgaggctgaagcaccagggagaaaatatgtgcttcttctcgccctacctcctttcccatcctagactgtccttgagccagggtctgtaaacctgacactttatatgtgttcacacatgtaagtacatacacacatg

SEQ ID NO: 658257 - DNA, 127 bp, Homo sapiens
agcggggtcgcgcctcctgcttccagcgaacctgttccctctccccacatccccgcctccatctcccccggtctggggacccttccctgctgggttgggcggttcgggcggggccggtgtggggctg

SEQ ID NO: 658258 - DNA, 319 bp, Homo sapiens
gactgaatccaacgccgcgttctggtgaaacttcaggcaacttccacccatgccagaaagggaaggggagtaggcatcacatggcaagagagaaacccagagagaagaggaggaaatgccaaggtcttttaacaaccagttctctagagaactcaagagtaagaactcactcatctctgcaagaatggcaccaagccattcatgagggatgcaccccaatattcccaacacctcccaccaagccccacctccaacactggttatcaaattacaatatgagactcggtggggcttggtgggcggcgttggatgcagtcgg

SEQ ID NO: 658259 - DNA, 156 bp, Homo sapiens
gacttagtttgagtaggacatttcccaccaagggctggaggagttgcggcttcagcctgaatcgaatgtcagaacccatgccagcggtgcttcaccctcttggggataacttgcttagttttttactaaatgttcctgtgcttggtttacacaggt

SEQ ID NO: 658260 - DNA, 354 bp, Homo sapiens
acgacggtgtcatggtaggctgtatagataggatcttgctcctggcatcgcagattctcttcgtcatttaaaggtgtggatagagaaaccccttccgtccctggatggaagtggtccttatacccatgacaggaaaaccaagtctgtacccaggattgttcctttttaccactccttgtagactggtacggcctgtgcagaacttagcattgggcaaagaagagctaattggaactatggaacagatcttcatgaatgtcgctatctttgaggatgaagtttttgctggagttaccacacaccaggaactctttccacacagcctgctgagtgtgattgccaacttcatccctt

SEQ ID NO: 658261 - DNA, 257 bp, Homo sapiens
tgatgggcaccagatggcgtgaaggagcggagcacactggcagcctagaaccatctgggcactgaagggactgagagcgagcagcccaggagcatgtgtccgacagagctcgtagtgactgtctgagggcatccatgggacagaaagttcattcctccagggctccacctggcctccagccgcctggcaaggcactcacgtaggcattgatgttgctgcagagaatgctcaggttcccaccacaatggcacgtggat

SEQ ID NO: 658262 - DNA, 103 bp, Homo sapiens
ctgtatccggggagagagaagataaattgggttaaattttaaaaagcacaccaggctaccatattgaggaactatttgtgaggacaagcatgggcacagggag

SEQ ID NO: 658263 - DNA, 270 bp, Homo sapiens
cagagatgatgccactgcactccagcctgggcgacagagcaagactccatctcaaaaaaaaaaaaaaaaaaaaaggtggttgaattcgggcggggcttttaaattcccgggcccagggtagatttcggaaactctgggggcacccgtgggttatgggccctttcttagggcccgggcaattaataccctctttcttcaatttaacgcattggggccaagtgttctctaacattctccttatacccatgtttttaccaggggccggtgtta

SEQ ID NO: 658264 - DNA, 113 bp, Homo sapiens
ggacctggaacgtatatgggccttggttccgccattatgatttctcaccgagctgtttggtccgtgccctatcccacgaggagcagtctgtccccctgtaggcagggctgact

SEQ ID NO: 658265 - DNA, 110 bp, Homo sapiens
gtgtgcatgccgcgtagctgcgcccccgcgtggcgccgtgcgcccgggctcttcccgcgacgtctagttgctctggtagatccggcccaacgacggagtgcgtctactcc

SEQ ID NO: 658266 - DNA, 100 bp, Homo sapiens
aataaacaaaccaaaacattaaataaaacatcagcagaaacaggagtaatgttacatattatatcaccatacaggaagcgaacaggggtggggtgttata

SEQ ID NO: 658267 - DNA, 229 bp, Homo sapiens
  misc_feature (145)..(145): n is a, c, g, or t
ctccctgtggtagttttaaaatgtctgcaaattcttctctccaagaggcggaactgaatttacctccccttgagtatgggctgtacttagtgactcacttctaacaaagtcggacgtgatggcttgtggcttccaaccgtagtcnttaaaagacactgcaagctccgacctgggctccctctttgatcactagctctggggaagccagctgccatgctataaagacact

SEQ ID NO: 658268 - DNA, 112 bp, Homo sapiens
actcccctctattagcggagcacagtaagggagttcagtaagcgcagaggtcacgcctgctgggggtatgttgtgttggaagaagaggaggcgaggaggtggcatagatctg

SEQ ID NO: 658269 - DNA, 895 bp, Homo sapiens
cagggacaggatctttttacttcttccttcaggatccctttgttgatctagcaatgtggccaagttacctttgcctcctgactagtaaggttaccgaggctgagaatgtctaaaagctaacaggaacgatcgagcagcgacgtatgcatgcagcttgccgtctcgatagttgcacgatgtgttcaccaggggacacagccaagacgcccctaagatcatcgtaccgcggcacggacttgtcaccgagaaacttcactcgacgacgaaaatgcctcatgggactctgcaggcgggcatttgcgaatacatgtcagagtgcatagaatacttgcgaaacactcaatggcgagatgggttactgcgctttgaagacggtgatagagagcgcttacgagcatatgcccagtaataactgttcgtaatgcttgtcccgagacgcaatccttccgacgaattgtgcctttcacctcctctcagtgatcacccactgtctacaatcttataggctacgtccaagaagcgtgtcagatcaccgaaacatggcataacgcgaatccgagtgtattccaagagtgtggaacactagaagcacgaacgtgagactggagattcgaggagacgcaagtcgtctccatccgtcgatgtcatcacgtcttgaagaacgagcgctatggcgagtagcaggctgtctcgaaagcgtagaccagatgcttggctcatggatgtcgtacagtctcgtggattcctagtacatcggctaccccatattatcctcaacactcaggggtatgatcctgactacatctcactttaacacgacagtttactttccccttgcagacttgcgaaccctgtgcaaacatgcttttaagcttgcttctaaccagatatgggc

SEQ ID NO: 658270 - DNA, 182 bp, Homo sapiens
ctgaggatccggtattgttgatgacagtgatgataatagtgatgatggtggtgatgatgtgatggtggtgatagatggtgatggtgattatggtggcagtgatgatggtagatggcaatggtagtggcaatgggggtgatgatggtgatgataatggtgatgatggtggtgatgatgatgtg

SEQ ID NO: 658271 - DNA, 229 bp, Homo sapiens
  misc_feature (33)..(33): n is a, c, g, or t
  misc_feature (63)..(63): n is a, c, g, or t
cagatgccagtagcttgtattatgtcttggatnggcccctcctcgggatccggcagctgtggnctaggcccagccctcctcttagctcacctgggctgcggtcccagcctcctaactggactccctgcccgcagcctctcccagatccagctcctccgcacggcagccagagcgcgcgctctaaaacacagacctgagcgcgtcaccgtgccacttgggcgctcgtgcc

SEQ ID NO: 658272 - DNA, 311 bp, Homo sapiens
agacgtccattcttgcatagacgtccattcttgcatgtgtgtgcgtgtgtgtgctgtgcgcttgtgtgtgtgctgtgtgctcatctgtgtgctgtgtgtgctgtgcgtttgtgtgtgtgctgtgctcgtgtgtgtgctgtgtacatgcgtgtgctgtgtgtagtgtgtgtgtagctgcggagctgcataaagtatgagtgctttataggcatgggcattgagatgtaagcatttgggggtgagggtcgtgcaaattacatttcattagcatggattaaggttgaccatgctctgtcctcccctcctttggt

SEQ ID NO: 658273 - DNA, 446 bp, Homo sapiens
gacgggtccacacgtcggcagtgtccatctctatctcatgatcaccgctcggcctccaagtgctgattacaggcatgagcacaacgccagtcagtgccagcgtttatactaactatgtttctcttaggattacaagtcttgcatttccttaaacttagataaaacaaaaaattaaagaacaatagtgatttaaataatgtcttaatgataaaaagatgtagcacattaatgtgtaattcatttctaaaaggattcagtagtcgttgctgtgggcattagacaaagtcattgaaagctatgtgagctaaatggtagacttagaatttgaacgaaaaggaactccagagcccatcatcttaatttattctgctgtgctgcaattagtggtcgtaaagcgtgcaggatgacatgaagtggggagatactgggctcgctcagaagctgtt

SEQ ID NO: 658274 - DNA, 663 bp, Homo sapiens
gcttggctgagggtctaggtggactgtctgagatctgaagacagcatgtacacagccattccccagagtggctctccattcccaggctcagtgcaggatccaggcctgcatgtgtggcgggtggagaagctgaagccggtgcctgtggcgcaagagaaccaggcgtcttcttctcgggggactcctacctagtgctgcacaatggcccagaagaggtttcccatctgcacctgtggataggccagcagtcatcccgggatgagcaggggggctggttgcgggtggcttgggttggtgcaccttaaaacagccgtcgtgtcgtggaggagaggcggctctgtgcagcaccgagaggtgcaggggcaaatgagtctgacctcttcatgagctactttcccacggggcctcaagtaccaggaaggtggtgtggagtcagcatttcacaagacctccacaggagccccagctgccatcaagaaactctacccaggttgaaaggggaagaaggaacatccgtgccaccgagcgggcacactgaacctgagacagtttcaacaactggggactgcttcattctgggaacttgtgggccagaacatcttcgcctggtgtggtggaaagtccaacatcctggaacgcaacaaggcgagggacctggccctg

SEQ ID NO: 658275 - DNA, 126 bp, Homo sapiens
ccagaaattatgtttcgaactagtatgctacactgcctgtcatgtatgataatacatgtaatactttatgaatcatttaaggcgactttaacacatgcacacagaaatgtcacatgtagaattagg

SEQ ID NO: 658276 - DNA, 529 bp, Homo sapiens
  misc_feature (5)..(5): n is a, c, g, or t
  misc_feature (153)..(153): n is a, c, g, or t
  misc_feature (173)..(173): n is a, c, g, or t
  misc_feature (175)..(175): n is a, c, g, or t
  misc_feature (178)..(178): n is a, c, g, or t
  misc_feature (254)..(254): n is a, c, g, or t
caccnatcatgaagtcctggagaactgcggtcaacctattcccttggttgatgtgatctcctggtcagcgctctctctagctactcttctctattggctcacaacggcccagagagcaatggcaccttgacttaagcctactacagactgttngaggcccatggcaaatttantntancggggggaaaatggaaccgggcctgacattaaacaaacaaatgctatggtagctttttcacttcatagcatactcntccccctcggtgatactatgacctgagtagcatcagccgaactgagagggagaataactcaagacaatactcagcagagagcatccccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgc

SEQ ID NO: 658277 - DNA, 1796 bp, Homo sapiens
  misc_feature (1023)..(1023): n is a, c, g, or t
gtgaaggagaaggtcgggttgtagaagctggtgtgtggccggcagctcgctcatctggtgtatcgtgggcttatgtcaggtccagtgccatcgtctctccctgtgaactgggcagggaggcttcgactgtcagagagggagcctgctgcctgctgtatagttcctgagcttgcacagtccagacttctctcaaaactatgtgtgcttgagtgcagcactccagatgtttgtgcctcagctcctagcgctagaactccagcagcatctggccccattgcacaccacttccttgtaatttgcagcacaaaagcgcaagggcatcttgtccagcacaagcacacccttgtaccatctatgtgtgcattgatgaccagcccaacggcacacggatggcaccagcgttagatcggctagactcactgcacacatcttgaccacagccacgcacctagacacagtgtgcaccaacaggcacaccctgcacacgccatgcggcgtgcgtacggtgacagcagcaaagagagagaataccacaccatcacccacgacaagaccaacgcacccgaaacacatcactcaccaacaacatggcacactccatcacagacacaaaccacaacacaccacccacccaggcgaaccaaccacgcacgccagcacgcaccgacaccacaccagggacaagcacacaccacaagaccacgacagaccacgacacaacgcaataaggaacacacacaaaacagaagaaacatgacaaaagaaaaacacgacaagacccacaacagagcgcacacaaacaaacacatccgcaaacacaagacgccaccacaagaaccacgagggacacacgagaacccaaagaaaaaacacaaacacacagagcagaacgaaacaaaatacaaacaaaaacacaacaacacaatcaaacaagcaaaaaacaaaacacaaacaaagccacaaggagacaaaacatacacataagtcaagatatataagtcaatcaagatctatcacactacngacatatataacgaaccacaaatacataaagaactgaaactataatagtactacatatctacacaaaaatactatacatatcaatagaagatacatggacacacagaacataatactcaaattcgctaacactctctgcaacacacactaccaccaaatacaagatctatctacaaatcacaccaaaaatctaatataaacattagacaccactaactaagataacccaacaagcacactaaactgatataatcataaacactaatcacatagacaatacgaagtacactacagcataacgagacgtactgcaaacacacaaacaacacacgaactaacgtatgatgacaagaggatacatgaggcataaacagcactaaagaacagacagcgaaggtacagtagcctatcagatagtaatgtgtaccagacacagcataaccaggtgcgaaccaagaggcgaacgaagacgaaaagagagacaacatagacaagactaaggataaggggacgagacggagctgcagacgagagaacaatacgcaggcccaaccgaacgcgagtgacgatggaagaggcgagagagaggagaaaagagagacgagaaaggacgagagcgtaaagctgaactagaggcgccagagttcgagtcgagtagtgctgatatgcacgaatagagaggagaaagagagagagagaagacagaggaaagcgagatgaaggaagaactgacagtaggcgaggcaagataagtgacagcagacagatctaac

SEQ ID NO: 658278 - DNA, 141 bp, Homo sapiens
tctagaggtctcactcagtagcaaaggactgatcggttcgcatgtccggccttcctcagaccgaacgggctcctgcttcatcttggccagctctcccctggtatccccaccccacatgcatgcacccagggttacgagctc

SEQ ID NO: 658279 - DNA, 483 bp, Homo sapiens
caggcttctttatagaaggagatggttcttttctgtcttctagcctaaataaagtatcatcccaataatggggcctatgccttgaatgaatagaaatgaataagctggtgtttgttttttcaaaagggaagtaatttagatttgttctcctcaaccataaaatgattttagttcagttttacccagtgaaacctttgtttttatgaaaaaaaaggaaaatggtttcccctttggttttatatgtgttaaataaatgggtaaaggacccccccaatgttattaaaatttttttttcgagcattaaaaattttttcaacccccattgggtttctttgggtgtgatattttaatcaaaaggggttgagttgttaccagtgttttttgaaaaaatttttaaaaggcttataaatgtttgaaatttcccccaaaggctgttttttaaaatatatattttttaaaccaataaagttttttttttgccta

SEQ ID NO: 658280 - DNA, 417 bp, Homo sapiens
  misc_feature (67)..(67): n is a, c, g, or t
  misc_feature (139)..(139): n is a, c, g, or t
  misc_feature (170)..(170): n is a, c, g, or t
  misc_feature (322)..(322): n is a, c, g, or t
  misc_feature (324)..(324): n is a, c, g, or t
aaaaactcagttggttgaaactgacaaggtaaggattagctttcaatgtaagaggacaactcttgcntaacatgaatgttaagtaaaggagctcactgccgtgaatgcttaggatccataggtcctggccaactccagnctaagagcaatataaagctctcaaacaaacncccacaaataataaaaccccattccctaccagagctttatttctcttatgttgtatcaagcctcatagtcacccgcacagtgctgcattagggcggcatacaaaagcatcagttctcttccacctccgtagctggtcaatgaagacacacangntaatgatctttaacatatctgcaattagaagttctctgaagacgtcgagacgctactggggtaaaactcagctcttaagcggattggtcataa

SEQ ID NO: 658281 - DNA, 564 bp, Homo sapiens
tagaggatcccctacatgctcgaaaagctctactgcatctgtaaggcgcagggagactcctatgacctcgaggactttgtaaacctgtcagcagcttccaggttcgggagtgactgcttcagatagaccgtatgacaggaagtggtgccacatgtgcctcctgatcgaagaccaagatgcccagggctatgagctgttcttcaagacaagagaattgaagaagaagtggatggagcagtttgagatggccatctccaacatctatccggagaatgccaccgccaacgggcatgacttccagatgttctcctttgaggagaccacatcctgcaaggcctgtcagatgctgcttagaggtaccttctatcagggctaccgctgccatcggtgccgggcatctgcacacaaggagtgtctggggagggtccctccatgtggccgacatgggcaagatttcccaggaactatgaagaaggacaaactacatcgcagggctctggacaaaaagaggaatgagctgggtctgcccaagatggaggtgtttcaggaatactacgggcttct

SEQ ID NO: 658282 - DNA, 98 bp, Homo sapiens
gcggccgcctactactactactactgctcgaattcaagcttctaacgatgtacggggacatgtaataaagaattacttttccttttgcaaataaaaaa

SEQ ID NO: 658283 - DNA, 109 bp, Homo sapiens
ctacatatacgaatcgagcctgtacctgaacattcgtgtccagtcaattcgatgaatctttaaaaaatgtgagtacatatatcaccagatggaagtattatacaagtga

SEQ ID NO: 658284 - DNA, 219 bp, Homo sapiens
  misc_feature (9)..(9): n is a, c, g, or t
  misc_feature (15)..(15): n is a, c, g, or t
acatgtgtncagagnaatcccacattcctagtcctcaccacttttcacagcctcgcttaacttggcttacaggaagcataaagccaaagtgtttggttttttattgcaacatggcctggcccgatataaattagataatgacagccaatggctgaaaatggggttctttgactttcaaattctcagggaccttgagaactttataaccagaaatgtcaa

SEQ ID NO: 658285 - DNA, 139 bp, Homo sapiens
tgggagggagcgagagggctcctttccaagcatgacctcttcttggatgcccagctgctccaaagaactggagctgggggccgtgccagtgaagactacagtgcagtaccagtgccacaagtggaagtggcagtgtgtg

SEQ ID NO: 658286 - DNA, 109 bp, Homo sapiens
gcggagtagccagtagcagtcaggacagggactggttacggccactggcaactcggaagcaggaatgttctgccgatactgataggtcagctcacggaagctgcgcagg

SEQ ID NO: 658287 - DNA, 892 bp, Homo sapiens
cccaagcgtaagagcccggggccctgggccaaaaagtgggagcccgccagaggagagaacgtctcccaacccgcgtggggattgcccgacgctcggggttgtgtccctgacgcccccccgctggccgccctgcagacaccccgcgggtgtggcgatagcaagcagagcaatcggcgcggtacaaattcctgggcattcttccctaggcgcacaacagaagggaggcgcatgtggtaaaacgatgaggctcccagccaagggaaaaagttagcgaaagtcgacagagaagagtgcacaggacctcccccaaaggcgccccacgttataacgagggccccccaaagcgagggcgcgtcgcccaaaatcgccccccaaaggggagagtgccaagaaagatgggcccacacagaggcataccaccccgacggattgcggcccacgaagccacctccgtgggagtagctacgaagcccctgcgggcaacaaggtcatcacgcacgcccaaagctgctcttgaagaagccgcagccttagaacagaaggtgagccgccaataagtgccccgagtaaagcagcgagccgcgccagacagacatactaatgggggaggggacccggcgaagtcacttgcacaggagttcccggcgggggcgcgaccactctcccccggcagaagaaagacgcagcgctcgcaccgcccacacggacacaacgggcgcccctaggagcagagagatagcgtgcgcaactaccagaaaaaggaccataacgctcttatcgagaaaacaaaaaagacgaacagtcccacaaaggaaacccccccccccgggagcgaaagaggaacccacagggcccaaacgcgccaagacggcaaaggccccgcccacaaaac

SEQ ID NO: 658288 - DNA, 1135 bp, Homo sapiens
ggccccgtagctggtgcctgcgacggcgggacccggactcggacgcgtgccccaggatgggtgagttcaccgagaagaagacaacatgtggcaccgatttgcctcaagtacctgtgtgtattaccttacagattgcttgctatcttggctggcttgagccatggcatgtcatggacagtggagcaatctgtgacagctggcccttcaaggagtgacatacatcgagtacttgcatggcgctcagtgcactcatatctggccgacagtcctacatccttgggtgttgcgcgttggcacatgctcaggtacactggctagacttgcgcgggtcattgtggcttgcatgcgccaagcgcattcgaacgggacgcggtctggaagcactgcatgcggcacatgtagcgttcattctctgctgtcctcagtcaattctatttctgcgtggaagatcaatcgcgtggttatcgctcggccgtacgcactacttagccagcaagcatgagacactggagcgtcaatggagacacctgcaaggacaagcagtgaccagagcgctatcgaccagctcggtgccatgcaggactgtgactcagcgcagtgtggacgcagctgtgccagcaaggagattccagctgctgtggcatcacacaactcacaggactggcgacgacacgtgaagtggaatccgctcaccagtgaggtcccgtggcctgtgtggtcccagactagactgcatgcaaagacggtggatggctctattgatgggcaagcgaagagcatgcctcccaaaatctacaaggtggacgggcgagtgcatcaccaagttggagaacttcatccaagagcaacggagggtcattggggctgtgggatcggcattgctgtgtgcaggtcttgagatgatctccagtgctgctgtacacgagtctcaagtggagcactactgaacctggcttgaggccttgctgatgctgaacacaattactgagttgaaaccaatggagtaacacgcgcatggggttccttgatagaaaacacacttgtgcctataacataaactctgaggaaccagactcagaggcagatcaagtggcctatgatgagacacaatgccacacgacgtaagggatgacga

SEQ ID NO: 658289 - DNA, 431 bp, Homo sapiens
ttaactccattgacattttgggatgggaaattctttgttgtggggtcctgtcctgtgcattttaggagttttaagcagttttggcccctaccagtagtatatgccctttaccccctggggttgtgacatcgaaaaatgtctctagacattgccaaatgctctcgtgggggacaaattagccaccagtcaagaaccactgttctaaaccagcagtctcaaagcatggtcgccatggaccattgaggtcttaagaccctttgagggaggagtgtagatgaagtcacaattgttttcataaaaatcaaagttaattgtccattttcaccgtgtggacattggtatttacggtgcataggcaaagtggataaaatttgttggggccatagcaggatgcaagggcaccacactgtattcttcactcacagtttgga

SEQ ID NO: 658290 - DNA, 311 bp, Homo sapiens
ttatgtggtagtctatagaaaaacctaaaactttgcattttcctgagacaaagtaagtagcagaggagacattctctctctctgtcttttggtatggtttaaagtaaatgtttgttagtttttttctgacgacagttttttgctcttgttgcccaggctggagtacagtggtgcaatcttggatcactgcaacctccacctcctgggttcaagtgattctcctgcctcatttttcctatgtagctgagattacaagcacacgccaccacgcctggctaatttaggtattattagtagcgattagggttagt

SEQ ID NO: 658291 - DNA, 283 bp, Homo sapiens
  misc_feature (117)..(117): n is a, c, g, or t
atgatctgaggattcccaataatagctaaaactcacctgagttgtataaaactccagttgagacaaaatagactacgaaaggtgctttaaccatatttgaacacacaatagctaagnaccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataatgtgatag

SEQ ID NO: 658292 - DNA, 176 bp, Homo sapiens
ggcgcttgtggatccgtagggtatgatctgctgaaggacggaggagttagaccccgcaatcaagagcctgtcttcactgaagcccttggtgatattttgccactcagccaagaatgaggatgcatgcttcagattctctatgtcccgaacctggaacctatccaacaagcgcctgg

SEQ ID NO: 658293 - DNA, 297 bp, Homo sapiens
gagtgcatggtggatgtggtgtcaggcaggcacagtggtcacgctgtaatctcagcactttgggaagccaagtgggtggatcacctgaactacaggagttcaagacaaatgagcaaatcaacatgacagaaccctgtctctaccttcttggtagccaagcatggttggtgcattgcctgtggtcccatgctactcatggaggctgaggtgatgaggatcacttcgagccctgggacggcagagtgttgcagttgagcccaagatcctcactacgtccactcgcaacctggtgtgaca

SEQ ID NO: 658294 - DNA, 328 bp, Homo sapiens
  misc_feature (72)..(72): n is a, c, g, or t
  misc_feature (74)..(74): n is a, c, g, or t
  misc_feature (289)..(289): n is a, c, g, or t
accataaatagtagatgcttgaacaaaaatcagtactcatgtaggaattctggtatgggcaccacttgattntnggatctctgaagtgaaaagcatggcacttgttcacagtcacctcaagctgtgactatcctgctctctcttcgtctatatatgtgcacatggacacacctacgcgtatacaagtgagattattgcaagaaccaatctgttacctttgatggaaactgtcatacaaatacatgcaaggagactttaatgactttgatcaaaatatatgatcagaatngttatctagtgatatgaatttggggtaattagggtttcg

SEQ ID NO: 658295 - DNA, 365 bp, Homo sapiens
agcggagtgacgacccaacgcctcctgcttgcctgcagggtggaccgtcccatcagcctctgtggcctgtcgcacgcagggaaggacctcatgcagtcctggaatgatgcaggcaggaggcagtgctggaatgacatctcagggaagacggaagaagtgtcgtcgactgtggaaatggagtgtgtgcgcagaagccttgctttccatccacacgacagtgagagcccgacatgacatccctgacttgtaccgagctgtgctcgggggtggcacatctagctcccacttgcataatatgcgcccagttgtcctgacgtgacgtagactgtggacatgtcggtgcagtgcgtgtgacccacgtctcg

SEQ ID NO: 658296 - DNA, 417 bp, Homo sapiens
cctcacagcttctctgaggtgactcctgcatttcgtcccctcgatctgggacagtcacagcatttctgtgatgctgacatagacctttcttgctcccgcctccccaggaccccagacgtccaggacgctgacattgatctccaagaccgttcagaccctcggcagcctgtccaagtccaaatctgtgagtccctcttcttcattttctctttttagggacaactgattcttttctctcttcagaaaatacacgtgaaaaaactcccacatttgagagagtcgtcagataaaagatccagaatcaaagacggcgacacatactctcttgaaaaccaggagctgagcgtacccgtcccgcgtcactctcccctccttaagtgaagcccttgactttttcgggagcctgtgggtcgtcgc

SEQ ID NO: 658297 - DNA, 612 bp, Homo sapiens
ccactcagccttggaccccacttcagaagctaggcccgtgtcccgcggtgctgactgagcctgcttcccgcctccccctccgtgcgtgtgctggaattccccaggggacccgggcccccgccaggggactgtctccgaagacttgatttgttccgtgccctgtgttctccacactgccactgaccaacgtccgccagcggtttccacgtgtgggcttcaggtgttgttcacagcacaacccgaccacaacagagccagtgcacttttccgtcgcttgtgccttttttgtctttgtgctaacgtcttgactaatttaaagatgctgtcggcaccatgtgttatttatttcccgtggtcatgctcagccttgctgcttctgcagtggcgcaggtgccatgcctgctccctgtctgtgtcccagccacgcagggccatcccctgtgacgtctggccgacccggctggacaccctctgccgagtaatgacgtgtgtggctgggaccttctttattctgtgttaatggctaacctgttacacctgggctgggttgggtagggtgttctggctttctttgtggggtttttatttttaaagaaacactccatcatccta

SEQ ID NO: 658298 - DNA, 1069 bp, Homo sapiens
ggtagtatggtagtgatagagtgaggatgaggaagatgtgatgccgacgcatgtgacttggcgggaggcagcttgggtcttgaatacgttgcgtgtcgcggagccatacctggtgcctgcgtggagaacggtgcgcactttgcacaagatattgtaatccgtatactctgggagacgataaaccagagaaccatcacaagaacatgaatgtatgttcacaattgcttcatcacaagccatcatattagacatataacgtaacgttattagaaaggtttcgtgtccgagggagaggcatagccgtgtcaaatgaagaagtcggatggtcgcctacatatcatcggaggccactataatcgcagtggcagccatccgaagatcctccgaatgaggaatcaaagagctcgtcttggccactaccaatgatcctcatgtgaggagaaacgaatcgtgtgaagcataagctatatagggaaatgagatgggactacgtccagtcactactggtacaggactatataaagtattatgacgaaagacaagcactcgacccgtggacccaccatgtatgggaaccctgtaaagaaaaagtgctcccgtagtattaaaatgtgagaccttgaaaatgaatatcaactatcttgggattgactgggggaggcgcggaagacaattgccaagatgggggctgttgactagtaaaaaagttcatgaacataactttcgcgggtatggacttggaatctaaagtgatagccatgtattaattgtaccctgaattggcacgtacttaggtttgccatcgggagccgaattagttacgttcattggctacagaatcattctagttctgctaccctggagggggggaaacataagagcacgtttccaatttgccttactttcctcgaaaaaaacaagcgctcttgtggtaagtcataattttggagacaggtggggtctgccatgaatccaatatccttgtaactccagagtagttgagaaggcttggggagggctttttccttgatgatgctctgggcccttacaggtaccccccacttcaagg

SEQ ID NO: 658299 - DNA, 224 bp, Homo sapiens
gttctggcttcctattcccatcacacactttttcaaatcgctagtcaagtacaatttacctgttctaacgatgcggccaggcacggtggctcatgcccgtatcccagcactttgagcgcgtaaggtgggaggatcgcttgcgcccaggaggtggcggctgcagtgagccgcgatagcaccactgcactccagcctgggatacagagcaagactctgtctcaaaa

SEQ ID NO: 658300 - DNA, 575 bp, Homo sapiens
  misc_feature (368)..(368): n is a, c, g, or t
cccttttggggtctatgacctactcccacgagaacgtgcctatcaagcgcgatattattggtgcctatccggaagacgagaagagggagcacgatccatttcgtctgaagcatagccccaatgtcaacttaacggatgtgaacagcctaagatgctttgaaatgacccttgtgttttgccctgaccgaaccgtagtttggtgtgatggctgctagactggcctctgccaaccgacagtaggtaatgcacggattgctgaaggtatgttccttaaagtggaagctgaactctgagcactctcaggcaagatgatggctgactcacttcaatggactcgttctgacccgagacaaaatgtgttccatggncaaacaaggtggcccactgagtgaagttcactctggattcaagaaaactcaagcatgcggcccgtattcgagctgagttggctattctcactaaggggggggtaataaacataagactcctatggttaacaccacggggctggaaaaccgggggaaaccgagttaatctgctgcaggggttccccttttgccggtgggaaaatgcca

SEQ ID NO: 658301 - DNA, 1147 bp, Homo sapiens
cggcggcaaaccgaagttggaatgtgtactcttagcagcgcgcggtagaagaatcggggagccagcatcatggcagaagcgaggagtggtggaaaactgatcttttggattacgatgaagaggaagagccccaggctcgctcgtgagagagagcaccagctccacgccgtaagaagagacgatcaagggatcctacgttgtccatccatcggcgtctggattcctgggaacttgactgcaggaagccgggagcgtccgtgacgggccatcagtgggactagtgagcattcagagcaatccttacatgaggtccgagctatgagatgcattccccaaggccatcctgggcatggactgtcgctgtgccaggccaatgtccgcggatgggcaagacagcaggtctatcgtagcttggtccatcctaccatgcagattcgagccctgtcgactggaccagtgtgacggatccatggatcagtgttgaccacacgagtggagcatgagccgtataccagatcagcaagaggaagtatgagcagcagtttgccaatgtacattgctgcagcagataaagggtgtctggtgtaactctacgagttggtcctcatccgatcgaacgaagggatggaacgaagatgttagaggaaagaacatgtcacgccatgtcggtgagtcgtaaacccaggaggccgcatcctggctgctacgggcgggaataggaagatggcagacattacaggaaagttgaagcaaacatggtgcgtgtgaggatgtgttgagcaagaatgattggagcaaagtgggacaatgaaggtgagaatgtgaagagaaaatcggagcggacatgtgaatcgaacagacaaaaaatagcgaacatgaaagttaccaggagccaccccgagaacaaacggacagaccggcacagaagagaacaggaacgaacctgtaaggaatccccaggaaggaatgcgagaggaagaagagaacacgaacagacgggaggacgcgcaggaaaaaaaggcgaagcatcaagaaaagaaaaaaaacaagcaaggacaaaagaacggcgacgataaccacagagagaaaaaaaagaaagacgcaacaagcaccaacaacacaaacaaggcaacaaaagagcacacaa

SEQ ID NO: 658302 - DNA, 1566 bp, Homo sapiens
gggactgatcccaaaggagaacacattccagcttctcatctatagctgcggccgtagatcatctcaggtgccatccgagtaggggttgcccaacctactgatgtagcgcttctcgcggtctggattcttgacgtgttccgcgagtgccctcaggcgtgaagtcgtatcatcgggtccatcaatgagacagcgccgaagtccgaaagtcatgactacgcaccacgagttcttgttgcttctgcggagaccatgcgcacgtagagtaggcgagaggtaagacggtcatcggctagtgatgactgttcactgagagtggccgagtcaggggctatgagcactgaattgcctgatttggtcctttcttgtgactaccagaggcgtacgaaatcgttcgtggagagatgcacgtattgtgaggtaaacgtagggcataggggcacaccttgacttcctgtagaattgcacttggcacccgccgggcacgagccgttgaccccgccctcaatatgagctcgctcagactgcaatggtggacctcgacgaacgggttttggcggtcccctcccatatgggtctcgcttctagactgtagtaagggcgaacccgccggtgagttagcacaactctgtggcaagtccataccgggtctggggagagcgttgactttgcgcccaacgtgcggcgaatgcttcggggcacactggtaccgccgttttcccatccccatccgcctattggcgacgagggaaatagccggttcccccttccttgtgccgagattaccgtttccgcatctcagggatgcgagactatacgccgtgggtcactttccgaacagcctgttctccgttgtaccaatttcgaaagcgtccggaaagtccacatctgccgattgcgaaatctccacttgggtttcaccatttgttggaggcctgggtggccacgcgctataggatctcccacaaagctcccccgtatatggtgacacctgttaacagggcggcgtcctcgatatggaggaggcgcacgcctcaccacaaaatggtagcacgacgcgaacatttccacacgcacgacgcgcttatctatggagtgcgcgcgcccgcatcaatgcgatgagcagcagacgtcagcttttccccagcccccacgcagcactcggtgtcataggatctgcaacacgagacgctactcgctcaggggcaacatctgggcggtcccacccaggggagtgacacactaacgtggcaaacaatgtctggccccgcgcgcggtgtatgagtggatgtgcggtcggtcaccctcctggaagggtgatctacgaggagtacagctcataataacccagtgaccctgcgtggtgattagcagggagtgagggcaacacgctattcctaaattgctacagcggcggcgagatagctcgcccaacagttgcaggtggccacaccggacatgtagtatatgcacgggctccctactatgcgcgtcgaacgacgagggcactacccgctgtgacgggtggtactataagtgactccctctcatttacggctgttgtgtatt

SEQ ID NO: 658303 - DNA, 332 bp, Homo sapiens
gaatttccttttctcaactctgtgataatatttctttttttggctgggcctggtggctcatgcttgtaatcccagcacttttgaaggccaaaaatgggtagatcacttagggtcaggcatttgagaccgcctggccaacgtggtgaaaccccatctctactaaaaatacaaaagttagctgggcatggtggcgcacacctataatcccagctacttgggtagctgaggcatgagaattgcttgaacctggtaggtagaggttgcagtgagccaagatcatgccactgcaccctggtctgggtgacacagcaagactctgtctcaaaaaaaaa

SEQ ID NO: 658304 - DNA, 155 bp, Homo sapiens
atggagaccaggctgagtgggggatcccagcacgtgagaggtaaggcaggaggatcgcctgagctcaggagttcaagaacagcctgggcaatgtggcaataccccgatctcttcaaaacatacaaaaattactcgagcgttggtggcgcaccttg

SEQ ID NO: 658305 - DNA, 410 bp, Homo sapiens
gtggtaggatatgagggagaggaattagtagagtgatagaggagaagataaaatcgctttggaaaggaggtgagcagattgattaagttcaacatatacctgcccttttacccagaaattccactcttaggaatttatccaagaaaaattaaaacatatgtccacaaaaacacttgaataaaaatggtaatatcctgaaaccaatgtatcaagtaagagtattcactgtattattacagtctagaaggcctatcttatggtgtcttaatataaataattttcttacattcctaaaatttttttattcctttttttttttggagagggagtctggctcggtcacccaggcgggagtgcaggggcgtgatctcagctcacggcaacctcggccacctcccaggctcaggtaa

SEQ ID NO: 658306 - DNA, 311 bp, Homo sapiens
ctcattgtggaacactgcaaaataccccctcctttcttgacctttctgtctctgcaacagcctcatgtgttcatcataggcacatcaggtggaagggaatgaaagccactgtgacaaacaagacaaagaaagcccagcattgccagtggcctgggacctgaaaacaagtcattgtgtgttaattcttcatggaagaaaactaaaggtcgtgtgtgtcagtgtgaatgctggctgtgaaattaatgctttggccaaatgactcagtcgagacagaaacatgattttgttcgcgctggtgtgagccaacatct

SEQ ID NO: 658307 - DNA, 433 bp, Homo sapiens
tcataggttcgcaggatcataggcacaacagtggcagggaaggtcagcagataaacaagtgaacaaaggtctctggttttcctaggcagaggaccctgcggccttccgcagcgtctgtgtccctgggtacctgagattagggagtggtgatgactctcaacgagcatgctgccttcaagcatctgtttaacaaagcacatcttgcaccgcccttaatccattcaaccctgagtggacacagcacacgtttcagagagcacagggttggaggtaaggtcacagatcaacaggatcccaaggcagaagaatttttcttagtacagaacaaaatgaaaagtctcccatgtctacctccttctacacagacagggcaaccatccgatttctcaatcttttccccacctttcctgcgaacctatgagggtaccgagct

SEQ ID NO: 658308 - DNA, 577 bp, Homo sapiens
  misc_feature (84)..(84): n is a, c, g, or t
gagacacagcggttcgagaaggttttgaagagactggtataaaatcagaattcagggccgtcctgagtattcggcaacagcacnccaatcctggagcttttgggaaggcagatatgtatatcatctgccgcctaaagccatattccttccccataaatttttgccaggaagaatggttaaaatgtgggtggatgggtttcaatggcctggcgaagactgaaaattcaactcccctccccagcagaggtggtaggctgctgctgtatggggacaaaaaagggtttggcaaaattggcctggctgtggaagaacttccagcagtttacccagggctgttttattaactctatcataagggactgccagagaattataaaactatgaaagggattggtttaattcccctttatatggttagaaacatggaggctaacgaatggcataagaaatagtgggccttttgggttgatttaacatctggctgggattttttaatggatatgatttccatgaagaaattttggtttttaacatggaccttttaaaagcctctttttgaataaagccaatgggggga

SEQ ID NO: 658309 - DNA, 193 bp, Homo sapiens
tggccgtgctccaccactatgatttccacgctgggcgttgacagaaacacccacgtgtgcctcctggagtgtcagcctggctgatggccctgagccatgcattcagggagtgacggctgttttgactcgggtgcagtgacaaagtggtgaactgtggaagggtgtattataagggatgacacctgtgatgctc

SEQ ID NO: 658310 - DNA, 131 bp, Homo sapiens
gaaattgcttcactgtgtagacgcttcattgacaccactcttgccatcaccagtcggtttgccagatgtacagaagaggccagtaggccatccccagaggatgacaaaaggcaaaggactgttactaagag

SEQ ID NO: 658311 - DNA, 164 bp, Homo sapiens
cagataaggcatgcgcagataggctgtttatttaatggctgatctatgtaatcacaggaggccagtatgtacatgacaaagtgggaggttttatttctggtgtctctctccttccttgcgatacaagtcttgcatgctctccttccttcttggcctggaggctg

SEQ ID NO: 658312 - DNA, 763 bp, Homo sapiens
  misc_feature (763)..(763): n is a, c, g, or t
tggagggggagtttggctctgggttgcccaggcttgcagtgcaatgggagagatctcagctcactgtgcaacctctacctccgttggttcatgtgattctcccgcctttagcctcccgagtagcggggattacgggcttgtgcacaccagtgccaagctaatttggtatttttagtagagatggggttcctcagtgcgggtcaggcgggtctcagactccgtgacctcaggtgattcgaccgccttagcctcccaagggggcgggagattaccgggtgttgacgccatggcacccaggacgggtttacccatttttacgcttgtgtcaagaatggcctcccctttaaggggctgaaataaatatcccttggtttggttttcccacctttttgggttattgggtattggttactaacgggtcctgggggtgtaccaacctgggcatgtgtggatatactgtatgagcagtggtgaacagatacctcttccagacccttgtttccagttctgtcttgggtatttacccagaagtgggtcctccgattattttggaactccatttaattttggagtggttgtccaatggtccccccaggtgtcgtttactccctcacgtgcattgccagttttcattccttttaggagaacatccacttagttcctgatcgtgggtattggcaaaaaaaaaaaaggggggggcgaataaatggggcggaaagaggtcaagggcggtccacgccgtacggttcgctaccccgcggtn

SEQ ID NO: 658313 - DNA, 117 bp, Homo sapiens
acatgcactttgatgagcctgattgcgaacactcttttggtctggacaaggctcctgtgctcctgtcttccgtgaatcggaggggcttcgggaccacctcccgtagggacgggaaga

SEQ ID NO: 658314 - DNA, 435 bp, Homo sapiens
  misc_feature (27)..(27): n is a, c, g, or t
  misc_feature (97)..(97): n is a, c, g, or t
  misc_feature (432)..(432): n is a, c, g, or t
ctgaaaatcgggtgtttgaaaacccancccggcccaacatggtggaaccccaatctcctacctaaaaatacaaaaaaacctagcccggatatggtgncgggtgccctgtaatcctcagcctacttgagaggctgaggcaggagaatcgcttgaacttgggagcagaggtgagctgagtgcagtgagccaagaccatgccattacactcaagcttgggcaacgagagcaaaactctgtctcaaaaaaaaaattagccagatgtggtgacgcatgcctgtagtcctagctactcaggaggctgaggtgggaggatcacctaaggccaggaggtcaaggctgcggtgagccgtgattgtgccaatgtactccagcctaggtgacagagtgagaccctgtctcaaaaataaataataaataaataaatgttcagancca

SEQ ID NO: 658315 - DNA, 751 bp, Homo sapiens
ctatgctgattcgtcggtcaccctgaacgctttatattcttatcctaccaggcttcggacataatctcccatattgtgaactgtacatactccggaaaaatagaaccgtttggatacatagcgtatggtctgagctatagatatcatactatgcgctctcctagggtttgatcgtagtgagcacgccatatatttacagtaggaatatgatcgtacgtacacctcgaggcatattgtcacctgccgctaagccactaatcatcgctatccgccaccggacgtcaacacgtatttagactgactcgaccaaactccacggaagcaatatgaaatgatctgctgcaggtgctctaagccctaggattcatcttctcttttcaccgtacggtggcctgatctggcagttgtacttagtcattaagctcagtcactagacgatcgatactagcgacggacaacgtagctacgttgtagctcacttccactatgtcctatcgaataggagctgtattgtgccatcataggaggcttcatgtcagctgattatacccgctattctcaggctactagcctagatcaaactacgccaaaatccatttcacgtatcatattcatcgtcgtaaatctaactttcttcccacaagagtttctcaagcctatccggtaatgccccgatgttactcttgactatccccgtatgcatacaccacatgaaacatcctatcatctgtaggctcattcatttctctaa

SEQ ID NO: 658316 - DNA, 227 bp, Homo sapiens
cgagaggtactcgtcaatggggatgttggtcccacctggccgagactgccagtgtacggcggaatactgctacatgttcatagttcttctcgacgtcccggtccagcagctccacggggtgatctccttgcctccaggcgcttctcattctcatggatcttcttcacccgcagcttctgcttctcagtcagaaggtcgttgtcctcatccctctcatactgggtgac

SEQ ID NO: 658317 - DNA, 852 bp, Homo sapiens
gagccgatcgcgggcgatgtgtgcgtagccgtgcatctccccggtgtgttggaagagcagcgagcccaaaatgcagcgatcgctcttgggggatgggtctccttgagctggctttgccatgtctacaggagaacacacggttcggttgaagtgtctgactacatttccaaccaaagtgtcactgtccactcactgacgggtacagaatgcttcctagggacaatcaggaatttgttcctatcaaagggtaatctcgcccccttgcaacttaaacgcttggttactagttcctgtaatctcgatgtcaggatccgctgcaccaaatccagggctaactgaagacaaggtacgcaggtatccattgaaggctggaaatttaggctcacgtacttcgtcgaggattagcgtgtcttttgcccagttacggattactgatcctcgattgctgccactcaacaaacttaggagtacgtggcgtgcgtctatacctgagtggcagaagacagaggaccagtaattctacccatggctaattgaagacacaagtggcctgttatctatcgcgggtgtacaggggattatcaattgatacaacctggagcccagcaagattacacaagtctgagaatgctttctctgtctcatgtcgtcagccagcaccaagcctatgttgggcactatcagggctgatggaaagatctcagtacaactcagatgcataatgctgaatagagattgtaacaacactttcttggctggatgtgaagcttaaactcctgtggattcacatcgagataccagcttcagatgttgtcattgttctagtaaactagttccataatgctgacaggg

SEQ ID NO: 658318 - DNA, 1416 bp, Homo sapiens
  misc_feature (1)..(1): n is a, c, g, or t
ngagttgttctgcggtgcgacaaacgcaagtggggcgaactcttgggggtgttgaagtgagcccccctgtccgactgctgcgtttctcggagatagagttgtgggagagctccctccggatggttgttgacccgaccgacacgatgttttgtgatgcgacgatatgtgttggttgctaaaatggcgcccctgcataggagatcgtgcctccctgatatgtgatcgtcacaatgtgggttagacgcggccgatatttctgcgctttgcgctagttgtatcctgcctgagtcccaaagagaatgtggtgttttgaatatgtgtctgattgtctttgtcgtttgtggtggttgataaactctacacgcctgtttgtggtgaaaatagatatttggtgaacactgcgtccatcgtctccccctttgtgttctgttggattacttactctctgcatacatctttctcgccaccgcgataataataggaggagtgtgtcgcgcaccagacccctccttggtgtcacacgacttcgggggtgtgttctcccccgccgtggtcttgttaaaagagatcagatggttcgtgcgtaatatgctgccaaccgaattattcctttttctgctgggggagaagaaacgcccccgtggggattcgtcgtggtttttaaaggtaatccctcgtctccactcttctcgtgtcgggaagaaattggggtgagatcccggcgaagggtgtggaaccgaccgcaactatgggcgagacaaaatagtttcctacaggcgcccgcaaaggttagtttcccgcaagatctccccaagagtgataagaggcaatttcctcgttccctggagaccccacgccacagagagtggttttgatattcttctctgtctctcgtgggaaatacatcacactgcttgtggaaatatgatttgtgagacgcccacgccccgcgtgttctgtaacgtatgacacagacactggccacagaaaaatagagagtgccacaccccgtgccacacatggggtgctttctccgtcttctcaaagagatgtggaatagccaaatcttgtctgttgtatagaacccctggacatggttaagacaccctatctcacaccctctggagagtgtggaacccccagagcacaccaccatctggagaaatattcaaagagccaagagtcccagattaaggataggcgatccctccgtgatccagccagaggttgatcttttgcatgggaaaccagctggtaaaatggacacccaccctgtttgactaccaacacatcccagaaagagatccactcttgcacttggtcctgcgcttgagggggggtgtttcaactttccccctttaaggtttcacaccaatttcattgcactttccctttccaataaaattgttgcattcc

SEQ ID NO: 658319 - DNA, 799 bp, Homo sapiens
acccacgcgtcgcaacacctctttacagtgaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagagaagagagagaagataacacataatgtatttagagagagagagtatagatagtatgtatatattgatatattgtattgagagaggggggttgtggttatgtggtgttggatatgtatgaaacagcaagtaggatgtgatttgtgatatagtgtatatatataagagagagaagagaagagggagaggtggggagtgtgggagatgatagagaaagataggtaaagggaggatcataggatataaagagtggagaagagaaaaaagagggtagaaaaggaggagtgttgaatgtattaaatgtatgttaaatataagagatactatagagtgtggtatgaaagtaatttaaaaggaataagagagaaggagttaggagtgatggtgtggttagaagtattttattatgttatttaaagtggtggaggttggtggggggcgaatatcggttggttgtgcgaggggagaggaactgtgctgaggtaggaaggaataacatgacaagtggaatgagaaatagtgaatatataagacaggacagggggagggaaggaggggaacgagaatacgcgcgggcagagcaaaagggaaaggacgagcaggcaagaagaggagaaagcgagaggaaggggcgcgaacgcgaggagcacaagcacgggcgg

SEQ ID NO: 658320 - DNA, 716 bp, Homo sapiens
ggcgcaagcgctatcctgagcaggatgcggttcgtggttgccttggttcctcctgaacgtcgcagcggcgggagccgtgccgctcttggacaccgaaagcgtcgaatcaagaagaagctggagtacggcgcttctgcaggaacacgtctccacccaccccagcttgagccaacggcctggaggctctaccaagtcgcatccggagccgcgagactccaaaagacagccctagcaagtcgagtgcggagtgcgcaagaccccagaagacaggccccaacaagtcgggtgcggaggctaagacccagaatgacagctcctaacaagctcggagtgtctggagagcgaacagacccgaaaagaggcagccactagcaagtcgaggttcggaggcgcagtaccacaaaaagacagcaactactaaggtcgcatccggagctgacagagctccaaagagacaagcactggcgaaatcgggtgcggaggcgcaaaccccagaagacaggcccaacaggtcggggtgcggagggcaaagacccaaaaagacgggcctagcaaagctcaggtccggaggcgcagaccgacaaaacgatgtccctaagtaaggtcgggtgcggacgggcagaccccgaaaagacggctccagcgagtcgggtgcggaggatcagacccccagaaagacgtccctaacaagtcgggtgcggagaagcagagtccag

SEQ ID NO: 658321 - DNA, 974 bp, Homo sapiens
gtaaacagccccgaatggagtgcccaggcgtgttcgccgcggaggcgccgttatcccgggcccgccggccctgagctcccggcggcgcagattggctcacagtggttgattgatcaaccccattggacgttggttctgtggtacaaatggagtacaggactcagtcgtcacggcctgagtgagagaagccttatttccaagatggagaagaagcggagcaacgaacatgaacagcctctcttcaggctgaaccacaaaaggccatggcgattcaacttttatttatgttgggcaagactgtaacgatggctgacttagtaatgttgcagcttctcagctgaacacacaaaacttcaactttctaatcaacgacgacaacacacagctgctgcatttgaatatatgcaatttctcactgatcatattcgcttgtgaccatgaagcttgtccaacattctggctgcttctgctcgtggtttccgctctgtggggaagaaaccatctggggcgaccgactggcacacagcacatcttgtgcaccaacgggcgcaatgtggcctgggctgttccccaacttgactttggcacgggtggacattcctcattcacgcagctggtcgggcacttctggaacttacttcactaggccgcgccgtctcccaccgggcgcttacctgctatcacagggcccgaaatcggcttaggaaaattgtcccggtgtacgttgccacagtgtgcccccgtgacaagcgatagtgcctggtgttaccacggtctcaccacacacacactactgggacaggacaacacttactttacaccctttcgcgacacaggcaagacttcccgattgccaagagttgtgaccgctatacccccgtataggtgaaaattatatagcgaaagagtgtgtaatatctccgcgacatctatcatcatcagtacgcgcgtagcaagtcaatacacaatgggtc

SEQ ID NO: 658322 - DNA, 541 bp, Homo sapiens
gtggcctcgggtggtctacgtagtgtgccgtgagctccagaaccctgtgtctgcagatacctgcaaatgatccacgtgggctcccttcaacggcaccagcactgcatccttctcccgtgacagacggacgagctcctcatgcttcctcttaaatgtttcctcttccctcttcctggttaagctgcacagagtgaagtttatccttctaaaatcctttaccctgaaaagacacacatatttatggaaggagcaagtgagatgaaagcaaagaccaggctggaaatgagcagaaacggtagaatcccccagaatccagtcccggtcatggaaggatggcacagagcacgcctcggggaagatgaaggactcgcgcacccgtgcgcggctcatggcctccagaatctggagctccccggctcggctctggagcttcactactccagctcggcgtaggtgggctctgccctctgcagactctctgcagcgattggcccgggtaccttcagagcctacagatctttgtgccgtagtataaccttaa

SEQ ID NO: 658323 - DNA, 135 bp, Homo sapiens
tagctcggtaccgcttctgcttctgccatttcaattaatgttcttcctaagtgataaggatgtagacttataagcaggctcttggtgaggagggtcttggtgaggagggtcttggtgaggggcagaagcaggaag

SEQ ID NO: 658324 - DNA, 136 bp, Homo sapiens
cagcacatctgcatctgcaccatcatgcatcactcacaggcatcttttttcgtccatcagccatgagtcagcccatgcttctctcacacacagcagactctctcacttttcttcaccagcgctcaatcatccaaca

SEQ ID NO: 658325 - DNA, 363 bp, Homo sapiens
cagctatgtcgtggtggctcacgcctgtactcctcagcacttttgagaggacaaagaggtgggcgggaatcacttgaggttagcgacgttcgagaccagtcctgggcagcatggcaaaaaccccagtctttacgaaagatgtaaaattggccgggtgttggtggtgtgtgcctgtagtcccagctattcggggggctaaggcgggagaattgcttgggccagggaggtggaggttgcagctggctgagatcgtaccactgtactacagcctgggcaacacagcgagactccatctcaaaaaaaaaacgaagtttttgatgcttccaaggtgccattaaaattggtcccgaagggttatctgga

SEQ ID NO: 658326 - DNA, 758 bp, Homo sapiens
gctgaagaacaaccgcaggtcgacattgttcgtgaaggctggcagtgactggggccaagcattggcgaactgccacattctcccagaagactgttcatggctactgctggctcaaggcgagtcaccttcacatgttaccacctgttgacaccaaaaggcggaccgagacagtgcaccaagctgtgcccaggggggcagactcccattcctgctgtatggcactgacagtgcacacagacaccaacaagattgaggacatttctggcacgcgcagctgctgtgccctcccaggtaccccaagctggcagctctgaaccctgcagctccaacacagcctgggcctgcgacactctctctgccacacacttttctgcctacactcccgcacctccccccacccagcacctcacctgccccctctggccccaagggcactcctgcacccacgcccccctgcacagcgcttctccacgcacacactctactctcacccatccccccctcccagcaacacaactggcactcacaacccactgcctgacaccaacctgaccgcctgctcctcctcaccccgccccctccccgcccctgcccccccccccctcccctgccctcccctccccccctgctccccccccttccccctcccccccctgcgctgctcccacctccccgcccctccccccccccacgcccttccccccccccctcggtccccgccccgccctcccccgcccccctcccccccccctccccgc

SEQ ID NO: 658327 - DNA, 373 bp, Homo sapiens
agggagagcaaacactttggtcataaaaggatatggaacacccaagtttttcacacaaagtttattgccctttcccaacaataatacctttgaaaacattccgagatgcactttcccatgacttaatatatattaaccgcgctcaaaatacatgtgcgggacagatattggtgcttaggctccagcagggaaacacaagaggcccagaccctggtggtgggaaacttattacactcctaggggcaggcaaacaaggggcaggcttgggagacccattacacgggcaggaaccccttttttcccacatttccttaaccccttggcccggcctttggattctttttttcaaatttgttaggaaccccccaggaac

SEQ ID NO: 658328 - DNA, 457 bp, Homo sapiens
tgaatatttacaagtagatttcagacaggaatactacagggtggtcacaggataacaaattctaggcagcagatttacatgacttgaggctgtgggctgttaagacgctgaaaaaccagggtgtggaccaagctggctaaggctgagtggacccaacgtggtgctggattggatggaggttttacctaggccctcattatatgctcattaacaaactaaatcacacacccgccagtgccatgacagttctgagaccagtgtttgatgtaaaaatggcaccacagttccaagaaatctccacctttacccaggaattttcatgaacattccactccttggttaaagaaacccatcaagatgaaaccccagaacccattattctctcttgggtatgcccaagctcccctttcttgagtgtgttctttttgctttgcaataaatctgttctttcacaaaa

SEQ ID NO: 658329 - DNA, 1053 bp, Homo sapiens
gcagtgatccattcatctaaactctgatgctacaaggcgcagtgctggaatacctttctacatacaggcactgttggcatctgaaccaaacgaaaggcagaatggatttgttgaaaataacaatgaaagcagttaactctctttggctgggacctacagatgacatacagcagtacagtcccccaggttcatgctttacacactactccttagagcattgctcagagatacgcgcctgggcagaaaatatcatcccttcactgtcgctgattggcagcctaacggcctgacacttcctgggctttaacactcacccggctctggcccagcagacgaaaaatacactccacacatatcatcctcccacctgccccttgcactccaccaacgcaactccacccgaacgcttcccacacggcgccacagcgactcgcaccacttcccaacacacccaactacgacactgacccgcgcacccgcacctcaccactacctcaggatcccaccccaagacaaacctctactaccctatactactattcctccagaaacccaggcaccgcgccacacctgtgaacgcaccactacctaataccgctcagaatccaagatgacataatgggcgaacgcaacccgcaagactaatatcccgtatcaactcccacacactgccacgtggctcaataaccttcgtatttaacacttcacaacagcgacacgattacgcgacagaacagaccttcccatcagactacctctacccacacagaaatagcggacccttcaggccaacgctcaccctctacacctggccctctcataatactcactaaattggaccaaaccccctattatgagaaatccaccccttgaccacaatctcactgcaatcgggcctggtcgagcattcagaactcaaaaccacatgacatcctttacatcaatctcccccccggcttgcccaccctcctcgctcctcgccgctcgaatgaccacattgttagtacccacaaccacattccgagcctatactcgcacactatcaaaactcca

SEQ ID NO: 658330 - DNA, 155 bp, Homo sapiens
tgagactccatctctaaacaaacaaacaaacaaaatagtaattctagtatcaggacagattggccccaatttagcaccattctaataagatctgctttatttaagaactgtttgattcacagtgctgacagagattatgatgcggaggcagggtc

SEQ ID NO: 658331 - DNA, 138 bp, Homo sapiens
  misc_feature (3)..(3): n is a, c, g, or t
tantcttgactcaggtcacacagctctttatggtgaagccccgtgaactatgcaatctgagctctaagtttggatatctaactgctctgctgtgttgctttcccattatatgcttaagctaactaattacgaaaaggg

SEQ ID NO: 658332 - DNA, 296 bp, Homo sapiens
tccagctcgcatttgagcggccagggccagggaccacgcctcggcagatgacgtgctttttatcgcagaggaccagttctgccatacggggcactctatggggccaggaacaatggccactttcggtgatagcagatggatctctcaccaactagatctcaggaactcaaactagacagagaaaccaaacatatttcatgccattctactcagtgcatgggattaatgagaaagggattcgacaaagaacgacagccattcattcagcaaatatttgagggtggctgcacatggtg

SEQ ID NO: 658333 - DNA, 305 bp, Homo sapiens
  misc_feature (76)..(76): n is a, c, g, or t
gtgtggggaggatgccggcagctcagggcacagtccagacctggggacacccgcgggcaaaagacaagtcacgagnagaagaagcggagagaaccaaggattttttcctggttggaaaaaacagagtcttaaaaatcctgtgggatgccagggagtcctgggcgctgatatctggtggcattaaggagtcaccatcaattattttaggcataaatacagaactggggttgggtggggtgtttggttcttatctttgagaatactttctgaagtgtttatggataaaataatatgatgtctggaaa

SEQ ID NO: 658334 - DNA, 260 bp, Homo sapiens
ttattttctttaaacaagaatcttccattttaagttcttaaacctatattttaaattactataagggacagaatgtttgcttgaaggaaaaaaataggagagatgtcaaggtcccaaaccaatttgttttcttcaaaatcaatggtaattggtgaaccctggtaaattattaatacacagtacacacacaagcgttcacatagggtcacacgcgaaaagggtggcacatttctagggatggggtgcactaccgagtggga

SEQ ID NO: 658335 - DNA, 314 bp, Homo sapiens
ctcacaaagctatcactatacaaatgatgacaagtgcacaatggaccaatgctcaagccagagagtgtgccaatgtaacagagcgtgacgaaggcagtcacctcctgggggcccaggtagggcacactgatcaggaccctttgaattataccctgaagaatgaatagagaatttttgagagggcccgaaacaagatatcgacgcacaacagaaacagagagcttactaggtcaagaactcaaattgaaatcctcccctgtcacacgcgacggcccttgaccacttcctgcctatagctatgggctgctgaacta

SEQ ID NO: 658336 - DNA, 907 bp, Homo sapiens
ggaacgtcaacttaagagcacaggggattagtgaggttatggttcttgccgcatccgacatttatttgaaacttgtattagtcaagcaacttaatgctaggctaagttgcagtgagtaataatccctagaccccagtgacagtgcagaaaaagaagggtttcatatgtggagtgtgatgcatgtcaatgggagtttcctccacctggtgactcaggtatccaggcacattcatctgtggaggtctgccatcttgacacgaggtcattcgcagaaggagagagggtgtagagtcctgccactttttaggtgctcctgacaaggatatcttcagcactcctgttcacattccctgtttccaaaacttatcctttaccgagtgcaactggcaaaaattctgggaagcattacaagttctctgttggctggaaaccttcataactacgtaatatggcccttaagccatacattttcatgggttcaccccggtatggctgacctcataaggcttatatcatttcaccttgtgatgtatcagctttattgtcatgaaaacgcaggaacctcgtttggggggagacaagcgtctttcctcattcgtccccacttgattttctttgaagatcttgttctttacatataagtgaatgttggtttacatgttgtgacccaacttttttcacatacaccaccccccggcacacccccccattggagtttcatataaaaccaaccgaggggggcgcggcggcggggaaaacgagtggggggtatcaaaagggctcatgtcataaattgaggggatatattcggggggcaaactctttttggtcgcggcagttactcggctaaaaccttaaatgggggtgacaaattgatatcgcgcgttgttgtccccatgtatttttg

SEQ ID NO: 658337 - DNA, 503 bp, Homo sapiens
ccatgttatgccggggggagaagaacggatctggtaatgtaattgtagtttaagaagattagggaagaagtcccgatatatgtccatttcctgccagtgaggctgcggatgagcagttgactccccagtcccatccctccggactgcttttcgctgtcctgggtctgtgctgttgcatggagttcctgggggaagcccgtggggacggggcatctggccagggctcactgctgttgacaggtgaataaagaacgtccggatttcctttgggtggacggtgatgatggggcctcctggtggcctcgagggagaggtggtgtcacctctgtggcggccaggccccgtcctccagctccagcggtgcagcatgctcaaatcccaggtccctgtgagcgagcgctcctccactggcaccacggaccccagcgcctgcagcacagcctccagattcactgttactggctgagacaggactgggtcctcgcccacggcaataaggtggg

SEQ ID NO: 658338 - DNA, 211 bp, Homo sapiens
aggaaatgttgaagaatgaagctgggtcctcatctctcaccttatacaaaaatcaactcaagatggatcaaagacttacatctaagacctgaaaccatagagttctagaggttacatcggaaaactcttctagacattgactgaggcaaagactgcgtgatcacgaccccaaaagcaatgcaccacatgtaaagataaatagatggccctc

SEQ ID NO: 658339 - DNA, 920 bp, Homo sapiens
aatcaatggttttacactggcagcgatcggaaacacctgcagataaaccctgtaccattccattattgagaccttaatgctcacggcctcggctgcttagaacgaatagtctgtgaaggtatctggtcgctcttgctcctatgaaatctagcaggctaccattgtcatttcttagggttcattcagttccttgtgcaagaacttcctccaggaacactattgctacaccgagcgtagtctacatgcgcatgactcgaacactttgtgcccttggttgctcatctgtaacttggacacgtatgcactcctcatcttggctgtactgtataccatgtgctgctgataatctgaagaaatgccactccctttaaggtgatgaggacacatcaggcatggaagcaagtaaactaatctctgtactgaagggatgatcttaacctgttccatgatactctacaacttcctctgcattatatacttttgcgaggatgttttccttgattgtttgttaattattaaaaagtctgtatgggcatgaacaacctactttaaggggaagatacgattgctggtctagctaatgtgatgctgtgataccttatggcactaaagcagagctgagtaatgcttaggcgttccatgtcggtttatttctccagactgggcggtagctgtgctctgtgcgactgttgttaccattgtgtgttagcctttcgtgtgggtctaagcgttggtttagcctgtcaagtccggacgccttaagttgaccaaatccttgtccttgatgtggtctgagccggccctgagggtcctgaaaagtttcggtcctcttgtggtccacctttttggccctgcccccgctggtgagatctgctgttctagccctgaaggtgctggccctgggggggcctccccgggtc

SEQ ID NO: 658340 - DNA, 159 bp, Homo sapiens
  misc_feature (61)..(61): n is a, c, g, or t
atctcaatttgctccagatgagctctttgacatctcaagatgcgatcacatgggccggatncagagaaatgtttcctggcagagcagctctctgcctcccacctctgtgctcccagctcacaatggaaccactatcccactacattccacagggggcgg

SEQ ID NO: 658341 - DNA, 133 bp, Homo sapiens
  misc_feature (98)..(98): n is a, c, g, or t
tagtactaggagtagttatagtatttgggtctatacgtattaggtctttaacccatattgaattaatttttgtagtataggtataagataaagggtcncaactatcattctacttagcctagtgaatatacca

SEQ ID NO: 658342 - DNA, 160 bp, Homo sapiens
ccgtgtgtcagagtctcacaagaataaaatatagaaggctacatggaggggttaaaaatacacaaaaaagtagttgaacaatctataaattttttatacttgaaatcatgattgagttgaaataaaaaagtgcatttcaatggctaaaaaaataatatcg

SEQ ID NO: 658343 - DNA, 1073 bp, Homo sapiens
ttgggattttactgaagttagttcgggcaatgctccattgacgtcctttatttcgagactgtggtggtcccctactactgtacagatcgtttcgggggccgattcgattctccgggtccatggacaaacctgtactagttaccattcaacctgccgtgcaggaatgttctgaacatctggcacgctaccaaccttttccaggtcacatcactgatgtctaatggtctacggctacgtgcaaccgttgctcctggttacagaggaaaaggtcccaacggagtggcacagatgctcggaagccccaccaaggggcctcgggccctcccctgcccctccgacaggctccgccctccctgacccgcagacagccatcgtgccctcccatgacccgccagcagcctctgcaccttccctgcggcactctggtcggttgatgctccttccgttcctcgggcatggtgccttggggggtaggtcgtgatgtgcactggacgaggaccacagagtacaagaaacttgtgacttcgtggacgggataaagaagttccggacggcatgttcatggtgttatcgaggacattgtccgcacagaccgctggacaaacacggcttgtcgctcccccaaccagtatccagtgatcgccagtgggcaccctgcatcgtcgctcgcctgtggtcctcccccagcactcttgccgctgcacgccagccatgccccaccatccctagccacacccctcaccctgctgtcctcccacggtctgcagacagatgtttgaagggcccatgccgtgcccagctccaatgcagacacatcaggcagtggccaggcccccacggtgcttctcagtggacaatgatgcctcctcctgggaagccttacctgcccagcccacgccgaccaccgggaggaagccgtgactgtcctttggctgcatctcccgaaccatggccaaggagggcttttctagtgggatgggcctgggcacgcggccctactcctgtcagtagccggcccacccaccagcaggcccccaacccccaggcaaaaatggctagaggacgggaggaga

SEQ ID NO: 658344 - DNA, 421 bp, Homo sapiens
gcgcaaattcccgggccagtgtttttctcatctgtaaaactgggtataattcgtgtaccatgactcaccaggtggtgctatgaggatgcagtcactgataaatgtaatttgctccatatggcaccttggtttattcaaaaacggtgtttttcaaacaatctacggtggcagatttgttacactaagtaattgggagagacagtggtgaacctaaaacaggcaaaaattttccttgcctttcatggaggcctggacattctgggataaggcacaaagcaaaaggcccgtttttaaaaactttaatttgggttaaaaaatctatctcattataagagcgaacgtggatgttatgttagcatctgctgtgtggccggacaggtttatattggaggacctaaaaaaaaaataaacacagaacaaa

SEQ ID NO: 658345 - DNA, 515 bp, Homo sapiens
tcttggaagcgggatgtcagcacaagagtgagttgaggatcaaggagaagcatctttcaagcccaccaccgaatagatgcgactatattgatgaattgtgcaagataaacatcaccacatataatgactgttaaaaaaaaggaaatcgaaaaagacttgccaactttctacattcctatattttaacccaaatttaagtattttgtggtgtatagagaaccattttaaatatccagaaggctttgtcttgtttgtttaaaatcgcattttaatttttcatcttggctttaagaaaaaaaaataaaacgaaataaaaacacatttgagcttgctatgttcacatttgaagttttaaaaagaagcagagttgttatgtgttaaatgtgagccttgatctgctttttggtctctgtaaatacatttgaccaattttgttctttattttgctaatgtttaaagatgttactggttttattgtaaagttgataatggtaaataaatgttggttccctaca

SEQ ID NO: 658346 - DNA, 601 bp, Homo sapiens
gaagctacggtgagaacatagccagtcccaaagacaagtttcaaagaaaagatgacagctagagattagctgggagtagtctttgacagtgcttatttgatactgtctctcagagttggcgataaaccaggtaatgtacaatggtcattaggtcgtcagatagctttaaagttgtgaccttctcgtacatgaatcttctacccagtttcctttcctttgtatgcgaaacatgaaatcctagaatgtatgagaagttcagacattaggcataaggaaactcgttgcaggctctctgtccagggctgcttcctgtcctggaggggccagtgagtcttaggtatgtcatttattctcacatttgtgttttgttacgaatcagtgaatggtcaataagctggcttatcttccatattaacaattatttcgatacttttaatcacatcttatccgagcccctcttgaaggctttgggaccccggtcgggcccacgaaaaaaggttctgagacaccgagggggcggcgggggccgatgctcctttgggacctcggctgtagcgggcccccaagaacctgggctgccctttgcgtggttgccaccgta

SEQ ID NO: 658347 - DNA, 696 bp, Homo sapiens
  misc_feature (419)..(419): n is a, c, g, or t
catggtggctcacgcctgtaatcctagcactttgggaggccgaggcgggtggatcacctgaggtcaggagatcgagaccagcctggccaacacggtaaagccccgtctctattaaaaatacaaaaactagccaggcgtggtggcaggcgcctgtaatccttgctactcaggaggctgaggcaggagaatcgcttgaacccaggaggtgaaggttgcagtgagctgagatcactgtcactatactctggcctgggtgacaaaagcaaaactccatctcaaaaaaaaaaaaaaaaaaaggcattacgacggttttccaaggattaagcctaataggtcttacgaagaaacaacaagccccacgggaagcgctgaattcgcggaccaatttttttacaccacaggagggacagcacattacnaacttttacccccacaaaggtattacccactgcggacatattcgaggccttggagaatttatgcaaaaacccatggcaggttaactataacgcgcttgtggtaacttcccaagtaacattttggggaagagcccacggggtgtgggagagtctccttatagagcctcgagggaagattggtatacactaggctttaggcagacattttgtgaagaaccccaattctgttacatacacattgtgttagaacctttcaacaaggacattggagtggtat

SEQ ID NO: 658348 - DNA, 103 bp, Homo sapiens
atcacatctgacaaatcaaataacccttccttcatatctttgggctgatacctaaaatttctgtatactgtaaaatacactgagtcaattctcaccattgatg

SEQ ID NO: 658349 - DNA, 149 bp, Homo sapiens
gcgcaggatctgtgggcaagggttagtgccagaattatctcatttcatcaagttataaaacttgaggtagtgcaactagatatacacttcttgaagacggaacatcttggtttgtttgttgttttatttttcgagacaaggtcttgctg

SEQ ID NO: 658350 - DNA, 333 bp, Homo sapiens
gagactgagtctcactctgtcacccaggctggagtgcagtggcaccatcttggcttgttgcaacctctgccacctgggttcaagcaattctcatgcctcagcctcccgagtagctgggactacaggcatgcaccaccactcctggctaatttttgcagtttcaccatcttggccaggctggtcttgaactcctgacctcgtgatccacccgcctcagcctcccaaagtgctgggattacaggtgtgagccaccatgcccatcttcttttctttatgataagttagtaatgaatttttaattgtcttttattcagaataaactatattataaag

SEQ ID NO: 658351 - DNA, 293 bp, Homo sapiens
ttttttcccctaaccccccccccccccttttttttaggggggggggggggggttcccaacctttttttttccttggcccctttagttttgggggaaaaaggggggtttttttaaccagggcttgggcaccccccccaagggaaggggaatttttttggggcccccttgggttttttttttggggggggcgggttttaggttttttttttttaaacccggcctttttttgggggaccccctccccccaaattttttccccgttttttggccccccttaaaaaggttttttggga

SEQ ID NO: 658352 - DNA, 217 bp, Homo sapiens
gctcgtactctagagtgatcccatgggcggtgaagagtccctgaaccagagggccagctgagccacgcaagagaaactgggagataatggcatgtttggtgttaagccactaaattttatggaataacttgttagagtagcaatacacaactaatatagttttcatccaaacgtggcacaatcattttgtctcatgcattgtttcaactcgtttttc

SEQ ID NO: 658353 - DNA, 993 bp, Homo sapiens
aggtgccacgtggtcagctccaccacagccgcggaggttggaagcgatgaacgacagcccaacacgagttgctgtcgcgccgccgagtgggccagggcaaagccacacagcgggatacgcgactttgggaaagacccgcagctggaaacgaccggcccgttggacaagaaccacagggccgggcccgcaccaggggagcgccgccccccgcgtaaacaagcggtcgccctgagcacgggggaccgtcccacaagccaagggcctgccccctgcagagcagcggccaccccaactgggacgaggcgccacaccagcccacacaagggggagcatacacgaggcacccgccccaccgtggcgcctcggcgggaacccgcccccagcatcaccaaaacgctggtacagatggcgcaaaccacccccagcccctcgtcagggacccggggtcacgcgcgcagaccccgacgcgaccccgagtggaatgccccaacatgcgcctctggcagacacacggtacaccgtatagggagagccgagtcggcaagcaaaggcagggtccttctccacacagaccccgccgaagaaaacaccaggctcgtcccctcgagcaacgggagtgtaacgcggagagaggctgtgggtcgaggatattcacgttagtaaaggagaagaagcggtgcaagtagtaaaagggagaggggactaaaccataatgttaacgatcaccccacaagttggctctagcctactcacacggcgacagatcatgttctgcgtctcagacccctcttgtagagattgtggaggtgattagcgccctgtagtgtcgtcatagtaggacaccccgtgtgggctctcttatagaaaccacctgggttggacttacgagctcttcaaaccactggaaaagtcttttggtagcaaggcgccccggcggtggcccatttccttgggcgggggtttgaaaaaaaggattccccgtctttcataaca

SEQ ID NO: 658354 - DNA, 1057 bp, Homo sapiens
  misc_feature (1033)..(1033): n is a, c, g, or t
gtttggtccgttgctttttttggtcctccttgttcatgtgtgctccgtttgcctcggcgtttgtcatgtttattatgtctgtccggcctgagtgtggggtgtcctgcagggcgcgttttccccttttttggtcgtggctgattttctttttccgcgtaggactgttgagttcgggcctggtaagttctggtcgatccagtgggggtgtcttcggacctccatggctctctacaggctgtcagggctttccgttgctgttcttcgcctagagagggagcttggcccattttggtctctattaggtcctcccttacattttacttttggctacgctgtaggctgacacttcctcagtccaggcgcccagcgagttttgagtcttagaatacaggatgcagtattcagtgtcacgtcgttcgtcttttttaaacgctgtgttagcggcctggtgcatgtcccgttcagagatgtatcccaaactgatcgtcgtggacattcgaaaacgctggtggtctggcgttctgttggcctccggtgaccttccccggtctccgaagttctgttgctgcggccacccggaatgccagtatgacagtctgtctcttcagccacaatttatgtttgcccctagagtgttgctgtgacttataacacttctttttcccatatgtcattcatttctcaagttctgaagagtagcagttaccatcgttagacgaccgttcccttacccctcccttagtcttgggttaagtcccagaatccgttgaatttgccgttcgctgatgacataaatactgtaatttctttgtgtggcacatgagactctctctactaaagcgtaagggctttacaaaaagcagagaccacatcatttaagcttcagcacttaagcccagagcctcacacacagcaggcaatccaataaatatattgttgactgatcaaaatttttttggtgccagtgtagagttgggcttgctgctgctgtcttcagcgtaagtcttgctttttcagctgggtttctcaattnttacatcctaggagtagtgcattt

SEQ ID NO: 658355 - DNA, 445 bp, Homo sapiens
caaaaaattagctggcgtggcctccagcacttgggaggccatggtaggagaatcactggagtccaggagttcaagaccagcctgggcaacgtagcaagaccttgtttctaaataaataaataataacttccttctatgcacaacctgctgttactgtgctaattatgtaacaggcttctgtagagccaaactgatttgaaaaactgtacttggctgttaaaggtatatttaaaaatacgaaattactcaaaatgttttgttgttttgttttgtattgttttgtagacagagtctagctctgtcacgcaggctggagtgcagcagcgtgatctcaagctcgctgcaacctccgctcgccggtttcaagcgattatcctgcttcagcctcccaagtagctgagtagagacgtgcgccagcacacgtgcctaatttgtatatatttag

SEQ ID NO: 658356 - DNA, 210 bp, Homo sapiens
gctagaagtgcgctatgacatgcgccgactttccgcacgggagatgcttttattttcggctccggaaacccgcaggtttgccaagacactgctgttgcataccactcccggcactctcaacgcctcgtatttacacgatgcaaccacaacagccgcacgcttaaaccctctccaactgccagtcgcgcgtgattggtatttcgaggcatg

SEQ ID NO: 658357 - DNA, 1230 bp, Homo sapiens
  misc_feature (35)..(35): n is a, c, g, or t
  misc_feature (396)..(396): n is a, c, g, or t
aagtgtccgtggtgatgagagaaggaagatgttgnttctctccaagaaaaagagttgtggagtgtatgtgtgccgcccgtggtgtaaatacgcacgccggtgaggggtgagagaagagaggagaactcacactgtggttcgccagttgagacgcaatagacgacccttgtgtctcgctacgctagagttggggcttcgcgtgtgtgtctctaagggtaagatgttgctcatgtagagtagggatagagtgtgtgatgagcgcgctcacagtggcgcacagtgagtgtccgaccctgtagctgtgtgatatagagcggtagtatgttgttagatattttggtgtgacgcgcggcgaggcacgtatcgctgtggttacatcacacgaggggggtatanagcagaggaggtgatgcgacgtatatctctcgtttggtgataggaaaacgtatatttggggttgtggtatgagaggggcatatactctttcgcgggagagaatagagccagcatttagatagttctggtgcgaatcagacgtttgggagaccctcacctctggggggtgtcgttcttgtacccccaactatgtggtgtgagagtaatatatatagtgttatgatagacccccgtggagagttacttataggagacaggggcacctcggatggactcgtggctgtgctgtgactctgtgtgggtacttgctggtgggggggaccagggggctcgctgtgtgggccaccccccgcgttgatgcacgcccgccgctgttcaccactttgtggcacttttgtcactgttgtttggcgtttactcctcttttctgatacttcacttcttgttttgtcggctcttgactcgtgtgttgtcacgcgatacccctgattgtagttgctcctcgggtgaggggtggtatattgtgtctggtagatatggatagtgtctgcgcccaatatatatattagaggtggggtctccacccagatttgatggacaccagaaaaagggggggtaagccccacagtgatagaataaagatagaaaatctcttatgtgttgagagatgcttcataggttagttggggaggaaaaaataggtttgtgtacattttgtgttagggaaattaacacccttgggcctttcccataattaaacataggaaaataattacttcgagcaattaactcgggaccgaaggtagagtagacgcgcccgtgtgttggtgtggt

SEQ ID NO: 658358 - DNA, 155 bp, Homo sapiens
  misc_feature (23)..(23): n is a, c, g, or t
  misc_feature (38)..(38): n is a, c, g, or t
  misc_feature (78)..(78): n is a, c, g, or t
caaagagaggctcggctgccggncacagactggatttnttgacatcaagtcccacgcgttcttccgcagcatagactnggacttgctggagaagaagcaggcgctccctccagtccagccacagatcacagacgactacggtctggacaacttta

SEQ ID NO: 658359 - DNA, 865 bp, Homo sapiens
  misc_feature (252)..(252): n is a, c, g, or t
tcatgaagggctggggttttgattgctacattgctggtcgttggcctgacattatgcaacatgaactttcccagacaacccttcaaccagccggctgggtcaaaacttgtagtcctcccagtgggcagatgatgccgggcccagtagggggatttggtacccatgatctcacccaccatgggacagcctcccagagcagagctagggccacacccttactactagtacccaacgatatatagctacagccanggggctaccctttatggccctatactacctactaccagcagacctaggtacagggagctacccacagcactagccgcctcaacacaagtaccctattacctaggtaccaggaccctagagacttaacctaggccctaggtaggtagagagataggggggaagcccttgaataccacctagcttactactcgctatattccccaggagaccccactacaggctaccccggcttgctagctagtttaataggagaaccagcccagtatatcccccacgaacagcagtagggcggaggtaggagggcactaccagatagccaacagcttgggaccccctggccaaggcaggtgggggctaccgggccccagacctacacccacaggcttgtgtagtacccatgtaggtgccatggacggaagtagaggtgaccggatgaccaggattgccatttctgttgtagaggcctcctgccaggaaaatgggttatccccgtgaagtgcacagggcatgactgaaagcgctatgaggctggagaacactgaagcttatggcggcttgggctggatctcttgctccagaccacgagatccactgtcaatccgaaggcagggca

SEQ ID NO: 658360 - DNA, 173 bp, Homo sapiens
aagtagaggaacgggtactgtgtcgctccagctctctcctgagtcgggtaactgcgtcgcctccagctctctctcttgagtccgggtaactgcatctgctcccagctctctcccctgacttggtcgctgtccccgtctcagtccccctgacttgggtccctgtctccatctca

SEQ ID NO: 658361 - DNA, 232 bp, Homo sapiens
ttttccccccccctttttagggggggggggacccccccccgcctttttttaaaaaccccaaatggtggccccctttttgggttccccaaacggggggccccccccctttggtaaaaatttggagggcaatttttccccccttcggggccccggggtttttttcccgggtgggttggttctttttagctttttggccccccccccgggggttttaattcaatttttttccccc

SEQ ID NO: 658362 - DNA, 179 bp, Homo sapiens
tatctgatcttttagctacgtccagccttagcccctaccccccaattaggagggcacgggcccctaagcaggtagtcagcccgactaaatcccctaaaagtcccactcctaaacacatccgtattactcgcatcaggagtatcaatcacctgagctcaccatagatcttaatgcattca

SEQ ID NO: 658363 - DNA, 1379 bp, Homo sapiens
  misc_feature (1210)..(1210): n is a, c, g, or t
atccatcttccctacccttcctgccaagccagggactaagcagcccagaagcccagctaactgcccatttccctgccatactgcttctgactggctgtcactctgcatccattcctagtggcactcaatcgcaaacctgctatccttcactttacctgtattataatcttcacccctgctaactggcttgggcaccacggcccacatccccttcctccacatctactactacatggcttggcaacctacaacgctcaaccaacggctgcgcctctcctcccttggccctgcagcagcactgcgcacacgcgcgctggactggcgcacttctgcctctcatgcgcgcatttccccctagccgccccctagcctgcacggagccacgacacgcacgcacacacccacaatcacttcatcacacatctcatctaacaccccagactgccaggggccaacagcaactcacccaacatccaagcgacaagcgaccagcgcacgtatggccttgccccagtcctcccacgactgtgcttgccccagctcgaccgcctcagtggtctgccactgatggactacatagctgcagaccaccagcacccaacatgcatgcacgccgcggcaaacttacacaaccctgggcccaccactaagcggacacacacaaacaccacacaacaacacaccacaccacaacacacaccacccccgcgcgaagaggcgacgcaacagccacctctccgaccaccacacgctctctacccaccccgcgccacgacgcagcgcggaacccaacaaaagagaacataatcaaacgcccgcgtcattcaccccccagacgacgcataatcccgcgtgcgacgcaacacacaccgagcaggcgggcgagcgaaaccaccaagaaaaaaagaggagacgagacgaaccgcccacaatcctcaccttccaccacccccagagccgcgccccccccgcagcgccccacgcccccacgcacctcacacccacaccaccaccgcccgcccacgccaacaccgcgcgccgcacaccccacacccccgcgccccaccacaccacgccctgcgaccgctacacctctccttccgctgcccctacgcaatcacacacaccgcaaccaccgacacacaagacacgcagacagagcaaagagcaacgagaagaaaggacaacgaccaccgaaagacaacgtggngagcaacgacaacacgcaacaccaccaactacacaccacaaacaccaaccaagaacgagacaaccagataaagacaacacgaacgcacacaagaacagagagcagcacacaaagcgcacgcctcatcacagagacaatgatgcacctacgacacggagagacaaaaacc

SEQ ID NO: 658364 - DNA, 955 bp, Homo sapiens
ggccatgttggggttgtgggtcgggtggccgctgctccggcctaccggggtccttgcagtgagtactcactcccttcagcgtcgtctgcccccagctcagctcttactgcgggtcgctccgacggcgtgtccatcctgtctagggtactatgcgggcatatatctccttcgcgaaaagcaggtgccgacaccgggctgcatctgtggcgggtcattgagccgcagttggtgggaacgtccagtctatgactcgagggactaccaccaattctaactgccctggaagtgcaaggcgaggagacgcagactgtttggaggtggcccagcgatttgggtgagagcaccagtaaggactattgctatggatggtacagaaggcttggttagaggccagaaagtactgcattctggtgcagcaatcaacagattcctgttggtcctgagactttgggcagaatcatgaatgtcattggagagcctattgatgaacagaggtcccatcaaaaccaaacaattgtgctcccattcatgctgaggctccagagttcactgcgaaatgagtgttgagcaggaaacttctggtgactgggtatccaaggttgtcgatctgtagctccctatgccaggggtggccaaattgggctttggtggtgcgggacttggcagactgttctggtcatggagttctcagcaatgtggcaagccggggtgtctcctgggtgccgggttgtgcaggggaccggaccgcgagtgttgtccgggccggggctggtgcccagggtaggaggccctaagagggcgcgttggtcatgtgttcccggtgccgctccggtggcgcagggttggtgtgatttacgcgggggtagtggtgtggccctccgggcgggggttggccttggtccgcggggtgtccgggctgttggcgcactaggcggattcctgggttagttttctg

SEQ ID NO: 658365 - DNA, 451 bp, Homo sapiens
agttcgacggagactctcctttatgtctgaattagtcgagcacagaaccgtccagttggcgtgcaagttcttcaggagtccccatgtcctcctcctccgtgatcgtccatcagggggcgtatccccattcatctgaacattctctccagctgagtacatattctttcttttgtcagaggatggaagactctaaggagggtctatcctagtagctggaacccattccccaggtggaaggacgatgactgcatctaggaactcatcagtaccagcaatcaggtcgtgcctgtctgaggcgtgataagcgatgtcatggaacacctcatcagacgtcagggtggtaatgggtctggcagtctcgtggtaggagtaggttttcccctgaggagctaagagaatgaaccagaagcttgtgggcacaggaacttcagtcagggcgcccagcatgaca

SEQ ID NO: 658366 - DNA, 416 bp, Homo sapiens
  misc_feature (341)..(341): n is a, c, g, or t
atcttatatgagagatacggtagttattgtgcaactacctgtggcattgcagatatcctgtgtacttatcacaccacagtggacaaggatctacacggctttggaagacatcttacatcaaggtgagaaacacaaacatcagaagtcaaacacgctgataaaagcgatccaactcacttataatcctgaggaatcatctaaacccaatatgatatgacgctgttactttgaagtccacagtgtgttgaagaaattatgaaatatgaagcctcgatttttacacatgactcaagtgttcgatatttgcaggaaatatataattcaaataatcaaccttgcgnagacacggtgcgcatccatgatatcactgtggaatggcagacattggccataagggagcttcaggcgcggctttt

SEQ ID NO: 658367 - DNA, 291 bp, Homo sapiens
tgagaacgaaaagaaagcaaatcacttctatgcatgcaactaagtaaaatactcagcttcaaatttcctagagtgtccagaccccccacctctcccctcgaatagcaaaaaagatagagggcttaggacaaattgacaaggtctggtcttctagaacctctaaccaaaaaattaggtaatatgctatatactaaatacaactaccccaagtttcctaccattaggtacatatataactatttactctgaatcaaagctttcacgatgatatgattctatatcttggattac

SEQ ID NO: 658368 - DNA, 135 bp, Homo sapiens
cacggcaggtgtactgattccctgtgacatcaccaccgtctggtaggtgatcaccagctgcaccacaggaagggcatagaagacagcaagggtggcaatgtgccagaagtagatctggtactttttccggcagaa

SEQ ID NO: 658369 - DNA, 328 bp, Homo sapiens
aggcttctaacctaacttacctagctctatcctaaactagcctagtcataaacttactgtagtctaacctaaccataattttaacttaagcctacccctagaataatattttaccttgtggggactaataaaattgccccggtttcttttctttttactcttcttgtgcggaacacaaacgaactgcaacgtgctcactggaggtggtgttagggcctgtccgagagaacccttccctggcgtggtgttcgggctggtcagagcggacccttcactggaggtgtgttagggctgttcagagagaacccctcactggagtgttttaggg

SEQ ID NO: 658370 - DNA, 131 bp, Homo sapiens
ggagctcggtaccgtcttgtgttgtgttccctaattggcttgtttgggtgatgttggggtttgtctccagccacatctcagaacctgagccaattaggggaaacacaaacacaagacaaggtagagccgag

SEQ ID NO: 658371 - DNA, 208 bp, Homo sapiens
ctcaaaaacaaaaacaaaaaaaacccaaccatctatgacacacttacagccaacctaatactgaatggggaaaagtggaaagcattacctgtgagaactagaacaagacaaggatgcctgttctcaccactcctcttcaacatagtactggaagtcctagccagaacattcagacaagggaaagaaagaaagggcatccaaactggtt

SEQ ID NO: 658372 - DNA, 239 bp, Homo sapiens
cccaaggcgtgaatacagactcaaaccatctagaggtgtatgatggtcccaaaaatgtaagatctagatatatctagatcaagaaggaagaatgaagaaagtgaaggatgtccagtgtctattaatttgccctaagagctagaacctcaggcttagcctaattatggacagtggagaagatgaaacattgaggcattcaagataactggaagtacattttggaaggaaggcccctggtg

SEQ ID NO: 658373 - DNA, 223 bp, Homo sapiens
cagagtcagctccctcagaccagtactactaccccttcttccgtcacctcttccccgggcgctctcagtacttgtgccacagtacaggagaccaggccctcctccatctttccttccccccaattccacaggcggccttgcaggccgctgctcatgccagtgtggacttcaagaatgttctggatttctacaagcagtgcaaggagataggttgagatcgacc

SEQ ID NO: 658374 - DNA, 251 bp, Homo sapiens
  misc_feature (107)..(107): n is a, c, g, or t
gatcagtttcactatctccaaagcatttgcatcatgaccttatacattcaatcccttttatgctggttccgttaagacccacccccacgcacaagactaaatgtagnttcccatatatttcagggtctctgtgtattaagctaactcagatgttttgaaagctttttctttaaacagaggtgaaatatctgtggctaaaaagtttgagatttgtgataactttgtagtcatgtaaaacttaagtgcttcat

SEQ ID NO: 658375 - DNA, 341 bp, Homo sapiens
  misc_feature (22)..(22): n is a, c, g, or t
  misc_feature (49)..(49): n is a, c, g, or t
  misc_feature (71)..(71): n is a, c, g, or t
  misc_feature (212)..(212): n is a, c, g, or t
  misc_feature (219)..(219): n is a, c, g, or t
  misc_feature (247)..(247): n is a, c, g, or t
  misc_feature (278)..(278): n is a, c, g, or t
  misc_feature (341)..(341): n is a, c, g, or t
aggaacgtcatcgttttgaaancgtcgcaataagacgcacacgtttgtntccgccgctgttgcttctaaangcctaaccaccttcagaaagttcgacctgtggcaaatgtggtaaccctgcccaagcgcaagagaaagtataatggggtgccaaggctaaaagacgaaataccaccgggaactggttcgaatgaaggcacctaaaaattgtntaccgcngattcaggcatgggttccgtgaaggaanaacactaaaccccagaagggcagctgttgcngcattccattcatcttaagaatgtcaacgttagtcctgccataaatgttctggttctaaaaan

SEQ ID NO: 658376 - DNA, 499 bp, Homo sapiens
gctcgaccggtatagggacttgacgaacttccccgtccagagtctctaatagggagctagagtttcaagacgactcaacgacaggtatggtcccatgaacgcctcttcccccccacggcaacagctccttctagtggacgacgaagaggacgccctgctcgaactggccgaattgctggagggcgaaggcttttgctgcttcaccgccacctccgtcaagctggcgctctcgcacttgacccatcatccggatatcgccctggtgatcaccgacctgcgcatgccggaagaaagcggcatgtcgctgaatcaacgtctgcgtgaacacacctcgcgccagactctgcccgtcatcgtcacgtccggccatgcgacatggacgatgtcagcgatatgctcaggctccaggtgctggacctgttccgtaaacccatctatcacgtgcgcttgctggaaaccctcaacaacctgtttccacagcccaggatgcatctggtca

SEQ ID NO: 658377 - DNA, 901 bp, Homo sapiens
tcccaaggccaaattgtttccagtcttttatttaaagatactttctccaataaacaattcagtggtatttcaggcaggactgtgggcagacaactcgttaacagatttacaacaactttacaaacctccctttcattcaagtggactaccaaaaattcagaagagccactataacaacccaagtgaaagttctttcactctgaagtgcttcgtgaaacgagggaaagagtttctagaaggtggagggtgtgcacaatttaacaattaagcaagtgtgtgtgttttacacagattttcacacagagccgacccgtgaactttcacaggtgaaagtttgaaagtgaaaatgtgagcaaagacatttataatcatagaaggactccaccaaatttcataaaaaatgtggaacaccacagagtgcactctttgtgtgaccagggtgtcgccaactctttcagggtgggcattcacgtgtgggaaagagactcccagacagtgtggcccgtgcaaccgcaccgcgtgggaatcagcgccaacaagcgaaacctgaggggagctcgaaggggtcaaccaaacaaagacagtactccgggggacatacagaggagggaacgataaaggccatcaaggggacggaaaaacaaatggacaacgagcggaaacaacaagaagcgacctatagaaaacacaacaaatgaggataaaacgcagtaaacacaaccaaagaggggaagaactgagggcccacaacgagagtggaaccaaaaaggcagagagaagtaaaaaaaaagactaagggaaaaatacacacaaacagcagcagaaagaaacgcccaaaaaaaagcgacacagctcaccaacaaaacaacctaagaaacgggggaaaaacgaggagacagct

SEQ ID NO: 658378 - DNA, 435 bp, Homo sapiens
gggtgggaagtgaggagcgtctctgcttggcccatcgtctgggatatgaggagcccctctgcctggctgccagtgtggaaagtgaggagcgtctctgcccgggcgcatcccatctaggaagcgagaagcgcctcttccccgccgccatcccatctaggaagtgaggagcgtctctgcccggccgcccatcgtctgagatgtggggagcacctctgccccaccgccctgtctgggatgtgaggagcgcctctgctgggccgcaaccctgtctgggaggtgaggagtgtctctgcccggccgctccgtctgagaagtgaggaaaccctctgcctggcaaccgccccgtctgagaagtgaggagcccctccgtctggcaaccaccccgtctgggaagtgaggagcgtctccgcccggcagccaccccgtcgggtggag

SEQ ID NO: 658379 - DNA, 451 bp, Homo sapiens
aagggatttctgcctgctccttctcttacactaaggtacatgtgcccacctaagtatcagccaagccaaggagaaaagccacaattaactgagcacttacttggtgccaggaacttgctcacaaacgatattaaaattttacagcaaccatgccagactaggtcttattttccttattttacagatgcagaacctgatgcccagcaaaggggaaaggatagcaggagccttgatccacccaggaagaggtgccagctggatcagcaagaggctggtggagaacaagaagctgctatgaaccaatctttagaaaacagcaggatctccgaggagagaaagaatttctctccagccaaaagcttcatgagatggaaggggatatcctatctcctatattgtatcctcatcatggtctcaataaacccacttggaagatgcccatgaaaaaaaa

SEQ ID NO: 658380 - DNA, 925 bp, Homo sapiens
ccgcattaactcattcatgtagtttattcaagtgatttatgtatttaaactaaatattgaaaatgttagtcaaattgtaggttagctatgtcaggtatttatatcagtctgtagtggattcccaaatttcaaaagctcttttaatggtaatggacaaacaataagcatatgcagaatcattcattgatgcaattttcatcaaggtggcaattgcatcgttaatctaactaaccagagcaagggtagaaccaagtttgtgttcaaatgttggccatttacttgtattgaccaaagtttggcagctctactaatattctgtgctcaggactaaaattgctgttaatttttcatataaaaatttaaccagtggctggtccattattatcccgtgctgacgtggggcacacaccatggggtggccatgttcctataacagagcacatctatattatagggcactctcatttccccatagtgggcagactggctcccctaactcacagtgacacccaattttaacacactttatacgaaggactcacatacactcgtccacatatacaggtaacagaaaaattacatccctattatcaccctatttgtttaattccttaaattttatctcctctacataatttgaccgtagcagtaaacagatttaattatgtctttcaaccacacttattaacctataacatgactcaccggccagaaaacaccccctgggggaaaccacgccacctaactgccacattgaaaagaacgcccaactaatttcaactccaacacacccagagggctgcggcaggcggcgcacaaaaacaagccactcaatggactaaccaaccctgcgaagcgaacaaagaacaagcgggcaacatcacgccacgccacacaacctaaaaccgcatggggacggacaccg

SEQ ID NO: 658381 - DNA, 449 bp, Homo sapiens
aagtcacacatgaaagaagccatgatcaagcttggttaccacatgctctgcttcctcatgtatctatatagtggtagcaactgcccttgctaatcaccgtaacttcggctgagaaagaagaggaagcgaaatccaagatgcagctcagttcatcaaagcctagcaggtcgcctcagctgccttttcatgcctgccacagaccacagtaggacaaaacctgacatggtatttgaagttaagagttaagaaagcttcctatagtagtatatcccatggcacttaccacattctatgatggtatcacaattagatgtatgcaactaatcactttctagattgtatgttcatggagggcagaatatgcccattcataattgaattttgttccttatgatcttggcacctaacacagtgcattgcacacaaacaataaatgattgatgactgta

SEQ ID NO: 658382 - DNA, 370 bp, Homo sapiens
cggcccaactgtggtctcagctggagtggtacgtgagcaaacaccacagttgagagccattggtctacacttgtggaaatgtttgagggtgagagtgtcgagcttgggtccctgctgtacccgtttatgagcaatgctgtcttggaaaattaatactactccaggggcctcagttttctcatctataaaatggagataaatgagatacactttcataggaaggttatatgggatttactgagataataagacagtacatggaaaatgctgggcatagcatttatttatttttatgttttttaaagatggagtcttactctgttgcccaggctggagtgcagtggcatgatctctgctcactgcaacctcc

SEQ ID NO: 658383 - DNA, 370 bp, Homo sapiens
cggcacgagggctggaaaagagaactccatctcaggacccatggtttgccctggagagcttagcactgggctgagcacaccgtgtgggattcaacgtgctaaaatgcagaacctgatgcccagcaaaggggaaaggatagcaggagccttgatccacccaggaagaggtgccagctggatcagcaagaggctggtggagaacaagaagctgctatgaaccaatctttagaaaacagcaggatctccgaggagagaaagaatttctctccagccaaaagcttcatgagatggaaggggatatcctatctcctatattgtatcctcatcatggtctcaataaacccacttggaagatgcccatgaaaaaaaa

SEQ ID NO: 658384 - DNA, 444 bp, Homo sapiens
caacacataggaagggtcagtgggcatggttctatccctattctcagagcatgccagtggcaacctgtgctcagatctggaagacaatggacccacgttaggtgtgacacgtacacataactgtgcagcacatgccgggaggtgatcagtcggacatcttaatttgaaccacgtatatctgggtagctacaaaattcctcagggaatttcattttgcaggcatgtctctgagcttctataacctgctcaaggtcattgtcatctttgtgtttagctcatccaaaggtgttaccctggtttcaatgaacctaacctcattctttgtgtcttcagtgttggcttccagaatggtaatcgaattcctgcagcccgggggatccactagttctagagcggccgccaccgcgttggaagcctccagcttttgttccctttagtgagggt

SEQ ID NO: 658385 - DNA, 1684 bp, Homo sapiens
  misc_feature (282)..(282): n is a, c, g, or t
  misc_feature (1608)..(1608): n is a, c, g, or t
  misc_feature (1684)..(1684): n is a, c, g, or t
gatgagtactgacgctggtggatgtgcctgccgtgtcccgcccgacgcttcccacgtgtgccggtacacatcggatgccgtggtcttgctcctggttagctccgggtgggtccgtgctaccgtgttgtcggtggagctgcgggggagtcgcatcgagcgtagcttggcggactcgcattccaaccactgcatgataatcccgatagtcaacactgcgagtgtgcagagcaggtcaacggcagagactggcagcctgtcatgtgtggcactcagcttaatcgnaatgatgcgtgccccagtcgccattgttgtggtgttcgaagaagcgtacgcctttcggtactccactgaccccgagctagaagtgtcacccttcgtacttagagtgcgagactacgagaaggtgacgccccatttggcgcggcacgcagttggctaaacccataccgtggatatctctatggaaaggtccgcgactacccatcacgaggaaagggaacatagcgtagcgtctccgccaattctacgacaattccctgttggcatagatacatagcgagggacttgggattgcgcttgtgccggccaatagcgctaaactagattgggtagaatagaactctctcggagtgaaaacgagcggagcacccatggagcccactggaatcttgaaagactttcggttggcacgcgaacgagcgaacggtagcaaccgttgctcaatggtgagcccgattgagcataggaccgctttcattgcctcgcacatgattgggctattcacgcggtcctcaattgccttgccaagaatgcgcgctcgaccgaacgctttcggaggggggaccactaccgattgacgccgatattcgagcgccattggttgaatgttgcgcaccacggggcgtcttttcaccaacgtcactaaatacaagtacaaaccccacgtagaagaatttgggtctcctacaccaaagaataggggacactccgagggcttgcctacctataccagacttgtgccctacgaactcaacattggattcgtggattgcgcccccgttcaaggggacttatggaaggctcggtcgtgtccctgatccacgaattaatacacaacggatggcccaccaacggcacgaaaaaagttcgagatggctttgaactccatgcatcaacgtgagcaggctctagggtccatgaggaaggtccaatgcgtatgcgtgaacaccgttggggccccacctgttcacacctttattacgaggggtttttaggccctcggtgcatccccagcatgtgggcaccctgtcccaaagggttagggtcctgggaaaagccattgcctgaaattatattaaaccccttccttgagagcagggataacgtgcggcacaagtgtcggtcactgtcgcagggagaaaagctcaggttgacagtgtgtgcccccttgcctaacgtcaagacagcattttctgaggcccccatgaggaactcattgggtcgacccatgggctgaggagacatttggacctcgttcgtcaccttgacagccctttgtggactacaaaccggttaccacgatcacaggttgagttgtgtacctctacnagcatggattagccactcgatcacggggcaaatttgctcttagcggcaccgtgcaccgtgtgaaaacctgacactn

SEQ ID NO: 658386 - DNA, 206 bp, Homo sapiens
aagctatacaggcacagtatagcgagacaaagcttcactacgcgcccgttaatctgcacctccagtagagacgaggtaacatcatattaggtcacggccggtctcgagctatctgacctcaggtgagccacccgccttggcctcccaaagtaaataaataaatgggtgagacagagtcacaaacggagcccaatggcacgccgact

SEQ ID NO: 658387 - DNA, 472 bp, Homo sapiens
ggcacgaggttttaaagtgtgtgctttttgcctttttctccttcttagcatgctttttgtaagttatacatgctcactgtagaaaatccagaaagtcacccagtaaaaagcctaaatttttccacaactcggaagacaactgtgaacttccacttaatctttacgttatgtatgtgtgttttcgtattatacccttttttcatacttttcatactgctttgatacttaatgttatgtcatcagcatttcccaagtttagacagtcgtgaaacgtaacttataaaggttatgtaaccttccatcacatggagatgccataatttatgtaaccaaactcccactactggccatttatagtatttccttttcctctttccttttcttcttcccttcctcctctcctttcctccttccttctttcttttctgcctttggcttttaaaagaatcctacaataaacaatttgtacgta

SEQ ID NO: 658388 - DNA, 157 bp, Homo sapiens
tctctccacactggacaacattttccacttttaaaaaatatcttctcacgcctgtaatcccagcactttgggaggcaaggttggcagatcatgaggtcaggagttcgagactagcctggccagcatggtgaatccccatctctactaaaaatacaca

SEQ ID NO: 658389 - DNA, 217 bp, Homo sapiens
ctccctctgttatagatcgtgagtctgtgagatggtgagatgagatcgtgagtcagagatgagatgagatcgtgagtgagtcagtgagtgagatcatgagatcgtgcgttagtgcgtctgtgacgtgaactcgtgagtgagtctgtgagtgagatcatgagattgtgagatcatgagtgagatcgtgagttagtgagtctgtgactcaggtggtgtg

SEQ ID NO: 658390 - DNA, 197 bp, Homo sapiens
atggcttcccagcctgaattctagccgacgtgcaacgacgacctgacagcaatccttctgaagctattccaaacaatagaaaaagagggactcctccctaactcattttacgaggccagagttatcctgataccaaaacctggcagagacacaaccaaaaaagaaaatttcagaccaatatccctgatgaacatcga

SEQ ID NO: 658391 - DNA, 854 bp, Homo sapiens
actgatcgatcaggtaccactttgctgtagtgaactcccagggtgcctttgaggctgctgggttcctcctgacctgatcatctctataacttgatcatccgatgctactcagatgatagtgggaatgtggaggttttgacgagcttcagtcagtctgcttggatcaggtgtggtaactgccgatgtttcccgtctgcctgttcgaaaattctcttctggaggagacatggtctactgggacatacattccagtgtggaacaatccgaggaggttggtgtgcacgcttgacttatggtatttccctgatactgaatggcctggagagcctgtgaccatcaaactggctagagtactaggagtccaccttgtaaatgcctactggtctcttcgctatgggggtctgatcacttggtctgctgttcacctctcattttgctgcgagggcgcctgcgtgaacccataagagccttttagtctcttcctcgacggtccctttgtttaggcccaagcgcttcgtcaatctaatccaggggctcgcgaatttttgcaccgtcgcccgtggatgttcccccgtgggatcctacggagatcatcgtaagccagctcgttgtccacacgcggggtcctccgcctactattcacgaaaccaatgggaccttgcatcatgagccggatctcccgtttgagcgcgtcatcaccccattggtaacctttgtgtgcgaacggccctacgggacgtgtgttgaattgccttccgggtggctcgccggagtgggtcgctcctcctcatggttctggggtagggttggagtctcgaagtcgtcgtgcagggccctgggaattgcccgtttct

SEQ ID NO: 658392 - DNA, 374 bp, Homo sapiens
acctggtcagtacttctgtgcctatctcatttaaatcagaacaatcccatgagctcggtacatctttcatgtcaggttacagatactcatctgcgggtcacatgaccagtaagccatcccagtggggcttgaatgctgattgttgggtgcccaattcatgctttaacccatagtacatactctttgacagaaatgcacgttgttactggcttttttgctttgctttttccttaaatcacatcagaactggtttttgctttttccttaaatcacatcagaactggtttttgcttagtaatttaggctccatgacctgaagattgtcttttcttatttttatgagttgaggttttgagtgagagggaaatacaacc

SEQ ID NO: 658393 - DNA, 263 bp, Homo sapiens
acaatcgagctcggtaccgagattcggggaggcactgccagttggaagagaaaaaaattgccgggtgtggtggctcacgtctgtaatcctaacacttcaggaggctgaggtgggcaggtcacctgaggtcgggagtggagaccagcctgaccaacatggagaaaccccatctctactaaaaaaattaaaaattagccaggcataatggctcatgcctgtaatcccagctgaggcagaagaatcgcttgaacccaggagccggg

SEQ ID NO: 658394 - DNA, 1143 bp, Homo sapiens
tggaaaaagccagctgatcttaattggctcctggggggcagggggctcaggagctctgtgagggggcgggtccgtttctctctctttcaccatctcacaggcttctgtggctgtgcgcaggatgtggcgctgtggccctgggggattggcttgccagtgcgcaggataggggcggaactggtcctgggggactcagtggtgtctgagtgctgcgtgagcggtggcgcgaagacattctgggtgagaggggggctccgacaccatataggagggtggaaggcttctccgggggccgagattcttcgcggtataagtgagccaccacagagaaacctttgtgccgtggggaagaggccggtatccacaagcgcccaagaggcctggggcgggggaaaatacagaccgcgataggaaaaggcggaagaggaaaatggggggggactcttaaaaggtaaaatggggggctacaggtgggcgtgaaagggttctgagtataattccctcctgggggatcaggagaaaattgggagcgaatgttcccagggagagacacatccctattgggaaattggcggcaaaacttgggggggggggggtccccttcccggaaaggggggaaacctgagaagaaggcaggaaatggggcaaaggccgggtggcgagggtggggccctaagacccggggaaaagccccggaaaacaacagggggggggagggcctatccaagaacacagaaaccttttcccaaagagagggcctgaagggaaattaccttctaaagaatatttctgtgcgcagagaaaaatatctataataccctgaaaatccaggttcctgggccaaagaggaaatccctacaaaatggggggctagatttgggatattcccccacggggggccccacgggggaaaattcccaaatccgaggaaggtttcacaccccaaggggagtcgccgaaatagtggacaccgggaataacggcgggaaaacacagagaagtccccaaggggggaggatacccccccgggggaacggggaaaagctcgagacgccggatggcccgggataagccagaaatttcggggcccccaaaggagaacgcgatgggggaaaaatgggctcccacacgggacccccaggt

SEQ ID NO: 658395 - DNA, 1355 bp, Homo sapiens
aggttcctaaagatcctgctgtttgccttgtgtgtggtactttctgtactgcctgaacaggacttgtgctgcaaggcaacaaagttactgctgaacttgtgtacctggcacctctacagaaacctggtggctgcacggcaacacggctatcttaccccttttggactcaatggcattcagcgtaacatatattcattcaattccgaggtgtacacctgctttcttgccttctgggggttatccgtgtaattctgcgatgctcatggagaggaagaccgggaatcttaagccgaggccaaaaccttctctaacattctcgctaaacgcgaaccgataccaacagttctcgacgccacaccaccagctgcgcatttccctcactaccttttgcgatcacattcaatctacaaccgaatgggcgtccacagtctacaactggcacctgttgacctctccatctccaccatacactaccaaccacataccctctcttcccccatctcatcgtcccccccccaccaccccacctcctcaaccctctctccttccacaccatctcatccctaacccactcgtatcacacccccacacatcatcacacccaccccccactcaccacttacacactatcttctcatctaccctacactccctctccccatatacacaacacctcccatccactctccctccacctaacacatacacacattctccccccgatcctctccctaccccactaacactcttcacattcctctcaaccaccacacactactcaacaactgatcacttacacaccatgtgcccccttctccatttatcctgcgcacttttataactcaaacacctacttaatctaccaccaaacagcaacctaacacactaccaacttactcacaacataacttactcctctcgcatctctctgttcgtactcatcacacacctactcaactattgcttgtccactccatcacataatattaaaacccactgggtcgggcagcacacgagacaagctagtcggtcgcaacaccgatcagatgacgccgcgactggtacgagtgtacggtgacagagcgttggagccagtgctgcggcgcttgggccgctcgaccggtcactagtgttgagtgatgtgagttgcgagcgaatcgatgagctgaactgacagacctgcagacaccgaaagcaaactccacgacttgcgcggcgcagctgcacgcgtccgtgtaactccgacagtgacgacatctcagtggccaggtccacatgtgccgaacgcagagcagaggaagcggacaagcacaccgaggtcacgctgagcgcagcatagtaactgacaccaagtg

SEQ ID NO: 658396 - DNA, 910 bp, Homo sapiens
  misc_feature (910)..(910): n is a, c, g, or t
caaagtgatcatttgaaaaagagatatccacatcttcaagcccatataaaggatagaagctgcacagggcagctttacttactccagcaccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacataatgtcggtgctggaggctgtgcaaaggctgggctcctgggcatcttgggaatttcaatctgtgcagacattcatgtttaggatgattagccctcttgttttatcttttcaaagaaatacatccttggtttacactcaaaagtcaaattaaattctttcccaatgccccaactaattttgagattcagtcagaaaatataaatgctgtatttctacccagaaacagcaccgcttcccactattatgattgccttttacctcacacatcgcgcgtccctgcggcgggacgcgggtgagataaagacatgtgacgtccactaggataacn

SEQ ID NO: 658397 - DNA, 345 bp, Homo sapiens
aagctcccaacaagactaatttggagaaaagatatcacaacttatctttttcttgcactgttgaaatctatttggctaagtgctggtatatatatttttacttaaggggaggatgtctcactaatgtggtctacggcggggcttgaaaccctgagttcaagtgatccacctggcttaacctcccaagagttctgggattacaggcttgagccattggccccagtctggactttccttaataatctgtcttctttataatagccaaccaaagtggggtatgaatcaagtagtgtcagtcagagatgatgatgagtggagagtggagacaaaaaatgtggataatct

SEQ ID NO: 658398 - DNA, 804 bp, Homo sapiens
caaagtgatcatttgaaaaagagatatccacatcttcaagcccatataaaggatagaagctgcacagggcagctttacttactccagcaccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgactataaacatggctacattgcatccagggtgctctcccgaagagcctgctttatcctgaagatggaccatcagaacatccctcctctgaacaatctccaatggtacatctatgagaaacaggctctggacaacatgttctccagcaaatacacctgggtcaagtacaaccctctggagtctctgatcaaagacgtggattggttcctgcttgggtcacccattgagaaactctgcaaacatatccctttgtataagggggaagtggttgaaaacacacgtgagtaccaataagtcattcactcaccaaatattttctgaaagctactatgtgccaggtgctctgttgggtgccaagtgaaatgcaaataaagggaacagtactcagttcagtttgctttgggaattaattacatgccatgtgtgtaaattgtgctaaattttaggaatacagaaatgaattaaacgtctccagggaacacatagtctagtgaagaagctgac

SEQ ID NO: 658399 - DNA, 145 bp, Homo sapiens
tacgatacactcgagctcggtaccggccggtatgaatgtcggccgtgtagataagccacagcaacaggggctggcgggggctgccagtgggaaacagtcaccagcaaagtgtaataatcctattaattaacttttttttttttct

SEQ ID NO: 658400 - DNA, 501 bp, Homo sapiens
  misc_feature (314)..(314): n is a, c, g, or t
ggctcaccataacctccgcctcccgggttcaagtgattctcctgcctcagcctcccgagtagctgggattacaggtgcatgccaccatgcctggctaatttttgtatttttagtagagatggggtttcaccatgttggtcaggctggtcttgaactcctgacctcatgatccgcccacctcggcctcccaaaagtgctgggattgcaggcgtgagccactgacccagccaaaataatttctgatatatttaaattactccaagtatgatcttcagaggacaagattatatgactgtgggaaaaacttccctttnttttccgtttaaaagaaagcccttaaattttggtacgacactttcgacactacataactccaatttttgtcaacggaaaactttctttccttggcgagaccgatgaaaagcaaagcaattctttctttttaggaaacttgggttaaaggattatgaggataatacgggggtttttatctatgttggg

SEQ ID NO: 658401 - DNA, 1029 bp, Homo sapiens
agatttatctctgacttctcttttctgttccactggtctatgtgtctgtttttatgtaagtgccatgctgttttggttactatagctctgtagtataatttgaagtcaggtaacatgattcctccagttttgttctttttgcttagaatagctttggttattctgggtattctgtagttccatataaattttaggattgttttttctatttctgtgaagaatatcattgttattttgatagggattgttttgaatctgtagatagatagctttggatagtatggacctttttttttttttttttttccctttgggaaatagagtttggtccttctgtgtgaccccagggtcgggcgtgtcgcctcgggacaattaatactcaggtccaattcgcacactctccaactctcccaaggggcccaaggcaattctctttcccacttgcagagcttcaccagagagtaacgctggggaacttggaagcgcataaacgccaacacaaggggccgcagagataacaacgtccggcggaatctcagaagcaagcgaaacaccaggcggtattcggccccccacggatcgagaagccggagcgccgtgagcaccaccgacacctgccgtgggccacccaaggggggtaaccccgcagccacacaccgacagagacgtcccacacaaagaagtggccgacggaaccacaacaccacgcgaggtatttaaccacccacacgctggccgatctagtggggcggaccaaaacaacaaagatgccgagacaacaagaacaccactgggagacacccaccgggggcgcaccaaaatagcgaggcaggaggacacccatggtacgggctgcacgaggagaggtgcacaaacacgcacacccacctataaggcgaggccaaagaaaaaacggggggagccactagcaccacaacaaaagcaatggcgccccaaccggagcaggcagtgccacccaccacaccccaccagcgggcggagcacagcagggcacctagcaccaccgct

SEQ ID NO: 658402 - DNA, 408 bp, Homo sapiens
caaagtgatcatttgaaaaagagatatccacatcttcaagcccatataaaggatagaagctgcacagggcagctttacttactccagcaccttcctctcccaggcaaaatgaaaatacttgtggcatttctggtggtgctgaccatctttgggatacaatctcatggatacgaggtttttaacatcatcagcccaagcaacaatggtggcaatgttcaggagacagtgacaattgataatgaaaaaaataccgccatcattaacatccatgcaggatcatgctcttctaccacaatttttgatcagagactaccagagggttgtacttgacccaaggtgtattttgctggagtcacatgttagtccagcagcctgtattctcatacgatgtaccatctggcagattgt

SEQ ID NO: 658403 - DNA, 674 bp, Homo sapiens
cgttgtagcctctacagcactgcaagatccccgagctgacagtcgcaggccagaattcgtgttagagtggcagctcttcttctgccagctcatagcacgcttcgtccactacatcaacatctacaagacagttgtggtggtatccacacttggcagccaaccatagacaaaaccctcactttgggatcgcctgacatggatgaacgaccgagattgtctagcactaagctcgtgctaccggctcgctcacatgacgtgcgaggcttgaaatggttgccctgtacgtcgaggtagagctgtctacagaagagcgaagaaggagtatccctgtcctgaacggcggccacgaactggcagtccctggtgacggacggacttcatcagacgatccggcgttgtggacgaggagcgcgatgggaaggtcggctggcgttctcccaatctggtcactcatacgttggggagactctcaatgtacattatagctgcctcacgactgtgctagcgctcccaagagtattatctgggtgggtgaaagctgccagtacgcagaggcgcgtaggcccggggcatctctgtcgaaggctacccggcgaagtatcctgtacgtctcatggaatccctcaagcgaagcctgcactgggagaggctctgcctagggtggcgggcgagcc

SEQ ID NO: 658404 - DNA, 319 bp, Homo sapiens
cccttaattttttgaggccgtgggggaaaaaacgcctgcaggaattcccccacaaaggccccgggaggagtgaaatgtggatgttgcttttgcccctcacgggggcatttgagtccagctccccccaaaatgaggtgcagccccccagaaagagctttgcccgtccccaagtaaccagggcccagcctccagggccccaaatccggccagcctttccccggtttgggtcctgccctctaacactcggctttgctggtcatgggaaaaacaaaattgctcctgcatgcaactaattcaataaaactgttttgtgagctga

SEQ ID NO: 658405 - DNA, 100 bp, Homo sapiens
atccacccacctcggctcccaaagtgctgggattacaggtgtgagccacaaagcccggcccattttcttcctctttggaggtaatggatttgtttggaga

SEQ ID NO: 658406 - DNA, 680 bp, Homo sapiens
  misc_feature (24)..(24): n is a, c, g, or t
  misc_feature (57)..(57): n is a, c, g, or t
  misc_feature (135)..(135): n is a, c, g, or t
  misc_feature (137)..(137): n is a, c, g, or t
  misc_feature (139)..(140): n is a, c, g, or t
  misc_feature (149)..(149): n is a, c, g, or t
  misc_feature (154)..(154): n is a, c, g, or t
  misc_feature (167)..(167): n is a, c, g, or t
  misc_feature (172)..(173): n is a, c, g, or t
  misc_feature (187)..(188): n is a, c, g, or t
  misc_feature (210)..(210): n is a, c, g, or t
  misc_feature (214)..(214): n is a, c, g, or t
  misc_feature (227)..(227): n is a, c, g, or t
  misc_feature (229)..(230): n is a, c, g, or t
  misc_feature (232)..(232): n is a, c, g, or t
  misc_feature (235)..(235): n is a, c, g, or t
  misc_feature (239)..(240): n is a, c, g, or t
  misc_feature (244)..(244): n is a, c, g, or t
  misc_feature (248)..(249): n is a, c, g, or t
  misc_feature (252)..(256): n is a, c, g, or t
  misc_feature (258)..(258): n is a, c, g, or t
  misc_feature (264)..(264): n is a, c, g, or t
  misc_feature (266)..(268): n is a, c, g, or t
  misc_feature (271)..(271): n is a, c, g, or t
  misc_feature (278)..(278): n is a, c, g, or t
  misc_feature (293)..(293): n is a, c, g, or t
  misc_feature (296)..(296): n is a, c, g, or t
  misc_feature (309)..(309): n is a, c, g, or t
  misc_feature (317)..(318): n is a, c, g, or t
  misc_feature (332)..(332): n is a, c, g, or t
  misc_feature (359)..(359): n is a, c, g, or t
  misc_feature (362)..(362): n is a, c, g, or t
  misc_feature (367)..(368): n is a, c, g, or t
  misc_feature (372)..(372): n is a, c, g, or t
  misc_feature (383)..(383): n is a, c, g, or t
  misc_feature (388)..(389): n is a, c, g, or t
  misc_feature (397)..(398): n is a, c, g, or t
  misc_feature (418)..(419): n is a, c, g, or t
  misc_feature (423)..(423): n is a, c, g, or t
  misc_feature (431)..(431): n is a, c, g, or t
  misc_feature (450)..(450): n is a, c, g, or t
  misc_feature (473)..(473): n is a, c, g, or t
  misc_feature (488)..(488): n is a, c, g, or t
  misc_feature (518)..(519): n is a, c, g, or t
  misc_feature (522)..(522): n is a, c, g, or t
  misc_feature (531)..(531): n is a, c, g, or t
  misc_feature (562)..(562): n is a, c, g, or t
  misc_feature (619)..(619): n is a, c, g, or t
  misc_feature (647)..(647): n is a, c, g, or t
gacatttaataaaatatagttgtnttatagccatgctcccatttttgatgaaagctngttagcaaatcctaatgttagtttaatactttaaaaatgcataacagatattcagtcagcattataaaacctttaagncngnnggctgtccngcagnatagacagagggntcatnntcacttatgtctgnntcttcatctactccttcaatanccgntttcttccctttncnncnggntacnnttgntccnntcnnnnntnccccgngnnnggnccagttnccaaaatagtaagcngcnctgaagaaccagnacttgtgnngggataggtatgtncgggtaacagtacactgatcttcaggngcntctgnntcanatctctttggnacagnnagggttgnnttgcctttatgattatgagnngttntattagtntctattaagtaattttggnttccatacataacatattggggngcaagactataaatnatgtggctagtgtgaaggacaattagcagnngtntcatgcagngaaaaaggagtgcttggggcctggttctacntcttctgattttatataatctaatccaaaagaaccatatgccaatatttcgaattcntgccattgaagttaaaataaagtacatnataataattgttataagaatataatcaagaggg

SEQ ID NO: 658407 - DNA, 112 bp, Homo sapiens
gcgcggtgacttagaggatcctgactgagaaaaggttatgagagtaggacacagtagactaccaggaggcaatgtcttcggtccggtggggatccggtggcatcgataaaca

SEQ ID NO: 658408 - DNA, 814 bp, Homo sapiens
  misc_feature (171)..(171): n is a, c, g, or t
  misc_feature (656)..(656): n is a, c, g, or t
  misc_feature (691)..(691): n is a, c, g, or t
ctcatgggcctcactctgccccagttggaaggccctaagccatgtgtcctggccctcaggctctaggggaagaggttttgggcccggaacttgagtctctccctggcctggaccccctgtattaggagtgccctcccttgctctgccgctgtctggttattgggctttagncccaggtaggaccattcccagaaggggctttctctgtaaactcccagagcccccctggggacaagaggaaccagcagtatagccacgcgcccttgttctctccacatgcccctcttaaggcgaacttgggtccacactccggccacactctgttaacgcccctccacggtttttctcccacggttccacactaaaataagggcacccaagaggcgtctgttgcgccactcgccactttctccttttgccccggcggagaagtctgactctgaaggtgacaccacgctaattatgcaatttgaaaaaagggaagagtgtttcttccacgctgccacaatgtgggccactccctcggaatatgggttctttgggagaccacaagaaccacgcgaccacttatgttggcgacaaattgtgaagaatgtctgaaaaaacgttctgaactttttaccttaatactccccgatcttcacgtcttcttggtntttgaccacagagtgtacccactggtgaatgtaangactgttgacccttggggtatggactgggtgaacgggtactaccacggaactctttgtatctatctctgccacttttctgtaaatctagtatccattcccaaactaaaagtttatttaattta

SEQ ID NO: 658409 - DNA, 456 bp, Homo sapiens
  misc_feature (24)..(24): n is a, c, g, or t
  misc_feature (57)..(57): n is a, c, g, or t
  misc_feature (135)..(135): n is a, c, g, or t
  misc_feature (137)..(137): n is a, c, g, or t
  misc_feature (139)..(140): n is a, c, g, or t
  misc_feature (149)..(149): n is a, c, g, or t
  misc_feature (154)..(154): n is a, c, g, or t
  misc_feature (167)..(167): n is a, c, g, or t
  misc_feature (172)..(173): n is a, c, g, or t
  misc_feature (187)..(188): n is a, c, g, or t
  misc_feature (210)..(210): n is a, c, g, or t
  misc_feature (214)..(214): n is a, c, g, or t
  misc_feature (257)..(257): n is a, c, g, or t
  misc_feature (276)..(276): n is a, c, g, or t
  misc_feature (287)..(288): n is a, c, g, or t
  misc_feature (301)..(301): n is a, c, g, or t
  misc_feature (313)..(313): n is a, c, g, or t
  misc_feature (331)..(331): n is a, c, g, or t
  misc_feature (337)..(337): n is a, c, g, or t
  misc_feature (342)..(342): n is a, c, g, or t
  misc_feature (379)..(379): n is a, c, g, or t
  misc_feature (393)..(393): n is a, c, g, or t
  misc_feature (438)..(438): n is a, c, g, or t
gacatttaataaaatatagttgtnttatagccatgctcccatttttgatgaaagctngttagcaaatcctaatgttagtttaatactttaaaaatgcataacagatattcagtcagcattataaaacctttaagncngnnggctgtccngcagnatagacagagggntcatnntcacttatgtctgnntcttcatctactccttcaatanccgntttcttccctttcccccgggctccccttcctcccctccccccncccccccgcccggccccgnccccccccccnnccgccgccctggnggcccgggcctngtgccggcctgggcctgnccgggnccccntcccctgctctcccggcgcctctgcctcgcctctctntggcgccgcccggnttgccttgcctttctgcttccccgccgccctcttcgtctctcttncgcccttcccgcctccct

SEQ ID NO: 658410 - DNA, 878 bp, Homo sapiens
tttactcatatatacacctctactttgtctacccccatcttcttcttaatctcactcctgtaccccgtatttccttatgcttccccctgcgtctttattgtaaccccccatctttcacctaaatttcctcctcccaatcccgatcccatccccggccacccggataaccaatttcgcacctttgacgaaacatggtcaaccctcgtaacaaaatgggtaagtccgctaataaaaaaactataaactgggcacccagacaatattgaaccatctctgaccctaccaatgagggcacattcacaccccccaacttctggaacccttcctcttaaaatcccccctctggtggtttttcctccccttcctctgggttctttcccctggtattttccttcagaaatcttgccgacgcttttttcaaacagtcccttcgtaccccgcccccgcctgcttggaaaacccaaaggtaccgaggcacccggcggtctataagcacaattccccacagcgaagggctgcggtaattcggctttcttcttccactaaggacgaacagatggtatccccccaattcaccccaatggttgttaacccggaccccccataatctcagcagacatgggagcccacacctcaccttatgcggaaccaaatagggtggtaattacactcccgcttatattagcctattcccgacatcatctggaatcatggttacttcactgccccccctctttatacatagattctaagacatccgcacactccacttacaaaatttggaatgttaatttttaatcttgaaaccaataatattcagcagaataccaatggaaattaaccccaaaaacaatgagttaaccaccaaaactttcagg

SEQ ID NO: 658411 - DNA, 320 bp, Homo sapiens
  misc_feature (250)..(251): n is a, c, g, or t
caagaacacaatctggtagttagaggttaagaggaggaataagtggagataataagtaagctaagggttataaagtactttctcagagctaggcagattttcaaggtgcctctccagtgtatttaatctatggtagaaggaagaacgagagtacagaatgggtggtggcgtctctcatagaaagccaaatcaagagcagttggagtctggagggctgagaaaggggtggctctggtttaagtctcttggnncagctgtgggactctctcagcagctgggaacagaaaaccagtattacaatggattttaagaatgggtgt

SEQ ID NO: 658412 - DNA, 552 bp, Homo sapiens
  misc_feature (293)..(293): n is a, c, g, or t
  misc_feature (348)..(348): n is a, c, g, or t
  misc_feature (371)..(371): n is a, c, g, or t
  misc_feature (391)..(391): n is a, c, g, or t
  misc_feature (424)..(424): n is a, c, g, or t
cgggctcattagcagtcgcggtgtgcggctcggcgcgggctcacaaagagctcggcctcgcggactgagccggcggcagcggggcggggacggcggcgtacccgggcagcccagcgccctggccagtctcctgaatatttacgcgtgctgaatctcctgtggacaaaccaccaataggccaggactgtcctgtggacagacggggtgagcctcttcttgtgtctggagattctgaaaagatttgatcaccaggagatttttcgggacattaccaaaccactcattttaggttngcaatggtctggagcagccaaggaagcagcagcgctctgatctcaagtggacctngttgacaagtaacaacgattccnagagacaaacgaaggtggcnatcgatttcccaagttttgtgggctgggttccncaggggccccgtgcgaaccagaagacctcatcgacgggatcatctttgctgccaattacctggggtccacccagctgctatcagaacggaaccttccaaaaacatcagaatgatgcaagcgcaggagg

SEQ ID NO: 658413 - DNA, 104 bp, Homo sapiens
tgaaaagtgagaggggagaggaggcaggcccaggaccagtactgcaaattaccaggaaaggacaggtggagacactttctttctttattatacattttgggaaa

SEQ ID NO: 658414 - DNA, 112 bp, Homo sapiens
aacatgcgaacggactgatcatgcgaacggactgatccatgcgaacggactgatcccaacaccttttcaatggacacctctcatccaccactcctatagatcagtccgttcg

SEQ ID NO: 658415 - DNA, 157 bp, Homo sapiens
gcccatttaaaaaattttattttttaaaagccttttttgcctgttgtaatgggcaggccccttcccctttcatgggaaagacaggtagttccctgaatataggttgaaaaggttatgtaaaaaaaaattataataaaagggatactttgcttttcca

SEQ ID NO: 658416 - DNA, 360 bp, Homo sapiens
tacttggtcaacgtttgtgtggtttaatagcattttttgtacgcttagtttcttactgatgctctaagctacagaattgagacccggcacccagattaggaatagaaaccttcggaagaaacaaaccttgtattaggagatggagaatctccccttacaactagacctctaacagctggaaccaagacactactgcagactatttcaggacaggtgaaacagtcgtcaccaagaactcctttagctcctaaaccagtgtcaagcaggccacaccgaagtgacctcaaggcaaacagaccacctctgcacctaagcctcagaagtactcatgcaaaaacaacagtcctcccaccacaaacg

SEQ ID NO: 658417 - DNA, 201 bp, Homo sapiens
ctatatgtattgttgagtattacattgtggttggaaatggaaaggtctgtgactggtgtagagagaggatgtgagccgaggatagtgataggtttctggctgctgctgtggctgctgctgctgcgtggttgttggtggtgatggtggatgactggtgctgctgctgcttgtgtgctgctgcttgctgacctcaggcccagg

SEQ ID NO: 658418 - DNA, 166 bp, Homo sapiens
cgagataaggtaggaaaggcactctatagcacttgatcctcacctatacccctggggctgggaatatagaagggaggagtgatctccttaagatagtggatcatctattacagatagtgaagcagccataaacccaccccataccccaaactgtgcaactagtagc

SEQ ID NO: 658419 - DNA, 99 bp, Homo sapiens
  misc_feature (69)..(69): n is a, c, g, or t
catcatcatcatggatttgctggtgcagtacaataggcttaatctcgaattcgagcctcgaattcaagnttctaacgttagaagcttgaattcgagcag

SEQ ID NO: 658420 - DNA, 746 bp, Homo sapiens
  misc_feature (263)..(263): n is a, c, g, or t
  misc_feature (290)..(290): n is a, c, g, or t
  misc_feature (316)..(317): n is a, c, g, or t
  misc_feature (508)..(508): n is a, c, g, or t
  misc_feature (520)..(520): n is a, c, g, or t
  misc_feature (550)..(550): n is a, c, g, or t
  misc_feature (553)..(553): n is a, c, g, or t
  misc_feature (587)..(587): n is a, c, g, or t
  misc_feature (672)..(672): n is a, c, g, or t
tcaagaagcatcctgagttgccccttacccacacccacatctgttacccacaccacttcatagacctgttcagtatttgcacactgcacaccgttcttcgtactcgccagggtgtgtgccttcccctagtcacttgctggatttcttttgctctgtactgttcaggctttgaactgcccaaccgtagttattccttggtttctcccgcctgccccccaccccagagggtagcaatgatctctgtttcctggacctcttacctntcctttatgaggtcccgaagcatctgntgctgcttagtgatcagtgtcaaatnntttccgtcttacagatatttatgccttacactcattgctcgtgatcattcttgttctaaggtcgtgtttgtatggctcgttacctcagatgcctatgccaataaagcatgctctcagaaggaaaatacccagtaaccagcctttccccgctgggcccgtctttgccttctctcctcgccccacccccattngtttacactccnttctcttaggctccatttttgaaaatattnatntttaaaaacaatatattgcaccagtggggcaaangggctttaaaaaaccaacatccagatgtttagagagaaataaactgagtgaaaatgcgagcaactgggaaaaccaccttgaactncctacagaactgtaattttaaaaacggtgttggtggatttggtagtatcaggttgcaaaaaaagggcgaccgct

SEQ ID NO: 658421 - DNA, 322 bp, Homo sapiens
ctcgtcgtactcggctcccaaagtgctgggattataggcgtgagccaccgcacctgaacattaaaaattttctttaagccaccattggaaatatccactattagaatatttatataaaatatttgtggagctcacatttattgaaaacattatgccatgtgttcagattgttctaagcactttgtatgcattatctcatttgatccttacaataactttatgagatagttactattatctctattttatttttcttttttcagccagtcaaatttagcagtggggggttgtataccaactttagtaacactgctttgaataa

SEQ ID NO: 658422 - DNA, 433 bp, Homo sapiens
cgcaactcagtcttccaacgtgctgtgatgacaggcatgatccactgatactggtcacttattgattaggcactcatacattaatagtgctgatggtagcaactcttatccgagacacttgcaggtaaagtgatgcgtactcaccttcagaggtggcacctgtcttgcatagcctgcaccactgactgctgcacatgccaggtccgagccacgtgtccatgcagcagacgacgcccacgctgtctaccacctccatgagcatgtgctcaatcgcgctacagtcacgcatgaccatgcatgcacgatgctcgcatgctgcagccaggcactattgagatctgcgtatcacgaaccaacatcgctagtgcagtccaacctagtctccatgatgcagaagcaagcgtgcacgatgcactacgctcgtcgctgcggc

SEQ ID NO: 658423 - DNA, 387 bp, Homo sapiens
cggctcgaggggcgcagaccgtctaagggattgatggatgtgacctcccagggctttgcttaccacacagatcagagcacgggttccctgtcgttaacaaccgctgcgaagggaatcccatccacacttctcccagacacctgggcccatccccgggcttcctgtggttgtccagtgaccgcccttcctcattgccccgggacatttttccgtggggcagtgctcccagccttcaggactgctgggggtgttgggggtggcctgcccagcctgtctctgactttccatgcagatgggcctggcgcgggcttgtcacggggctgcatagtgcttggagtcaccagcacctactgacggatccctgacgctgcccacgggtgttcttca

SEQ ID NO: 658424 - DNA, 466 bp, Homo sapiens
  misc_feature (237)..(237): n is a, c, g, or t
  misc_feature (466)..(466): n is a, c, g, or t
agcggcgggagcaagaatgaaagcaaacaggagctgctccggggtactgcttttgccgagtacccagaatcagtgctcaggctcagaaactcctggatagaagagagcatttcataacacgagaactgtgtccatcagtcattactacagagcacaaggtcctcccgttctgcaggaaggctgtgtgcgacctagagtcgggcgctgagatatacgccgacgcataacggtttgtcnaggaaggctaccaaccttgaggggccctcactcgtgtttgacccaatcagcgcaagttgacgacagacatactcgcagcaaggttcagacattcttacccaggacaaagttggaggacttcacacagagtcctagaaacaaagttaggtcgccaattaaggcgaaaaacaacaacactcccaaacgttccaagcccaccttacgagaatggacactatgggggaccccn

SEQ ID NO: 658425 - DNA, 267 bp, Homo sapiens
aggggccctttttttggccgggactttaaagttccccagtttttaatttgggggggctttaaaaaaagccttgtttcaatttccccctgttttgtaaaattccgctctcttggccacagtggggtttggcggtttttcaaagttcagccccgttccagcacttgaagggctgttttttgggcgtccctatctttgtcaattcttttttaaggccttaggacaggcatccagcctcaccaagcacaaacagggtgcataagggagcaa

SEQ ID NO: 658426 - DNA, 610 bp, Homo sapiens
tcttctctatagttcccgagttggcccccattgcagcccccaccctgtgggtagtcttccagaagtgatgcagtggtgtgagatgccctacaccttgttatttgggagactttgagagtcattcacttccatggtgactagtgtttgcttcttggcctgaatgtgtatcctagttctcgatgtatgccagtgttcctcgcgccagctgccgcgtgtcccatgcctattaagtacaacacgctaaactcaatatcataggaagaatgactgagggatagtattgggtattggccccatggcaggaacagccacttgcatctggtcccggtgccacacctgcggtgcgttggtgtggttgtggagcctgtccctgcgcgccttgctcccgttgagccacgctgtctggtgggtgattctctgccctagagccagccaccctggatctggcccagtctccagagctggcacaccctgcctgttttctctttttagacacaacagccgcagtttggccagcacactaagtcccaccagtctgaggtccgaggaaagcggggtgactcatttcccttgtccagggcccgagaagtagcgaggtgtccagcctgca

SEQ ID NO: 658427 - DNA, 442 bp, Homo sapiens
  misc_feature (1)..(1): n is a, c, g, or t
  misc_feature (435)..(435): n is a, c, g, or t
ncttttgcctatgccctgagaataccaccgccaagtattaagaagagccatccctcaccctggaatgatgcacaaaaattgattataaaggttgcctgtgggaacctgggtggttaaggataggattgaaagtgggacacttccttttcctctgtatagcttgcgtactttgtaccgagtacatgcattactagttcaaaattttaacatcgtaagtgaatgaaaatttaaacaggccgggcacggtggctcacacctgtagtcccagcactttaggagacgaaggccggaggatttcttgagcctaggagtttaagatcagcctgaacaacataataagaccctgtctcaacaaaaaatacaaaaattagctgggtgtggtgcatatgcctgtagtcccagctattcaggaagctccattgcaatctagcccgnccaacaa

SEQ ID NO: 658428 - DNA, 195 bp, Homo sapiens
ctcctggcttagagaggccctgaggaccaatccttgcttctgtcatctgaccttgccctttaggcctcctcagaactcccaaaatgtgacctatgctatcaccgaggccgcaggaacaagaggtgtgtgtccatgacattggtacctgtcatccctgtgtgcagcacgtgtgccccttggccttgctatatgcaa

SEQ ID NO: 658429 - DNA, 143 bp, Homo sapiens
aaaccgaggccttttaacaagtactccatcttcagattagctggttttgtgatcgcatttgtcctcagtgcaaaaagcatcttttgaagaactacttccaaatgtcagcaattatgttaattcaaatgaaatttgtttcctgt

SEQ ID NO: 658430 - DNA, 210 bp, Homo sapiens
cccccccccggggggggtttaaaaccccattttttaaattttttcggggggggggggggcccccctccttaaaacaaattttttccctggggagggggcaatgggggggggggggcccggggggggggcctttaattttggtttttaattttggggggcccccccccccttttttgggccccccaaaaaggggttttttttttcccccca

SEQ ID NO: 658431 - DNA, 154 bp, Homo sapiens
aactgtctccggtactcagtggactcttgaagatcaattaaaaggagaaaaaatacaatttctcactttgcattttgtctaaagaaaaaatgctttatagcagaatgaaagagaacgatgaaatggcttctttctcagttgattggttgaatgt

SEQ ID NO: 658432 - DNA, 421 bp, Homo sapiens
actggtaatccaggtgataatgagctagggagagtgatgggacagagtggctgtgtgaatgtcgtggagtttggatttgattctgaatgaagtggaagcctttggaggatttatgcaggggagagcctgacgtgaaattcaaatggattttttttttaaataggcaggaaccattaaaacatcagttactgggacgagcatgcccactggtaagacaaatacagagatgctgaaatgtggaccccatttctcctggcgctgttgccttatgcccgcctgtctccgcaggtgccgtgagtggaaatgtgatcgtgaacaccatcgcaggggtcccagctgccaccttccagtccatcaacaagcgcctggcgtcgccagtggctcctggggccttgactgtgagttgcgcttcacctggcta

SEQ ID NO: 658433 - DNA, 281 bp, Homo sapiens
tcgagctggtacccagcgcttgggaggcgaggtgaggattgttgtgagcccaggagcttgagaccagcctgggcaatattatgggatcctgtctctacaaagtagcagaaaacaagacaaaaaaaaatcagccacatggctgttacatgcctgtgttcccagttactcaggtagatgagttgggaggatgaatttaacctaggtggccaaggctgcagtgagctgtgagcttatggcatgttccggactcaggtaggttctgcagtggacacgaatgttca

SEQ ID NO: 658434 - DNA, 678 bp, Homo sapiens
tgtgcgccggtttactcctgtaatcccagcactttgagaagctgagtcaggcggatcacctgaggtcaggagttcaagactagcctggccaacatgttgaaacgtcgcctctactaaaaatacaaaaattagctgagtgtggtggcggacgcctgtattcccagctactcaggaggctgaggcacgagaattgcttgaacctgccaggtggagacagcactgagccaagattgggccactacactgcagcctgcgtgacaacagtagagctctgtcttagcagaacacgattttggtctattctcgcgggcgcatcataacaaggatttcctacttccacagcgctgcgcgtaaccgagtcgactttggtctcggccaggacaatgacgcccgcacgaattgcccggtgactccaccattctggcctccgagggtccctttacaatcccttgtgcatttggacgagatacactccggtaccttcctggagctatgctgaccctcctttaaccaaacactttagcttgatcccccactgttcaacagtaaacctcaaggtcttgatggattccttaactgggcatcaaatattgaaacggtgcgtccgcaacctcgtccgtgcgctctcatggcctacgccttgctctctccccaacgacgctctccgctctctttcct

SEQ ID NO: 658435 - DNA, 270 bp, Homo sapiens
ccgagcccggggcacctgtggtccccgggttaccgccggtcacgtctctgcttaacatctgcgttgtggtcgtgacacagatgtaccaggtccccactactcgactggcatcgcgcgatggtgacccctggcttacgtgggcttccggattcaccattgggtgggccctgggtcacgggtctgcttggtcccaccttggtcggcctttcctgtcttctggcagtccttctgggtccccttgctcctttccactttccaaggcagcacaaa

SEQ ID NO: 658436 - DNA, 129 bp, Homo sapiens
gctcatacccaccacaaggcatatcactacacacgcagcagaagggccgaaatagaacaaggtaaaaaaaagcactgtagtagaggatagtagaagccacggtcaacccacaagccacggtcaacccac

SEQ ID NO: 658437 - DNA, 480 bp, Homo sapiens
atgaaagatgttcctcattccaagctgaggacggagaaaagccgtaaagctgacactggagctagaatgacttgtcagccacctttgagcaagaacttgcctggagtccaaatgtatggctattgaaggatagtaagcagacagcactaaaagtcatccattcgttatggatttagtcttaagaccctcatttgagagatgccttccctgtacctggaggaaagaaacatctttatctctgaagacacagggccccagggaagagtctggacaaacaggctttaccaatttccccccgttggtaccgttagatcaggcccttgtccagtcatttccttccccaaggtgtccccccctccacccctagccttaaaatggcccaagttccctggttgtttgggtcctccatttcaagggccccctatgtcatgttaaacttttaaataaatttgcatgcttttctcttgtgaaaaaaaaaaa

SEQ ID NO: 658438 - DNA, 323 bp, Homo sapiens
  misc_feature (2)..(2): n is a, c, g, or t
  misc_feature (43)..(43): n is a, c, g, or t
  misc_feature (144)..(144): n is a, c, g, or t
  misc_feature (210)..(210): n is a, c, g, or t
  misc_feature (226)..(226): n is a, c, g, or t
  misc_feature (238)..(238): n is a, c, g, or t
  misc_feature (261)..(261): n is a, c, g, or t
  misc_feature (274)..(274): n is a, c, g, or t
gngccccctgtggattgatttatgcatggaaatgtcaccttgnccaacagttctgatgggaacctgaaaccctgctgtggcttcaggagggggtagtggcaagatgatggtttattcacgtgattttttccgcttcgtgatttncggaaaccttcagagttggttatgtgcctccagtggcatacatatggcttcagacggcaatcacanaaacccagtcactcanaagcgagctctncagatttaaaatttgcatttganttctgtaaagacnttgtcttttgcgggtaagcagggggaccattacaattccccaggtgggg

SEQ ID NO: 658439 - DNA, 412 bp, Homo sapiens
gccttcgggttttcgggggcctgggtaaaaaaagggggacacaaaaaccggggggtttttttttagccccggcccccggggcctttttccttttggggccccaaaaagggggggaattttttttctataatttaggaaagggcggggtttggtgtgggggtgggcctccccccggggttttccgggggggagattttctccaaaaagggggttttttttatccaggttctttggggtttgggcccagggccccaaaatgttccgggccccttttttaagaccgggggggggcttttttccccccgggggggggtttttggattaaggggggggggggggggggcctttttttaccccccgcggggggggggggggggggggggcccgggattttaaataaattttggtcccc

SEQ ID NO: 658440 - DNA, 181 bp, Homo sapiens
tcggtacccccatgccaaaattcttagcggggaagatagtccggacggcctggatgcgggcgatgatctcgcaggggatgataccataagagaacacatctgccttttcattatagggctcatctcggagaacctcaggtgacatccagaatggggaacccaccacggccagcttctcact

SEQ ID NO: 658441 - DNA, 295 bp, Homo sapiens
gcttagaggatccctgccgatgctctcaccggggccactgggtgcatgtctttgaaacaccacctctcacaatttaggcagaagctgatatcccagaaagactatatatgtttttttttttttttttttttttttttttttttttttttttttttttttttttttttttttttttttttttttttttttttttttttttggggggcgcggggggcgctctttttttctctctccacacaatctacaccaaaaaaaacagacgcgccgcgcccgcggggaggcgaggggggaaaat

SEQ ID NO: 658442 - DNA, 132 bp, Homo sapiens
aaaaaaccctttgggggcccccccccccttgggggggggaaaaacccccccccctgcccccccccttttttttttgggggggggggaggggggggccgggccccctttttttttaacccggttttcttttta

SEQ ID NO: 658443 - DNA, 653 bp, Homo sapiens
  misc_feature (620)..(620): n is a, c, g, or t
gggctgcaggaattcggaacgggtcctgacacacaacgaagagtggaaccttgccctactatgtctctatagctcggcttatgccagggacgtgccacgtgctgaggcgcacagcattgagcgcgcttaatggtcataaagattgctggacgcatcagatgatcctgtgagagcagagtatggagacacgggatgagcatagccatgcctagctgctgagtcagatcagacgacgcagaccctactgcatagccgtgcagcacacaattaatggacacctaccactcgtagccagacctaaggtagcatggctgtatgttgtgcacaacaagcgcctgagagcatagcatgcgtcttcgcccactatgcaggccaccctaagctagaccagatggagagaccagagtatgatgtgcaggcgcatgctaatcatggcattgtagagtcattcttgatcagatactgggaggacattgacgaagcagatcctgacataaatgccaggtgaaccccttccgtcgatggtgtctagcagctgttaccgaacggtgactagctgatgactaatggaatctgactgttgacacagctcgattagactacgcgatgaacgcctgtgntgctgtggacagcagactctgtgcgtccgtctt

SEQ ID NO: 658444 - DNA, 163 bp, Homo sapiens
ctaggcaactagcaagactccatctcaaaaaaaaaaaaaaaatgctgaattcaggttggggggttttgcattggatgaaaattcagttttacacaggtaggtaggaaaaaaagggaggaatattttgatccgggaaagggtgaataattttctttgatactat

SEQ ID NO: 658445 - DNA, 106 bp, Homo sapiens
tgaaaatgcgccactgcactccagcctgggcgagagagcgagactccatctcaaaaaataaatgaattaattaaaagtatggctgttgagctaacatatgatttta

SEQ ID NO: 658446 - DNA, 600 bp, Homo sapiens
ggccccccctattggaaaagggaattccaaggtgaaaaactgaaccccagctcccccccagccctcccctccattcccaatgggttttgtacccaatggtggaccaagaaagtggatgaccccccctagttcattcatccatcccctggctccagagatggtcacatgacccaggcctggccagtaaaagtagtctctcccctggccacagtaattggtcatgtgatgcaagccagcttactagccctttgaaaatgagtctcctgttgagctggtaggatgtaagcctggagctaatggcgatcatttttgcccccccctggggaaagcctgcttgggaatgaaattaacccaaaggaagtcccccctgagaaatggccaaaaatatttcctgaaaacattatgtggccctttggatccacccaagcctgaggtctacccctgggcttttggaataatgggaccagttggttcacccctttttttggtaattcgagtcatgggtaatttaaccccctttaaacccttaaaaaaccatcagcatcccccgggaacttttttaaaaaagcaaaatttctactgctttggatcctgggtcca

SEQ ID NO: 658447 - DNA, 237 bp, Homo sapiens
atggcataacaggaggaagctgatcccaccatatactctggcaaagtattcgccccctgaggagtgttgatccaccacagactgagataccaaaggaaatgattgagatcgtggaggagggcgatctgaaaggtgaggtctatccatttggcatcgtagggatggccaacaaaggggattagcctgcagcacaaggggagagcgtcaagttccaattgtagtgtcctagggccaaaa

SEQ ID NO: 658448 - DNA, 126 bp, Homo sapiens
cgttgtcagatatggggagttctgtgattgaggtggagtacattaggcgtcggtacaactacaggttaaggagggtgatggtggctcccatcgcggggatgacaaggccccttgccctccctgtct

SEQ ID NO: 658449 - DNA, 262 bp, Homo sapiens
atggtgtgcacaggggccagtgtcgaccacggggtcgcggggtccatgcttcactggcgccaggaggtttcccaccgtctgtctgcaggacatgactccaggagtcaggcgttcgtcgtttcacggggcttgcaaatgatgagtaaagtgttcttccgagtgagcagatatcaagcactcgcggttctttggatgagtcagcagatactcaatgtagaccaatgccaattcaggtttgactgggcgtgtgtcatggatctgc

SEQ ID NO: 658450 - DNA, 129 bp, Homo sapiens
ctgctccgcccctctctggactgcactgaaggtgaaataaggtatcctttgcaaaaggactctagtgtagcagccccatgcaaagattccctccaccctggtcgacatcttcctttttttttgtttttt

SEQ ID NO: 658451 - DNA, 375 bp, Homo sapiens
gtcaaggtgaccaaggccctgggtcagtgcgtccactctgtgtgagcgcgacggagtctgatctggctgatgggaccctcgactcctgtccgcactgcttcctgagtacctccgacggttggaagaccaggccactgcatatgtgtgtgagaatcaagcctgctcagtgcccatcactgatccctgcgaattacgaaaactactacatccatgactgccccaacccccttggggtggggctagaaggtgaagcatcccaacttgacgtagagactcaggcccatgcagggccgtagtagaaccttgtggccatccctggagcaccctgccactcaggttgaccctcggccaatacgtcacttgcccccccttggg

SEQ ID NO: 658452 - DNA, 1643 bp, Homo sapiens
  misc_feature (821)..(821): n is a, c, g, or t
ggtttgactgctaataaagcttggcagtagacctcaagcctaacaaggtacacaccacgtgaaagagaagggttcacggtgatagagaagcatgaatgccccaggctgatacgagaacggaggagaaacaaggacgtactgcgccctgtctcctgaggtaggagatggtatgaattgtgagcaggacgcagtggtgcatgatgtcccaaggccaagggtaccccttctgctcacctgcccaatgagataccttgtctgtggtgattgaatttaacgcggcaagctacatccgaagtgaggtacacatctctcttgtgagcatcttgcccatgatttctagtggagacaccttatgcataaatggatcgtgcttgagtcccctagttggtactccaagaagtaatccgcgtatcaccttgatacgaaaatacaacatcgagacactttcgaatagcatgcttcgcaaagtttccatcgactttgggtacattgtgtccaagggtggacttggtgagcaaggcctcgatgggcaatgaaagtagacgctttgcggtcactacgttgctacagtacccttgtgtctagggacacgccgaaagcaagactaaggcgacggctttaccgaagtgtcttacttagcgcacgatccttgcgcggagttgcttgtacccagaagggccccaaagttggaggcactattggccacgcttttattccccaggccatacggaaggagataccacacacagaagtatatgagaggacagcacgatgattagaggattacttaaacgcgacgggttacaaacattcacgcggancatatttcggaggcgggggggaaaaagctcccagtgggaggacattacccgcgttaggggcctacactgagcatggaacggggagaaacgaacaccgccgacaggaagactggcagatggcggtgttccatgacagacaggactacccactattatgttacccccattggggagaacgcgggtcgtagtggccctgtttttccccaacgacgaacttggttagtggtagccaaacaacgaggcgcgttgatcacaaagtctcaacggggcgccgaaacggaaactcctatccaaagacgttttgagagacagttccctcctattggccccatgtaccagcgccctaagggcattggccccgttggacaaccccttggggcccgctctatcaagggggcgacacgaacatcgagggaggggaggaccaaacatttacacagacgcgttgaaaacaacccgttagcgaagacgcacttttttgggtagcacatagtcaacatcattaagacagacactaacaaaagtagactgtcccgagtgctcaactacgtattgtaatttccatgccgcctgcattgcaggagccaccaacacggcggcgctacaacagcgagatagcagtggtggcagcaccaagaagagaactctcagtaagtgggtaggtagtttcactcatgagagcaccaccacacgacgtatagtttgttcatacgaccactggtggcagtcactagcaatgctcgccgaacgactcccccccccataataagagaggacgagcacaactcacataagtagctcacgaatagacccacgctgttt

SEQ ID NO: 658453 - DNA, 237 bp, Homo sapiens
  misc_feature (13)..(13): n is a, c, g, or t
  misc_feature (72)..(72): n is a, c, g, or t
  misc_feature (105)..(105): n is a, c, g, or t
  misc_feature (108)..(108): n is a, c, g, or t
  misc_feature (116)..(116): n is a, c, g, or t
  misc_feature (121)..(121): n is a, c, g, or t
gttacaattcccnaatacattatatacggaggtgctctcaaacgaaacccctcgttaggggcgggggacggngaccattgtcctccttccactgtaccagtgccnccncggctggnctccncgtaaataattctttataattccgctgtactgtgctcctcttttcaactgtaatgtgggtaactgtctgtctgtgtctctgtatgtctcaactcaaactctcacgtcacttatatt

SEQ ID NO: 658454 - DNA, 290 bp, Homo sapiens
gtaaaacattattcctgtcttaaaaaatccagataggccaagcaatgtgactcacgtctgtaatcccagcacggagtgcaatggcacgatctcaggtcactgcaacctctgccccctgggctcatgagagtctcctacctcagcctcccaattagctggggctacaggtgtgtgccaccacacccggcttatttttggtatattaagtagaggcgggattacactgtgtcggccagactggtctcaaactcctgacctggtgatctgtccacctcagcctccccaaaatg

SEQ ID NO: 658455 - DNA, 125 bp, Homo sapiens
aaaagaaaagtgatcagcatgggatagtgggaaggctacttcgaggggattcagcatctgaaaggccaaggaaatcacatggatacatcctgagttttcctcagttgtcagtaattaagaatgtc

SEQ ID NO: 658456 - DNA, 288 bp, Homo sapiens
  misc_feature (49)..(49): n is a, c, g, or t
acgtgcgtctgaggtgagaaactgcagatggagctcccacatcatcgtnggtacccctggggtgttgctgttaagccggggattcaggaccagatttattacatatttcaaaagctcaacaagcaacaaccaaggtaattttgctgtcaggcacaaatgccttctgatgtgcttggaggtgaccaaagaagttcatgagcggaccccattcgggattcttgtcaagaaggaagagttgaccctggagggtatcggccagttctacatcaacgtggaaggagaggagtg

SEQ ID NO: 658457 - DNA, 251 bp, Homo sapiens
tgttactgccccttttaaaataaacactattttgggcatgttgtggtagcttagacctataatcccagcagtttgggaggtcaaggtgggcgtatcacttgaggtcagtagctggagatcagcctagccaacatggcgaagtccgtccctactaaatatacaaagattagccaggcatggtggcacatgcctgtaatcccagctacttgggaagctgaggcatgagaattgcttgaacctggtaggcggag

SEQ ID NO: 658458 - DNA, 81 bp, Homo sapiens
gccgaggacacggccatatattactgtgcgaaagatcctaacggggactacctaggggcctttgactcctggggccaggga

SEQ ID NO: 658459 - DNA, 161 bp, Homo sapiens
gcgctctagcggatccctttaattggttcttcgatgacgctaaagaagctttaaattcctgtaataaaagggaaagcagagggacagaagctattcaaacttcgtcttctttatttctctaagcagcagtaatattaacgtaacttttccactgactttga

SEQ ID NO: 658460 - DNA, 468 bp, Homo sapiens
gtaataagcacaataacatcacatcctaacttatcataatcaccacagggagagaagggcatgaaggagaaaggagtacagcactgagatctgtaataaagctgtagtgtctgttcatgtccttcacccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgacagaagctctttagtttaattagatcccatttgtcaattttgtcttttgttgccattgcttttggtgttttagacatgaagtccttgcccatgcctatgtcctgaatggtaatgcctaggtttacttctagggttaacatggttaaaggtctaatgtttcagtctttaatccatcttgaattg

SEQ ID NO: 658461 - DNA, 1635 bp, Homo sapiens
  misc_feature (1635)..(1635): n is a, c, g, or t
ggatcctcggccgatgcgggccgcgcgggcgtgtgcctgacgactcgacagctgcggaatcctgcttctcagaaaggatggcatctcatatatatgataatctatgggccaaggtcagtcgagcgtagggacacagaagcttccattttctagtcatcacaacattcgagtcattcgtgggtaggacataggaagattggaatctgtaccgtttgcgaagtcatggcatgtgaggactatggagtcgaagccagggtgtggctggtccgcaactcaaccgaaatgatgatccctggatggctactgggaatctaaccgcatggagtgagtagctagtgtcccttgactgtcgtgagcgctgtgtgtgactagttgcagccctcgtgcggagatatacgctcggggactagccgttgcgacggggcctcatgccgggagagaaattatccttgatatggatcaacacttgttctaacattgtaggacacgccaatctgcatggcatcacttctgtttctctcccccttgagtacgggcatagtggccatggctggagcccaaatgtactggtaggaacgtatccattgaatgacccgaggagaagccttgggagctggaagggggggaaccctggggttattcgctagggtagacggtattctccataatacggtacggcgacgtgcaaagcctatgccgagtacgggctatacggtaaacacggaggggtacgccaaagtatcttgcggaaaatccattgccattcaaagaggacttaccaaattgcgtgaaccgtaccccccttgtcgatgcgaagacaggtgccattacagatgcgcgacgcgacgaccgttgtgtggagagcacgcgaacttatgcttggagtacccccagtggtatgaggaaaacctgtgcacgaagacgcttcacaacaggcaggatgcgatacacaatattgcataacacttttggccaaagtccagagggtgggccacatgtggggttgaacaaatgcataccccggcaagataagcgacagagtcattggcctgcagagaagcttcccccgcacttttaacttttcaccattggccttgggccagattaggcacaggaagaaattctccctttcgcctggccaaggacacaaccactgcgtacacaggtcagataaacgcaacacacccagagggtttgcctcgtgggcacctcagtcatgaaatttgagtactgggggtggaacttttcaccacgcgcgtttggaaaacggcactgggcaaacacgatcgggcagagcagttggaaaagcgtcaccacagtgcggtaatcaacacctagaagacagaggggcagtatgagcaattcgcagacgagacggctcagcgctcagcggaaccacaaacagggctttttagtcaggtatccgccctcgcctgttggacacaccacacacgtatatagcactattctggtgggacgatagggcagggtagtcttaatactagtccaggcggacatattactactcagcacttgctgattgccgacggcaactaccatctcacgagggcaagctagcttatcaccttgggcacaatagcacgagtttgaaaatcactcaaggatactatctgn

SEQ ID NO: 658462 - DNA, 111 bp, Homo sapiens
  misc_feature (26)..(26): n is a, c, g, or t
  misc_feature (98)..(98): n is a, c, g, or t
gatcaaagacatcctcatccagtatnaccggacctgctggtagctgaccctcgtcgctgcgagccaaaaagtttggaggccctagtgccctgctcgtnaccataaatccta

SEQ ID NO: 658463 - DNA, 166 bp, Homo sapiens
gtacttgaaaaacggaggttcttcctgcgcatccaccccgacgtccgagttgacgggtccgggagaagcgcgaccctcacatcaatgctacaacttcaagcagaagagagaggagttgtgtctatcaagggagtgtgtgctaaccgttacctggctataaaggaag

SEQ ID NO: 658464 - DNA, 1477 bp, Homo sapiens
  misc_feature (875)..(875): n is a, c, g, or t
  misc_feature (1317)..(1317): n is a, c, g, or t
gccgtcatctctttattggctgccagcgagagtccaccaagcctgccgggcagtccctgcttgcccaccacggtgtttgggtccaggcccagcctcaccaccccggggtgctgtctccttccatggttccacgccgtccttgatgggtgtgcccagtggaagtgtcatgagaagacccccatggcttggaagtgtgaaggggtgaactgggactggagtctcagggttaagggttcccccagaacccttctggggatatcctaaactatcctagttcctctgcctgaaaggggctccccaaatcctaccagaagggatggaatgagattaagacgtgtgaagaatgtgggacaaccgcttacaaaacccaggggggtccttgtgcaaggtcccatgtggcggggcattccctgtggagtgccactcacccagacccgcacaccccgagaaccacgtgggtcttgaggaaatggcagaggtctgtgggtgtatccccagaaaaagcagcttgagtgcggtcagtgtgggcggggctatatcatccccacgaagagtccactgtggtggggttcaatctcccctcgaagcctgtatccccacaacaaagattatccctctattggcacacacaagtgtttgacaaagagaaagagcatatgtccacaaggaaacttcactggggccatggagcgcaatacaacacagagatgacccaaggcagatatacgcatgctcgtgcgtatcctggcccatagagcacagaagagaggctaaccacgaagacacacgaggggacatagtaggttcaccaaagagcacacacaaaagtcgcccgtccaccgaggatacatcgaagccccaataacaagcgcggnccacaagaggtggtaccaaaaacagcctacaacacgaatagaggccctctgtgatagagcaaaacaatacatcatgagaaggcgtagcacaaagggagcttgtcaataggaccatcattaggcagtagaggcaccacttgaagtcacgatgtgacaatgagcgccagagatgtggcgaggccgaaccccatatacatcaccaacagaaaaacagccccaccatgtggcgacagcccacggagaaccccaagaaacagacggagaccccaccgaaggtgcaccacggacgaagagtagccacccccgagaaattgaaaaggcaccgggaacacgggagaagcaggaggacacacgagcaaaggaggtgctacacatacatagtcaagtggtgtggcgtgacacgacacgaactacacctgaccaccccgacaagcagaacganacacagactagaagatagaggaatacgaaaacgagggcaacacaccccacggtagcaccacgccgtcgagacgcacgcacaccagataggtggtaaaaaagagcaaacggtaccacacaacaaagtcgcgaatacacacaaatggccaaatggctcacct

SEQ ID NO: 658465 - DNA, 923 bp, Homo sapiens
ggtcagactgttccacacccagaagacgtcaggtgacttcagtcctgctgcagttgtgcagcagaggagactgagacttcggttgaggaaacgggtatttcatgtctcagggagtaggttgtgcagttacagcttttctgttggtatgcataattaataattggagctgcaaagcagatcgtgacaagagatggacggtcagaagaaaaatggaaggacaaggttgttgacctcctgtactggagagacattaagaagactggagtggtgttggtgccagcctattcctgctgctttcattgacagtattcagcattgtgagcgtaacagcctacattgccttggcctgctctctgtgaccatcagctttaggatatacaagggtgtgatccaagctatccagaaatcagatgaaggccacccattcagggcatatctggaatctgaagtgtgctatatctgaggagtggttcagaagtacagtaattctgctcttggtcatgtgaactgcacgataaaggaactcaggcgcctcttcttagttgatgatttagttgattctctgaagtttgcaggtgtgatgtgggtatttacctatgtgtggtgccttgtttaatggtctgacactactgatttggctctcatttcactcttcagtgttcctgttatttatgaaggatcaggcacagatagatcatatctaggacttgcaatacagattgtcacagatgctatggtaaatccaagcaagaatccctggattgaagcgcaaagttgaatgaaaagtgcccaaaataattagtaggagtcatctttaaaggggatatccatttgattatacgggggagggtcagggaagcacgagacttgagttgcagtgcagtttcaaagatcgtggtagatcttaattttagcatgacggt

SEQ ID NO: 658466 - DNA, 1095 bp, Homo sapiens
ggaggattccgtaggctgcagtgtggagcagctctaatgccttgccagccctgtctggagtgaagactaataatgccgccctacgacgagcagacgcagtgccttcatcggatgctgcccagtgaggccctgcaacaagttcgaggaggcctgagcggtcgctgaaggacatggaggagtccatcaggaagcctggcagcaggagatttctttatggactttggaccctaacggggaagttttgcttacctgtacagccagtgctacggagctcagcagcaacgaatacgtctagcagactctgccccttcagagctatgtctcgcaggaaacgccaaactcggtgggctctcccacacagccttggcacctggggactcatggattggccccgaccaggacaagttcagtgccatgaacgtatgagcaagggcaccgggctgctggcagtggccccaacctgctccaacaccgtgctgcctccttgtgcgggaaaacgagaccattggttgaccagtgagcaacgagagcccagtacgcttgcgagttacctcatgggagctgatgacggctagcgcgtccttgcccggtagccaacccgccctggagagcaaccaaccggaagacgaccaatggaggagctctagcctggaatgggcgccaaagagttgcccggaaagacagatagagcgtcctcggatcggacagataccccaaacaaaggatgaagcggagagccccttcggaaagagtgcaccacaatgcgcaattctaataaaccctagatacaccaaatttacccatcaataatgagaccgaaacatagaagcggagaagtacaccccaccacttggggcccacgactataggcgtagcacagaaattcagcaccatgggaattgtcaggaaacatcttacacctaccgcgaggacacgcacacacgcgcgtcgtataagcgcccccaagagcatgcagtatcacgagcgtgtagcaccacaagcatgctgcaacatatcatgaagcagagagtcgtctacatacgatcgtgacgcgtggctacgaccaatctcacgctggtagcgcacgcgtccgta

SEQ ID NO: 658467 - DNA, 161 bp, Homo sapiens
tacgtgggtttacggcgacgacatgactgagcaagtatatgcaacaatgaaagcacttcgggaggcagatgtagactgcttgactttaggacaatatatgcagccaacaaggcgtcaccttaaggttgaagaatatattactcctgaaaaattcaaatact

SEQ ID NO: 658468 - DNA, 317 bp, Homo sapiens
ggtgttttggtttcggttgtttccgaccactaggggtggggagggccggcccggccatggtttcagccccggccctggacagttttggggccccgggcccccagcccttgtgggttcagcccccgttcccgccccgccccgcccggccggcccttactttttttggggtcccagttgggccccgtgccggggggtggcccaggttccgcccgccatgggcctgttaattgtccggccccgtcggggtgtgttggtcccgcccgggggtgcgggggggttttttgaccccgggttttttttaaggggccttccgccca

SEQ ID NO: 658469 - DNA, 374 bp, Homo sapiens
aagtcctttaccagctttagccatagcaccagaaacaaaactaggggaggcctgtctcatcatggaaggcgctgaatttacggaaaacattattaatggcgtcgagcgtccggttaaagccgctgaattgttcgcgtttaccttgcgtgtacgcgcaggaaacactgacgttcttactgacgcagaagaaaacgtgcgtcaaaaattacgtgcagaaggagtgatgtaatgtctaaaggtaaaaaacgttctggcgctcgccctggtcgtccgcagccgttgcgaggtactaaaggcaagcgtaaaggcgctcgtctttggtatgtaggtggtcaacaattttaattgcaggggcttcgggggtaccgagctcg

SEQ ID NO: 658470 - DNA, 171 bp, Homo sapiens
caggtcatgttatgcaatgcatccatcgagttgacacagaggtgcctacccactgggccttggttgtgcaggtagatcgcactgtatttggtagcctctgtggacttagggaaatcctgtgaagtgtgtcaaggaaaatacacatgtgaggtttgagggagaaaaaaaaaa

SEQ ID NO: 658471 - DNA, 414 bp, Homo sapiens
cgggggaagcggaagctgcagctggggtgggggcagcacctctatgcttcatctctgtgggtggcaggagacaaaagcacagggtactatcttggctcctgggagcgactcttgctacccacccccacccatccccttccccttggtgttgacctttgacctgggggttcccagagccctgtagccctcgacccggagcagcctctcggaagccggagtgggcagttgctggcgattctgagaaaacttggccgcatccaccggggccctgcctccagtcggccgctgccgagtctctgcgttctggccgcttcccggcttaatgaatgccagccatttaatcattgctcctgccaccacaaatagatgagcagttaaataaaactcaacttggcataattcaaggcaaataaa

SEQ ID NO: 658472 - DNA, 743 bp, Homo sapiens
cacgcgttcggggtctccgggaagtcgcgggccttcggatgtggcggatgcggccgtgagccggcgggggaggtgctgctgctgcctccactgtactcagacccaggtagcacaggatgtccatcctccagcagctcagtgcaagcggtgtgaactcagctctgtttcagatgcctccacatctcatgagccttccaagtaagctggttgaacttcggtggcgtggctgtgctgagtgacggcctcttgctggcctggtggccgtgcaacccgcgaactctgcgagctcctgtcatgtggcctccgctgtggcccgtccgttcttgaccgtggcacagcctcgcagggccgggtggcgcatgcgtgtcgggtgggggctctggccatgtagtcctgtccatgctggttacatagggcaaggggatgctgactggggtcgatcgcggggagctgtgttcagctccccggcagtggtgcagcatcctggcgagccatcgaggggcgtggcaccaggccggacactagaggggcgacgctccgttatcgtgaaggaactacactggggatctggctcaacttcggcctggaccgggtagcaggccgggctgatgggatcccggtggagatgggggtgattggcgacgacgagcttcaatgccgtaaaagcggccgcggggctggcgcacgggctataaaccagggcaggtcgatagactggtggcgagaaccaaagtactgccagc

SEQ ID NO: 658473 - DNA, 887 bp, Homo sapiens
cggatgctcttaggagggttctagtcataggtacttaaaatgacagaatttttttaaagctggatttcaggtaattttcatgtgatatttctttgttgattttatttgttttctaaaaatatgtctaatctctactgataattatgagtgagttttgcctttaaaaatatttctcagaaccttttcagcctctgtcattgtcgttttaaaaaatttttaatttgtgattgttgaaagtcagtaatattaagtgcactcttttttgtaattttaccttctatttgagattgggaggtatgtatgaggtttgttgtgtaggtgtaagtatactcttaatttaaaatggaaatgttcatgattaccacattctttttagagggaacaaatctaatacccatactcagtgatggaactgtgtgcttctggaggccacactccaggatgaacagttgtaaattgttaatatgactcttgttactttgatagacattataaatgccagccctcttttttcctttttaaactttcatttggtttacaaaaacaaactcttcagtgctcagggtaaaaatttctggaaaagtggtctacccacggtggtgtgacgcaaggactctggagccagaaccagctaggttggagctcaccatctagtagtggggtgaccttggacaagcccatagcctctcaatacctaaatccccatttaatcggtgatcaataggccactgaaggctcacaggggtacggatccttcggaagccagcacggcgggtcaaaggtataacaaggcaacagctcgcacacaccgtaggcaacacgggacgacacaggagggccaaaacatcaccaccggagaagagaacaccagggcacacgacacaaca

SEQ ID NO: 658474 - DNA, 125 bp, Homo sapiens
  misc_feature (43)..(43): n is a, c, g, or t
aggtgattagaggatttaaactgggttgagttaggagttgggnagctgacacgtgtgtggcccgttataataaaaatacaaaaattagccgggcatggtaggcgcgcgcctgtagcgccagctat

SEQ ID NO: 658475 - DNA, 157 bp, Homo sapiens
gggctcatgtgatcctcaaactcggctttaaacgatcctcccaccccagcctcccgagtagctaagaccagaaaggcacaccactatgcccagctttttggtattttttggtagagacagggtctcccttggttggcctgagctggtctcaaactcg

SEQ ID NO: 658476 - DNA, 241 bp, Homo sapiens
ggccgagaaggggaaaaatgagagaactaccactaacctcacttgctcgcacaaggtcaacagaagttcggttccaagctacctccttgctttttctgtgaatcacttctttgtgaaggtttatacgcagcaatctctactaatctgttaacacatagattggcggtctgaggtattgatcaacagtactcatgcctacttgccatctgtcagggccccagtcacaccgctgtgtattccg

SEQ ID NO: 658477 - DNA, 466 bp, Homo sapiens
agctatggttagtgttactttgggctcaagttgagaactagaaagaacatttccttgagatagctggatgagttgacagagatacaggaaatgtcaagaatctaaagacgattcatttctatgtgggcatgagaatttctgaaataatgagctgtagttgacgaaaagcaagcagagcttagtgaataatcttttcaggaagaaagaaggtgaccaggccaaaatgtatcacctctgcagggtgataaatagccactgaatggagaggaaagagtgaaggaggaacaggcaatattaaagtaagttgctggtaagtttttaaaaaatcagtttgatattgttgaatcattaatcatcagttatcctaaaaacaagatttattataatgacttatcctgtgtagaaaaatacatctattttgagtgggagactttcaagatcatttctagtccagaaaaaaaaaaaa

SEQ ID NO: 658478 - DNA, 1046 bp, Homo sapiens
tctgatccgtcctaatcacaggagtcctacttctcctatcgtctcccaggtcctagctgctggcatcactatactactaacagaaccgcaagtcaacaccaccttcttcgaccccgccggaggaggagagccccagtctataccaacagctattctgattttcggtcacgcgctgaagtttatattcttatcctaccaggctttcggaataatctcccatatgtgaagcttactactccggagtgaaagagagcattgggatacgtaggtatgggtcctgagctatgagtatcaattgggcttcctagggtttatcgctgtgagcacaccagtatattcacagtaggagatagacgtacagtcacgagcgatatttcacctccgctagcataatcatcgctatccccaccggcgtcaaagtatttatgcgtgactcgccagactccacggaagcaatatgaaattgatctgctgcagatggtctgaggccctaggattcgatctttcttgttcaccgtaggctggtctgacctggcattgtgttttggcaacatgtcaatcacgtagagcatcgtaactacacgacacgttagctacgtttggtagcccacttccacgtatgtcctatcaatagcgaggcttgtgttctggccctcgtatggacggcttgcaattcacctggagtatgtcccctattgccggcagagcttgcaccgtaagatcaagacctacggcccagaaaatccatagcactatcgatcatgcccacggagtagaaacataagttggctgccccggacactactcgggccagacgggatgcccgacgtagtccgataccgaagcaacccacagaaccaccaatactggagggcacactctcaacgcggaaagagaacgcggatgaactgacacaaaaaccaagaagaacaccaaaggaggaaggggccacgcagaaacagcggaaacacacaggggacccagcaccccgacgcacaacaaaacaagcggcacgcacacacaacaaacaccgcagagctcaacag

SEQ ID NO: 658479 - DNA, 385 bp, Homo sapiens
ttagcgtggtcgcggccgaggtacacacatcacaaacaagtttctgagaatgcttctgtctagtttttatgggaagacattccctttttcaccaaaggcatcaaagcgctccaaatgtccacttccagacactacaaaaagagtgtttcaaacgtgctctaagaaagcgaatgttcaactctgtgacttgaatgcagatatcacaaagtagtttctcagaaggcttctgtctagattttagatgatgatattcccgtttccaacgaaatcattagagctatccaaatatccacttacagtttctacaaaaagagtgtttccaaactgctgcatcaaaagagaggttccactctgttagctgagtacctgcccgggcggccgctcg

SEQ ID NO: 658480 - DNA, 1643 bp, Homo sapiens
ctggcctctcccccacccctcagcccgggccctgggctctgtgtccccccctctccctccgcttcgcactcccgtcgggtacgggaaagtgtccaatgcctgatgcctggtgtgccctgagtgtgcctgtctgtgtgcctgcctgtctgccactgtgtgtcccaattgtgagcctgcctgaatctcttatcctgtgtgaagctcgtactgtgtactgaccttgtccaaatgtgcctggccctggctggctcatgccccatacatagcttgagtggaaacaaacttggaatgtgcatcttggcaacacaatccatatgtttgttgcacaaatggacttgagttcattcttctgtgcatgttggttggtaatcttccatgctttgacaccacctgtggatgtggggacatttgcatttgtgtgccatccaaagaactcttgatgtgttgacttgttggtgtgatgtacgatgaatgtcacatgagatgaaggtccatttcttgggatgtacacttcttccgtcaccattggggggtgaaggtcaccattgattctctgaataggatggaaggccatagcaaagcgcggtcatttttgagaacaacaaaatattggtaagcagcccatttcaagacgagacgtgagagggtaggacaaacaataggattacacaattagaaaccattggtgggcctggtgagagggaactttaccccttaacgatatgagccaatatcaagcaagtgaaacccatttggatcccaatcatttgaaaacaagattttccatcgatacaccaagcagaccaccgatataatagggggaccaaagaggcaacactatatcacgtggcacccgcatacccattgggaaactatttccaaaagttttacaaatgggaattccgcaaaaggcagcataccccaaagcggaacagtgtgggaatcgacctccccccgatatggaggacgcgcaaagtgaaatgcgccaaaaacacgtgagggcacagatgaaacgcactttaaacagcatatggctggagccattatggcatctatatggatgatgaaaacaccatggatgctccaattgaggccacataccatacacacgataagatgagccgatatactaaatacagcagatatatagttgctaagacaaaccacaaaaaagacagacggaataaacacgccccaataacagccaagataacattctttcgattacatactaataaacattagagacattttatataacccaatttcactggtaaagtcgcatttaaaaaagagaaaacaacgaagggtggtgtaaaaacggagatggcatgtagatataaacaaaaattatatttacgccaaagtaggttaaatggtgaatgttgaagatgtgatcagttggagcccggtgacgtgagtaattagaggcacacagaataggtgtcatatagtcagtagagaaaagaagacaaaagtaaaacagaatgatagaatggtttaccagaaacgaccacattattcattaagaatgatagctatcgattgaattaaaagctttaaagaatatagataaaattagcagaacgatgagcatgatgaacctagatgatgcaccgaaggtggactgaatataaacaaaa

SEQ ID NO: 658481 - DNA, 1182 bp, Homo sapiens
cggagccgccgaatccggtgccgcaggctcctctgcgacccccggtgcccccgacagtgtacttccgcaaagtggtccggctagagcaaattccggcatgtgttcgggcagccggtctcgaacgaccagtgctatgaggacattcgcgtgttccgtgttacctgggcacatgcaccttctgcgccgtcaaccccaaggttcctggcgcgtgattgttggagcgccaggtggagggggtgcctttcttggttgctccccctaatggcaagacgagtgccgcgattgagcaagggccgtactccgagcgtatgtagtgaggctagcacggagaccgtttcactgtgaccatcgagcgtgcgctgtctctcaacgaactgacgcaacgtcatacgtccagctggtctcgagagcgactgccagcggttccattgagattgcttggactacgaattcgccacggaggacaccgtgggcttgtacccctcctctcggcgttgtaacatggaggactcggagcttgggattggctaacttgggacgcggcgacatcgacgcgaatgaccgcaccgttggtgcctagttcaatccgtcgcgtagtggcggaccactcaaccgagacacccgcacaaagctggttggctttgcttgcaaggttgtcacgggcattgccggagcgagacacgattgggttaactccaatctgtgcggaagttagtcgtgggcatcacgacgggaacggcgtaggcattggtacccagggccttgggaacaaggcccttgaccacgcccctttgaacccgtcaagttcgtaaccgagaacttggtgtcacgcccttgggaaaacgctaactaactatgagcgatagccccattgattactatagcgtcagggcagagtgtcaaaagtgtatcccaaaggaagtctcgtttggccggcccatttcatattcgggagacccccgcgccggtgtaccgaggggagtgcaacccccgtttgggcttggggacacaaacacgcgccgagttgcacgcaaaagcgggccttccaccttgttagcacgtgcagtgtcacccctgggatcccccaattgccgatggagaggtaccacaattcccgttatccccttgtggcacacgaaactgtggtcccagaaaggggggttgcattgtagaaacggcgat

SEQ ID NO: 658482 - DNA, 180 bp, Homo sapiens
  misc_feature (103)..(103): n is a, c, g, or t
cccggaatggcgcaacgaagataagaagcagatgtacgccaagatggctcggcagggccacagccacgtaacgaactacgtgactcgcgtcatcaagacgaangaagacgatgcggggaacaaagaccagttccaggatgagatcatcgacgtcgagaaggacggacaggagatcgggga

SEQ ID NO: 658483 - DNA, 185 bp, Homo sapiens
gattgatgctgtcacggggctcagtggcagctggccgcctacgcattcacagccctggatgccctgtgctgatgggggtgtgaagatgggacttccaatggcgcctggcgagtccgcctcgtgggtccagtgcccttcctggggtgctgccaatgatgcgtgctgaactcagaaacagcacccag

SEQ ID NO: 658484 - DNA, 279 bp, Homo sapiens
tgagacagagactcactgccacccaggctggagtgcagggacgcaacctaagctcactgaaacctccacctcctgggctcaagcgattctcctgcctcaggctcaaccttgcttaccacttgacttttttaactattactaaacagtttgatattttgctgactttggttcgatccaccttttggtggaaattattaatgcgtaaaatgcataaattagaattaagcaaaacaagcaaagtgattttgctaagaaacctctaagaattaggttatttca

SEQ ID NO: 658485 - DNA, 187 bp, Homo sapiens
  misc_feature (5)..(5): n is a, c, g, or t
  misc_feature (7)..(7): n is a, c, g, or t
gaaangntcatgggccagtaacgggtaggtctctctaacggatctttggctcgttccaaagggacctcaagacttccatcgattttatatcgggggtctagaaaaggagttaatcggtttcccctcataaattcaccaaaatctgtaatcgggtagtccgtaactcttcctccacatccttcactaa

SEQ ID NO: 658486 - DNA, 392 bp, Homo sapiens
  misc_feature (79)..(79): n is a, c, g, or t
  misc_feature (121)..(121): n is a, c, g, or t
  misc_feature (162)..(165): n is a, c, g, or t
  misc_feature (181)..(181): n is a, c, g, or t
  misc_feature (256)..(256): n is a, c, g, or t
ttttttttttggtttttgggttttagattattaaggggtgagaggtataagttttgagtttttgacttttttttttttnggggaacaaaaaaaagaggaaaaaaaatttttttgggggggnggggggggggttttttttttcccccccctttccccccaaannnnccctttaaaaaataanaaattgtttgtgccgaggtctaagagtgcagtggctattcacagatgcgaacatagtacactgcagcctccaacncctagcctcaagtgatcctcctgtctcaacctcccaagtaggattacaagcatgcgccgacgatgcccagaatccagaactttgtctatcactctccccaacaacctagatgtgaaaacagaataaacttccccca

SEQ ID NO: 658487 - DNA, 186 bp, Homo sapiens
acagactaattaactcccactggtatgagcccctgtggatatctaaatacccgctttagttctcttccacagtgagcaggcagaggactcactctcctgggacctcctacacatagaacctccactggcctgagcataccttcggcttggttactcactctctattcaaactctccttcatgatga

SEQ ID NO: 658488 - DNA, 150 bp, Homo sapiens
agacagtattacagactgctgcaccaggacccagcacatgctgcatagattctatggaagtactctcctcatgtccatgtggcatagattcaaatggaaagccagcagatgcagtctacggacagaaagaaatccacagtaaagtgatgt

SEQ ID NO: 658489 - DNA, 345 bp, Homo sapiens
agttcttgagccacaaacccttcctctatagaagtacagtgtggtctgcgagagaatctgtatgtacaccaggcctcccaggatggcgagctccagtaagatgataatggaaagcagcagctggtcggttgtcacttttctggacattgaacggagaatcttccgacttttgctcaagttttcacttgtgtataccagtctactcttggtacgttctaactggtctcgttgttcccccagctcttctatgatttctgagccaatctggtcagtctctgtggcaatccgatgagaacgctcaatactttgggtggcccggttcaggctttcagtgccctgcagaag

SEQ ID NO: 658490 - DNA, 915 bp, Homo sapiens
gctctagcggcgggatttgatggcgtgatgtctcacagaaagttctccgttcccatcacatgggtccctcggtttcctgcctcggaagcgcagtgagcaggcactgttggttgaaggtgaatcagcttccctaatggatgaccctgtcctaagacccggtccactcgtccagcatggccttcctgggatacaatggctggacatggactcacacttcgtgtcggcgagatgtctacaggccgggatccaaggtgaacgagacatggatgtgccgtggaggctgtgaccatcgtggagactccacccatggatggtggtgggcactcgtgggcttacgtggacatctcgccgtcgtaaggcctccgggaactttcgaagaatcttgtctttgctgagcatccgatcgatgtgatgaagtgcaagaatggcgtatctatatagaactttggcgttaacatctaaggaatcaacggctctttaccacatgtagctgcacagaaatcgcgctgggatgaggactggtctgacgacgctatcccctggacgatcgggaccttcgagcgtgcaatgacgaatgtacgtagcctagagtctctcccgtagttctatgtggcgcactacaaccgcatggatgcagcgcatgacgttgccgtctggcggcctgaaaggaacgtgcccctgcctttgttggtcctattccagggtgaagcggaccggcaactagtttggcgcgaaggaatgctggatggtggtgcccagtgcagagggctgggggctcgcttgcgttaccgtgttgagtccccagtcggttggggagcgaaggtgtgaccattgaatgcgttgcggtcatcggtgggtgaccctatggggcaaaggttagctggggggttgtccccagttcggcggggccgccca

SEQ ID NO: 658491 - DNA, 691 bp, Homo sapiens
ggcgccagtagcctttccgtcaattcctgtgctgggcgtacgtcaagatggcggcgtctgtattaaacaccgtgctgaggcggcttcctatgctatctctcttcctgaggttctcacagagttcaggttcccctcacagactctttgcaccaaagctccctctgagagaagattctttgttcctcagtttcccatttctccttataagtgatgagccctggaaatatctggaatcagaagaataccaggagcgatatggttctcgccccgtctgggctgactaccgtcgcaatcacaagggtggtgtacccccacagcggactcggaagacatgtattcgtcgcggacataaagttgcttgggaatcccatgaccccatctgtcagagatcacatggttgcattgtggactttaggaaccgtgacagctcattgagagcaactttggtctgtcgcccacagcgggtatcatcttctatgctccatacacgagggagtctgtgtgaaggcagcacaacgcggttgacccagtgccatccagtaaagccagggatcatggtctcctcatttaccacatcccccaggttgaaccacgggacttgacttcagtacctctcatggggctgtgagtgctactccgtcagcccccaccctggtctcaggtgacccctggtacccatggtacaactgga

SEQ ID NO: 658492 - DNA, 238 bp, Homo sapiens
  misc_feature (204)..(204): n is a, c, g, or t
gctagggagtacaggggcgatctaagctcactgcacctgctccagtgtcaagcaattttcctgctcagccttccaagtagctagtgtctacaggcacgcactgcacctctcccggctaattttttgtatttttagtagagacgggtttcaccatgtggcgaggctggtctcaaactcctgacctcaggtgatccatctgcctcnggctcccaaagtgctggggttacagtcatgagcc

SEQ ID NO: 658493 - DNA, 129 bp, Homo sapiens
  misc_feature (77)..(77): n is a, c, g, or t
tataggtttgacactaaaaaacatagcaaatactcttttatatttagcctaattccgtgatgccttgttttcttaanattaattcatggcgcaatgaatgggggaggaaaaataacaacaacaaatatg

SEQ ID NO: 658494 - DNA, 158 bp, Homo sapiens
tggggtcaaaattagtaaactttatttaaacttcaaaaaaataaaataacagacaaaaggcagtcttaagcttggttcttcccgaggatcagtcggtaaccactcacaggcgaggaactacccctaagtgaagaagtacccctttatacctcaccccc

SEQ ID NO: 658495 - DNA, 338 bp, Homo sapiens
agacacggccgtagtgctccagtggtaccagtacagcagcatcgaaccgaggcaggccatcagcttgtcggcgatgtcacgcgcgcccggatgatatgtggtcgtccttctccggcgccacgcagccgagcacggacacgccggtgcgcatcacgtccatcgggtgcgccgacggcgggcagttcttccagcgccgcctttcaccgcggccgggatgccacggcaagcggacttcagcttgggctatgtagggaaaccagctcggcgccgggtcgggcagcattgccggtgcaccaaagcaggttaggcggggggatccctcttagaagtcggacctg

SEQ ID NO: 658496 - DNA, 642 bp, Homo sapiens
atgtctgctgtgaccacaggctcaggtccgagcctgctgcttggccacagcagtggctgggcgatgtgggaaccactatctcttgtggagcccccaaagagctgggaaagtgctggagggaaccaggcctttcccgcttttgcctggctgcagtggttcggctccgccccgtgccccccagccctcgttgtgtccacatccgcagctgcctctgcccctcgggggactggacacacatcctgccaggaggcgctatgaagcttggcccagatgaagccaggtgggctccgtgttcactcccactctcccgaggggtgctggcctccccagggtttgtcctatctatacggatttagacgaggttcgaggtctcagcctatcatgggcagctctcagtgattgtcattgttcctctttgcctgtgggtttaagttgcgtatttgtttaatcacaagtttgatacaaagatgttgttcatcgtagctctttggagatgcccattactactattcgaattaagctttgtactaattcgcatctggaagctcagcaagtgcacaaggccttactttgcgttaccgtggaaaccactgcctgccctccccgatgtggttgcgctcaataaagaatgctggaattcaa

SEQ ID NO: 658497 - DNA, 264 bp, Homo sapiens
tgcgtgcctgtagtcccatatacttgggaggctgaagcacaagaatcgcttgaacctgggagggtgaggttgcagtgagatgagattgtgccacggcagtacagcctgggtgacagagtgaacacctctctcaaaaaaaaaacgaaaattccagctgcatgcttatacgacctaacacatgaaccccagattccttccagctggtcacagttggacctggccagccatcttggcttcatccttcaacagaccttgcccacagaa

SEQ ID NO: 658498 - DNA, 230 bp, Homo sapiens
agcaggatccccaggtaaagatgcagaggatagggagatcatgttcttggggacagctatttgcgaggaaacaaggctgaggggtccactccgaacctctccacccgtgctgcaggtgctgcctatgatgagagatgagcagatggccatctcagggtggggccacaggtgcactgagacctagtagtttccaaaatccgacactcagacagagcatacttatctgattg

SEQ ID NO: 658499 - DNA, 176 bp, Homo sapiens
ccgaccctggagaattgagattcgtgcacaaattagcacggaaacgcgctccatataaagtcgacaaatcgtctccagagacacaacgaaaaatggacttgataccacaacaagccaacactatcatgaccaggaaaactcgacaacgaacatctttcttctacgaagagcacaac

SEQ ID NO: 658500 - DNA, 681 bp, Homo sapiens
gtgctgagattagttgagccggctaaatggtccattctgcattgtatttcatggctggaaatgaatatattcttttaccagcttttgagagacacattatgaatactatccataaggttaacattggaagctgtgttagttatatcaagagttaactttgcatacctaagtaacataggagagagtaaatatctttgtgagtcacccacattgggtgagacagaaaattgaagtctggttctaaaaatttgtaattatgctaacgttgatttgagttaggtgaaaactgggtacagtggtgtctgacttgagtttacaacatggtaacttgatgaactgtacaaagtagagacgaataagtcaaataattggttaacaaacatacaatacaccattaaaacaacaacagaagaacaaactaatataaaacaacaagatgtgcttcaccgacaacaaatcaaacagagaggcaccgcccagagaggggcgcgaccaccacagacacccacaaaacacgaggacaaacaaaccccaaaaaagcgacaggaacgagagcaacggcggcgtaacaccccaacagaacgagagagggaaaagaaacagtggccggacgggcggcaccaaaagaagcaaaaaaaatgacaagaaaacacaggggagccacacaaaacaaaacacgga

SEQ ID NO: 658501 - DNA, 142 bp, Homo sapiens
agccggtccgtctaacaggcttggggagatgttagcattttcatatatagattatggcatcaggaaatcgaaatagttttacttctatctttccaattggatgcctcttattcttttgtttgtttgtttgttttgttgtctc

SEQ ID NO: 658502 - DNA, 351 bp, Homo sapiens
tcagtcggtacgatcacatagaatgagcaatatgcagagtgaggtgagacggcgattcagcaggaatgtctccatgctctgaaactatgtggtcttatgctatatagttatctacttacagaaaataccaaagacgtccaaggccaccctgtcctgtcaacagaacttgctgctggccactcccaatccatctcataccattgggaattgattagtgctgtttctctatctttgtaaaaagaagtttcacttatttaggggtcgaggaatttaccaggttgagagagggatccttggttcttccaccagatactgttgttccattcccaaaacttggtccggttgcccttg

SEQ ID NO: 658503 - DNA, 462 bp, Homo sapiens
  misc_feature (219)..(219): n is a, c, g, or t
  misc_feature (256)..(256): n is a, c, g, or t
  misc_feature (264)..(264): n is a, c, g, or t
  misc_feature (270)..(270): n is a, c, g, or t
  misc_feature (282)..(282): n is a, c, g, or t
  misc_feature (291)..(291): n is a, c, g, or t
  misc_feature (313)..(313): n is a, c, g, or t
  misc_feature (320)..(320): n is a, c, g, or t
  misc_feature (326)..(326): n is a, c, g, or t
  misc_feature (337)..(337): n is a, c, g, or t
  misc_feature (341)..(341): n is a, c, g, or t
  misc_feature (344)..(344): n is a, c, g, or t
  misc_feature (351)..(351): n is a, c, g, or t
  misc_feature (355)..(355): n is a, c, g, or t
  misc_feature (365)..(365): n is a, c, g, or t
  misc_feature (373)..(373): n is a, c, g, or t
  misc_feature (385)..(385): n is a, c, g, or t
  misc_feature (398)..(399): n is a, c, g, or t
  misc_feature (444)..(444): n is a, c, g, or t
agccacgtgggcatccactccttttcctgcaagagatgatggttccattgctcttggcttcatggtgttcctggaaggcagatgagctggtcatttcgcctgggactcggcacctttccgagtgcagctggagggatctgagcgcaggaagacgcagaacaacagaaatagccgcccctccccgcccactgtcctgttggctatcatagatctctatgntcttgactttgtctctcctttccgagtcaatggtggnttacactnatcctngttccactgatnactctctcngacgagtccatcacctgcaacntaaatgnacaagnttacatcccantttngantgaagantttngaggtttttnttttaaanggctgtgtacanttatacttttttnntacacctgttcatttctacttaaatttatggcacagatttgatgngcaccagtcttgaggaaa

SEQ ID NO: 658504 - DNA, 405 bp, Homo sapiens
  misc_feature (349)..(349): n is a, c, g, or t
  misc_feature (382)..(382): n is a, c, g, or t
  misc_feature (392)..(392): n is a, c, g, or t
atttttttatattgactcatatatttaatgtagtaaacatttaatgtattaaactcctcatttcttcctgtaaataccaatttttatctggcatagtttcctttcggccccaaacacattctttagtatttatttcaatgcagttctgctggaaacaaactcttacaacttctgattatcagaaaatgtctttatttttgcagccatattcgagcagtatgtattggatataaaattctgggttagcatcatttttgttttttactttcagttctttaaaggttgctctattatcttttggcctttgttgtttcttatgagaagtcgcgtcatgcatattgctggcccnctgtaggtttatttgcttatgctgtttccaggnttgacctcancttgtttttttat

SEQ ID NO: 658505 - DNA, 1006 bp, Homo sapiens
  misc_feature (214)..(214): n is a, c, g, or t
ccacgacgtcgctgagagacagaggcagcgtgttggagctggctggtgcggtggtcagcgcgatgcccaaggccaagggcaaaacccggaggcagaagttggttacagtgtcaacgcgaaagcgtccgtgaaccggaatgctcgacggaaggtagcgccgtggatcgaatgctcccacatccgacatgcctgggaccacgctaaatcaggtacnggcgagaaccgtggccggagatggggttggatgtggaggcccgaacaggggggtgcacacatccggtaagagcaaaggtgaaggcccatggaggtggacgatagaggagagggcttaaagagcttgttcgggaagccacttgatgtgctgaatgaacgtggaggctagaagacagcattcgcgagataagaaggggaagatacatctgtcttggggatcgtcaattgaatatgtacgctacatggtagagaaccaccggggaggactataagagtgggcaagatttcctcgatacttgcaagaagaggaagatggaggtggagtgactggttgacactcaacagtgtggccctaggctgaggcgtccccgggaccagtgaaggctggagccaggggtgtaagggcaaggaggtgcttgtgtggttccacgaggagctggcaggtcccatgggaatcagacaggttacacacaacaccggtgcatagttccacggttctggggaagaagtgtcctcagaggtttcaatgatattcatctggggtcaggagaggcgaacgcggttgcggtggtggaggtatttgtgtgtcctatagcaattttaaggaagacaaagggggggctgagtacccggggccactagggatccggtggaaagggccaagaaggataaaggagagttaagagaggaaagtttggattaagggtttgggaaagagaacacagaaggaaatagggaagtggtggaggtttaatgcgtagataaaaaagagagtgagaatagcgtactttca

SEQ ID NO: 658506 - DNA, 247 bp, Homo sapiens
cccagatactggaggctgcagtgagctatgattgtacatgcacttcagcgctgggcaacaaagggaagccctgtctgaaaaaaaaaaaaaaaaaaaaaaaaaaattaaatcaaaattaaattatacacgcggcccccttcaaatgcaatcccgtgcccctttccttttctttctttttccctggtcgcctttcacttttgaacttactacatatagcgattaattacattcgtcactcttccttggc

SEQ ID NO: 658507 - DNA, 306 bp, Homo sapiens
actcaatctagtctggccctggtgactcacgcctttcggaggcagaggtgggagaatcgcttgagcccagaagtttgagaccagcctgggccacacgacaaagccccatttctacaaaaaaaaaatacaaaaaaaaagccagatgtggtggcatgcacctgtagtttaagctacttgggaggatgaagtgggaggactgcttgagccggggaggtggaggctggagtaaactgagatcgcgccacagaactccagtttgagcaacagatcgagaccctgcctgaaaataaatcaataaatacactc

SEQ ID NO: 658508 - DNA, 100 bp, Homo sapiens
tagtgttctagacggatcccttttcatagaggccacggaacctagaatcaggaagcacatggccacccacgatctaaagcagaaatccaggaaatcccat

SEQ ID NO: 658509 - DNA, 177 bp, Homo sapiens
cacattaatgccacatggccccgttcctcttcagtgagaacttcagttgaactagccagaaatcaggttgaggaagaaaacggggagccatggcctcgatgccctttctgtaccatttcattgtgctccccacactttaagccggattggctcccattgtcgggtacctgtatgctc

SEQ ID NO: 658510 - DNA, 131 bp, Homo sapiens
tgtctgtagcatatgagggttctgatttttccacgggtttgaagtggtatctcatggtggttttaatttgcatttccctaatgactaatgcaacctttcgtatgcttgttgtccatttgtatatctttgga

SEQ ID NO: 658511 - DNA, 119 bp, Homo sapiens
agaactaccaagtagaacaattaaagggttcaaatttggttggaaagaaaaaatcggccagtgggagtaggctcatgcccatgtaatctcaacactatggaaagctagagcgtaggagg
